United States Patent 11,098,302 (IDENTIFICATION OF POLYNUCLEOTIDES ASSOCIATED WITH A SAMPLE) - sequence listing, part 83

SEQ ID NO: 286786 - DNA, 553 bp, Homo sapiens
  misc_feature: GYAE6OF02GLODP.13.37.D04.1.454.CMB.1.raw
tcagtcacgtactacacgaccggtgctcgatttagtagcatactgttgggtttggggctggccctcagtaagcagcatcggaggtgcctcagccatggcatggatccctctcttcctcggcgtcctggcttactgctcagcctccatggcctcctataaggtgacccaggcaccctcagtgtccgtgcccccaggacagacagccatcatcacctgctctaggaaataattggcagataaatatacttcctggtatcagcaagaagtcaggccagtcccctgtgctggtcatctatcaagatcgccgaagccggccctacgagggactcccgtgacgcgtacttctcgtggcctccaacgtcgtagggaacctcgacgaccactctacgaccatcgacggccgggacccaggctagtgagtgacgctgacttattacgtgtacgagggtccggtagggacgagacacgacacgtcgccctgtacgtcgtcgtacggaacgtcgggaacgtacggtaccgaccgtaccgtaagtccgaccgtacccgaacccgg

SEQ ID NO: 286787 - DNA, 706 bp, Homo sapiens
  misc_feature: GYAE6OF02JC73B.13.37.D04.1.454.CMB.1.raw
tcagtcacgtactacacgaccggtgctcgatttagtagcatactgttgggtttggggctggccctcagtaagcagcatcggaggtgcctcagccatggcatggatccctctcttcctcggcgtcctggcttactgctcagcctccatggcctcctataaggtgacccaggcaccctcagtgtccgtgcccccaggacagacagccatcatcacctgctctggagataaagttgggggataaatttgcttctggtatcagaagaagccaggccagtcccctgtggtggtctattatcaaagactaaccaaacggccctacgaacgggactacccgtggacgtcgtagttctcgtcggttccaactcgtagggaatcgacgcctactctacgaccagtacaacgggactacgaggtactaagtggagtgacggtctacgtaacttacgttaacgtcgtacgtagggttacggttacgggaactaggaacctaaaccgtaccgtacgtttagggttacgggttaacggttaccggggtaacgggaaccggggaaccgtaaagggtaccttaccggggtaacccgtaccgggtttaaccgggtaaccgtaaccgggtaaccccgtaaccgggtaaccgtttccccgggaccccccggtttaccgggttaccctaacccggtttaccccggttccccggtttaaccccccg

SEQ ID NO: 286788 - DNA, 569 bp, Homo sapiens
  misc_feature: GYAE6OF02F60RU.13.37.D04.1.454.CMB.1.raw
  modified_base (517)..(517): a, c, t, g, unknown or other
  misc_feature (517)..(517): n is a, c, g, or t
  modified_base (535)..(535): a, c, t, g, unknown or other
  misc_feature (535)..(535): n is a, c, g, or t
  modified_base (556)..(556): a, c, t, g, unknown or other
  misc_feature (556)..(556): n is a, c, g, or t
tcagtcacgtactacacgaccggtgctcgatttagtagcatactgttgggtttggggtctgagagaggagcccagccctgggattttcaggtgttttcatttggtgatcaggactgaacagagagaactcaccatggagtttgggctgaactggctttttcttgtggctattttaagaggtgtccagtgtgaggtgcaactgttggagtcgtggggggaggcttggttcagccgtggggggtccctgagactctcgtgtgcagcctctggtattttagttttagctagttatgccatgagcgtcgggtcccgccgagggcctccgagggggaaggggcgtggggaggttggggtttcgggtattaggtgcttcttgatgatagcacatactatgcagctaccggttaagggcctctcacctatcctccagacgactaaattacccaaagaaccacgacttaatactctgaccagatagaccaggcctgggacgccggagaccgacggtccgtttaancgtagtgtcgagtaaagnttagttagaagtgagtggtanctgtacctattac

SEQ ID NO: 286789 - DNA, 546 bp, Homo sapiens
  misc_feature: GYAE6OF02IFMI2.13.37.D04.1.454.CMB.1.raw
  modified_base (299)..(299): a, c, t, g, unknown or other
  misc_feature (299)..(299): n is a, c, g, or t
  modified_base (473)..(473): a, c, t, g, unknown or other
  misc_feature (473)..(473): n is a, c, g, or t
tcagtcacgtactacacgaccggtgctcgatttagtagcatactgttgggtttggggctggccctcagtaagcagcatcggaggtgcctcagccatggcatggatccctctcttcctcggcgtcctggcttactgctcagcctccatggcctcctataaggtgacccaggcaccctcagtgtccgtgcccccaggacagacagccatcatcacctgctctggagataaatggcagataaatatacttcctggtatcagcagaagtcaggccagtcccctgtgctggtcatctatcaagntgccaagccggccctcgacgggactcccgtgagcgtattcctctcggcctccgaactcgtagggaacctcgacgcccacttctagacccatccaggccgggacccaggctagtcggatgaggctagactattcgtgtacgagggcgtgggacagcaacgctaccgtcgcccgtntacgtcgttaccgtacgggaaccgtacgggacctacggtaccacccggttaccgtaagtccgtaccgaccccg

SEQ ID NO: 286790 - DNA, 487 bp, Homo sapiens
  misc_feature: GYAE6OF02GQEF1.13.37.D04.1.454.CMB.1.raw
tcagtcacgtactacacgaccggtgctcgatttagtagcatactgttgggtttggggctggccctcagtaagcagcatcggaggtgcctcagccatggcatggatccctctcttcctcggcgtcctggcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagccgggacccaggctatggatgaggctgacctattactgtcgagcgtgggacagcagcactcgcccgctatcgtcttcggaacgtgggaccaggtccaccgtctagtcaccgg

SEQ ID NO: 286791 - DNA, 173 bp, Homo sapiens; identical to SEQ ID NO: 286716
  misc_feature: GYAE6OF02FZYCN.13.37.D04.1.454.CMB.1.raw
  modified_base (173)..(173): a, c, t, g, unknown or other
  misc_feature (173)..(173): n is a, c, g, or t

SEQ ID NO: 286792 - DNA, 208 bp, Homo sapiens
  misc_feature: GYAE6OF02GTEMD.13.37.D04.1.454.CMB.1.raw
  modified_base (193)..(208): a, c, t, g, unknown or other
  misc_feature (193)..(208): n is a, c, g, or t
tcagtcacgtactacacgaccggtgctcgatttagtagcatactgttgggtttgggacgagcaacacctatgtggtattcggcggagggaccaagctgacccgtcctaggtcagcccaagggctgccccctcggtcactctgttcccaccctcctctagtacgtgactgagcgggctggcaaggcgcatagcnnnnnnnnnnnnnnnn

SEQ ID NO: 286793 - DNA, 715 bp, Homo sapiens
  misc_feature: GYAE6OF02HIS2S.13.37.D04.1.454.CMB.1.raw
  modified_base (224)..(224): a, c, t, g, unknown or other
  misc_feature (224)..(224): n is a, c, g, or t
  modified_base (237)..(237): a, c, t, g, unknown or other
  misc_feature (237)..(237): n is a, c, g, or t
  modified_base (260)..(260): a, c, t, g, unknown or other
  misc_feature (260)..(260): n is a, c, g, or t
  modified_base (293)..(293): a, c, t, g, unknown or other
  misc_feature (293)..(293): n is a, c, g, or t
  modified_base (316)..(316): a, c, t, g, unknown or other
  misc_feature (316)..(316): n is a, c, g, or t
tcagtcacgtactacacgaccggtgctcgatttagtagcatactgttgggtttggggctggccctcagtaagcagcatcggaggtgcctcagccatggcatggatccctctcttcctcggcgtcctggcttactgctcagcctccatggcctcctataaggtgacccaggcaccctcagtgtccgtgcccccaggacagacagccatcatcacctgctctgganataaattgggganaaattgcttcctggtatcagaanagccaggccagtcccctgtggtggtcagtttancaagactaccaaacggcccctanagggactccctgacgcgtattcctcgttcggttacccaactcgtaggggaaacttaccacggtcccaactcctaggaacccacgttaccgaaccggggtacctcgaacgggtccttaaagttcgggtaacttgggaaacggtaccgttacggtaacctttaacgttttaccgtacggtttacggtagggttcgggtaggggacacggacaaacccgtacccgttaagtcggttagggttacgtttccgggacggggtaaacgggtacccgtaaagccggtacggaacccgggtttacccgtaacggggttaccaaccggtaccccgtaaacgggccccgttaccggaccccccggttcggtacccctaacccgtttccgttccccgtttaacccccccg

SEQ ID NO: 286794 - DNA, 703 bp, Homo sapiens
  misc_feature: GYAE6OF02H3KMP.13.37.D04.1.454.CMB.1.raw
tcagtcacgtactacacgaccggtgctcgatttagtagcatactgttgggtttggggctggccctcagtaagcagcatcggaggtgcctcagccatggcatggatccctctcttcctcggcgtcctggcttactgctcagcctccatggcctcctataaggtgacccaggccaccctcagtcgtccgtcgccccccaggaccagacagccatcatcacctgctacgtggagataaagttgggggaataaagtttgcttcctgggtatcgaaggaagaacgccgaggccacgtccccgtggtcggtcggtactagtttatacaagactaacccgaaccggccccttacgaacggggtactcccgtaggacgtacgtactttcgtccttacgggtttacccaacgttaccgtaggggaacttaccgacggaccctcgttaccgtacggtaaccaacttaccgggaacggaccttaacgacggtacgtacgtaggtacgtaggtacggtacgtacgtaacgtactttacgtacgtttacggaaggttggtaacgggacgacgttaccaaacgtacttacgtggtaggtacggttacgacggggaacggtaaccagtccgaccgtcggttacccgtaaggtcctacggacccgtaacgggtcctacccggtcccctaggtaacccgtccgttccgtcccgtcccccg

SEQ ID NO: 286795 - DNA, 192 bp, Homo sapiens
  misc_feature: GYAE6OF02F9IG8.13.37.D04.1.454.CMB.1.raw
  modified_base (189)..(192): a, c, t, g, unknown or other
  misc_feature (189)..(192): n is a, c, g, or t
tcagtcacgtactacacgaccggtgctcgatttagtagcatactgttgggtttgggacagcaacacctatgtggtattcggcggagggaccaagctgaccgtcctaggtcagcccaaggctgccccctcggtcactctgttcccgccctcctctagtacgtgactgagcgggctggcaaggcgcatagnnnn

SEQ ID NO: 286796 - DNA, 842 bp, Homo sapiens
  misc_feature: GYAE6OF02GKU5G.13.37.D04.1.454.CMB.1.raw
  modified_base (238)..(238): a, c, t, g, unknown or other
  misc_feature (238)..(238): n is a, c, g, or t
tcagtcacgtactacacgaccggtgctcgatttagtagcatactgttgggtttggggctggccctcagtaagcagcatcggaggtgcctcagccatggcatggatccctctcttcctcggcatcctggcttactgctcagcctccatggcctcctataaggtgacccaggcaccctcagtgtccgtgcccccaggacagacagccatcatcacctgctctggagataaagttgggganaatttgcttctggtatcagaagaagccaggccagtccctggtggtggtcatttatacaagactaaccaaaccggccctacgacgggtactccccgtaggacgtcgactttcctcgttcgggttaccctaaacgttccgtagggggaaacttaaccgacggacccctaaccttccgtaccggtaaccctaacgttacccggaaacccgggggtaccttaccggaaccgggtaccgtttaacggttaggggtaacgttacggggaacgggtaccgttaacggtaaaccctttaacgttttaacccggttgggttaacccggttagggggttacgggttaacgggggaaccgtaacgggtaaacccgaaaccgttaacccgtttaaggtttacgggtttacggggtttaacgggtttcccgggggaacccggggtaacggggtaacccgaacgggttacccgttaccggtaaccccgggtttaccgttaaccgggttacccggtaacccgggtacccccggttaaaccgggtccccggttaccccgggttacccccccggttaccgggttaccccgtttaccccgtttccccggtttaccccccggg

SEQ ID NO: 286797 - DNA, 459 bp, Homo sapiens
  misc_feature: GYAE6OF02GZ92G.13.37.D04.1.454.CMB.1.raw
  modified_base (423)..(459): a, c, t, g, unknown or other
  misc_feature (423)..(459): n is a, c, g, or t
tcagtcacgtactacacgaccggtgctcgatttagtagcatactgttgggtttgggggacagccatcatcacctgctctggagataaattgggggagaaatttgcttcctggtatcagaagaagccaggccagtcccctgtggtggtcatttatcaagatacccaaacggccctcagggatccctgagcgattctctggttccaactctgggaatacagccactctgaccatcaacgggctcaggctatggatgaggctgactattactgtcaggtgtgggacagcaacacctatgtggtattcggcggaggacaagctgaccgtctaggtcagcccaagctcgcccctgtcactctcgtccccacctcctctagtcgtgacctgacgccgggctcggcgaacgggcgtcaagtacgagtcannnnnnnnnnnnnnnnnnnnnnnnnnnnnnnnnnnnn

SEQ ID NO: 286798 - DNA, 709 bp, Homo sapiens
  misc_feature: GYAE6OF02JMFV6.13.37.D04.1.454.CMB.1.raw
  modified_base (225)..(225): a, c, t, g, unknown or other
  misc_feature (225)..(225): n is a, c, g, or t
  modified_base (248)..(248): a, c, t, g, unknown or other
  misc_feature (248)..(248): n is a, c, g, or t
tcagtcacgtactacacgaccggtgctcgatttagtagcatactgttgggtttggggctggccctcagtaagcagcatcggaggtgcctcagccatggcatggatccctctcttcctcggcgtcctggcttactgctcagcctccatggcctcctataaggtgacccaggccaccctcagtcgtccgtcgcccccaggacagacagccatcatcactgctctganataagtgggataattcgcttccngtatcaagaacgagccgaggcctacgtcccgtgtggtggtactatttacacaacgactaacccgaacggcctacgacggtactacccgtgacgtcgtattcgtacgtacggtaccaacgttcgtacgggtaactacgaacgccgtaactcgtacgacctaagtaccgaacggtactacgaggtactaagtaggacgtacggacggtacgttagtaaccttaagttacgttggtacggtaggtaccgggtaggaaccgaggtaccgaacgtaccgtaaccgtccgggaccccgttacgttacgttacgggttaccgttaaccggggtaaaccgtaccggggtaaccgtaacgggttaaccccgtcccggttaaaccttaaacgggtcccgtaaaccggacccggtaaacccggaaccccctaaacccgtcggttaacccgttaccgtacccgttaacccccg

SEQ ID NO: 286799 - DNA, 547 bp, Homo sapiens
  misc_feature: GYAE6OF02IG42J.13.37.D04.1.454.CMB.1.raw
  modified_base (227)..(227): a, c, t, g, unknown or other
  misc_feature (227)..(227): n is a, c, g, or t
  modified_base (335)..(335): a, c, t, g, unknown or other
  misc_feature (335)..(335): n is a, c, g, or t
  modified_base (379)..(379): a, c, t, g, unknown or other
  misc_feature (379)..(379): n is a, c, g, or t
  modified_base (442)..(442): a, c, t, g, unknown or other
  misc_feature (442)..(442): n is a, c, g, or t
  modified_base (476)..(476): a, c, t, g, unknown or other
  misc_feature (476)..(476): n is a, c, g, or t
tcagtcacgtactacacgaccggtgctcgatttagtagcatactgttgggtttgggggggggtcacaagaggcagcgctctcgggacgtctccaccatggcctgggctctgctgctcctcactctcctcactcaggacacaggtcctgggcccagtctgccctgactcagcctgcctccgtgtctgggtctcctggacagtcgatcaccatctctgcactggaaacngcagtgatcttgggacttatagtacttgtctcctgtaccaacaccaccagaccaacgaccccaaactcaattaatttatgtatttacactaactccggccctcgagtntatctaatcgtcttcatgcctacagtcagcaacacgtcctaccngaccatctcgtcggcctcaggcaaggacggacgaggctagtaatttatcgtcgcggtctcggngtacgtattcgacctacctttgcgttcgtacggntgtacgactaacggtcgcccgttacgtacggtaccacgacccgacgacccaacccgtctacgtccacttcc

SEQ ID NO: 286800 - DNA, 174 bp, Homo sapiens
  misc_feature: GYAE6OF02FV0XP.13.37.D04.1.454.CMB.1.raw
  modified_base (174)..(174): a, c, t, g, unknown or other
  misc_feature (174)..(174): n is a, c, g, or t
tcagtcacgtactacacgaccggtgctcgatttagtagcatactgttgggtttgggggaagaggaagactgacggtccccccaggagttcaggtgctgggcacagcggccctgggctgcctggtcaaggactacttcctagtacgtgactgagcgggctggcaaggcgcatagn

SEQ ID NO: 286801 - DNA, 181 bp, Homo sapiens
  misc_feature: GYAE6OF02JJ4PJ.13.37.D04.1.454.CMB.1.raw
  modified_base (173)..(181): a, c, t, g, unknown or other
  misc_feature (173)..(181): n is a, c, g, or t
tcagtcacgtactacacgaccggtgctcgatttagtagcatactgttggtttgggggaagaggaagactgacggtcccccaggagttcaggtgctgggcacagcggccctgggctgcctggtcaaggactacttcctagtacgtgactgagcgggctggcaaggcgctatagnnnnnnnnn

SEQ ID NO: 286802 - DNA, 591 bp, Homo sapiens
  misc_feature: GYAE6OF02FUH39.13.37.D04.1.454.CMB.1.raw
  modified_base (224)..(224): a, c, t, g, unknown or other
  misc_feature (224)..(224): n is a, c, g, or t
  modified_base (302)..(302): a, c, t, g, unknown or other
  misc_feature (302)..(302): n is a, c, g, or t
  modified_base (492)..(492): a, c, t, g, unknown or other
  misc_feature (492)..(492): n is a, c, g, or t
tcagtcacgtactacacgaccggtgctcgatttagtagcatactgttgggtttggggctggccctcagtaagcagcatcggaggtgcctcagccatggcatggatccctctcttcctcggcgtcctggcttactgctcagcctccatggcctcctataaggtgacccaggcaccctcagtgtccgtgcccccaggacagacagccatcatcacctgctctgganataagttgggggataaatttcgcttcctggtatcagcagaagtcaggccagtcccctgtcgctggtcatctatcaagntcgccaaggccggccctagagggactccgtgacgcgtattccgtcgtcggcctaccaactcgtaggaacctcgacgcccactctacgaccatccgaggccgggaccaggacttagtggatcggagtctagtaccttattacctggtacgagggtcgtacgggacacggcgtacgcctactccggcccgtnttagtccgttaccggttaccgggtaacggtccgggaaccgtacggttaccctacccgttacggtaaacggtccgaccggtaccccgaacggtacccccc

SEQ ID NO: 286803 - DNA, 592 bp, Homo sapiens
  misc_feature: GYAE6OF02HC9AP.13.37.D04.1.454.CMB.1.raw
tcagtcacgtactacacgaccggtgctcgatttagtagcatactgttgggtttggggctggccctcagtaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctagaaataatggacagataatatacttctgtatcagcagaagtcaggccacgtccctgtcgctggtcatctatcaagatcgaccaacggccggaccctacgacgggtactcccgtagacgtcgtatttcctcgtcggtacctaccaacgtcgtacggacctcgacgtaccctactcgacgacctacgtaccgacggacccgggaacccaggtactagtcggagtacggacggtctagtacttagttacgtcgtacgtacgggcggtacggacaggaccacgcctacgtccgacccgtagtacggtcgttacgttaccggaacgtcgggtaacccgtacggtaccctaacccggtactacggaccgtaacccgg

SEQ ID NO: 286804 - DNA, 843 bp, Homo sapiens
  misc_feature: GYAE6OF02GWFID.13.37.D04.1.454.CMB.1.raw
  modified_base (128)..(128): a, c, t, g, unknown or other
  misc_feature (128)..(128): n is a, c, g, or t
  modified_base (130)..(130): a, c, t, g, unknown or other
  misc_feature (130)..(130): n is a, c, g, or t
  modified_base (166)..(166): a, c, t, g, unknown or other
  misc_feature (166)..(166): n is a, c, g, or t
tcagtcacgtactacacgaccggtgctcgatttagtagcatactgttgggtttggggctggccctcagtaagcagcatcggaggtgcctcagccatggcatggacctcctctctcgcgctcgtgtctncnctagctcctcagtcgtcctctaagtaggtccaccgngcctcctgtgtcgtccgcccgacccgagacacgacgacgaactctactactaccctaccgtcgtcctcggtaagggaaataaaacgttaagggggttacggggaaaatttaacgtttcgttacccgttccggttaggtactacggacaacgtaaaggtaccgtacggaccggtaccgtaccccgttccgtggtcgttacggttcggacctacgttactacgtaacgtaaacgcgtcccgaaacggaacccggccccggttacctaccggggaacggttacccctccggtaaggacggtaccttaccttttcgccgtacgtacccctaaaccgtcggtacggtaaacgaacctccggaaccctaccctatccgtacgaacctcgtacggaccgggacccgaacgtcggtaactgggtacgtagacggtcgtcgttaacgtacttacgtccgtcggtacggacgggttcgggtaacggaccgaggtaacccgtcgaacccttaccgggtccccgtaacccgttagttcccggttttaccggttaacccggggttaacccgggttaaaccggggttaacccctaaaccgggttaaccggttaccccccgttaacgggttaacccgtttaaccggacccggaacccccggttaaacccgggaaacccccgttaaccccccg

SEQ ID NO: 286805 - DNA, 452 bp, Homo sapiens
  misc_feature: GYAE6OF02F5219.13.37.D04.1.454.CMB.1.raw
  modified_base (353)..(353): a, c, t, g, unknown or other
  misc_feature (353)..(353): n is a, c, g, or t
  modified_base (367)..(367): a, c, t, g, unknown or other
  misc_feature (367)..(367): n is a, c, g, or t
  modified_base (435)..(435): a, c, t, g, unknown or other
  misc_feature (435)..(435): n is a, c, g, or t
  modified_base (437)..(452): a, c, t, g, unknown or other
  misc_feature (437)..(452): n is a, c, g, or t
tcagtcacgtactacacgaccggtgctcgatttagtagcatactgttgggtttgggggacagccatcatcacctgctctggagataaattgggggagaaatttgcttcctggtatcagaagaagccaggccagtcccctgtggtggtcatttatcaagataccaaacggccctcagggatccctgagcgattctctggttccaactctgggaatacagccactctgaccatcgaacgggactcaggctatggatggaggctgactattactgtcgaggttggtgggacagcaacacctagtggtggtatcgggcggagggaccaagctgaccgtctagtcacgcccaaggccncgtcccctcggtcncctctcgttccccgccctccgtactacgtacgtcgactcggaggcgggcgtggcgaaggtcgacatgncnnnnnnnnnnnnnnnn

SEQ ID NO: 286806 - DNA, 697 bp, Homo sapiens
  misc_feature: GYAE6OF02IVTP2.13.37.D04.1.454.CMB.1.raw
  modified_base (229)..(229): a, c, t, g, unknown or other
  misc_feature (229)..(229): n is a, c, g, or t
  modified_base (677)..(677): a, c, t, g, unknown or other
  misc_feature (677)..(677): n is a, c, g, or t
tcagtcacgtactacacgaccggtgctcgatttagtagcatactgttgggtttgggggaggcttggttcagcctggggggtccctgagactctcgtgtgcagcctctggattttagttttagcagttatgccatgagctgggtccgccaggctccagggagggctggagtgggtttcggtattagtgctcttgatgatagcacatactatgcagactccgttaaggccncttcacctatctccagagacaacttaccaagaacacgctatatctgcagatagaacagccgtggacgccggaggaccgtacggtcctttagtcacgtgtagacgaaacgtattacgttagtaatggagtcggtaacgcttacggaccttaacttacttactttttgaaccttacggtcggggacccgtacgggaacccgttcggtacctacccgttcctccgttacgaccgtacccctacccgaaccgaaccgggtaccctacgttcccggttaccccgttcccccgtacgggtaccccctacccctaccccgttaacccaacggtaccgaccctacccgttcgggtaccggggaccaccggtaccggcccggtaccgtagggtccgtccgtccgtacggtaccggaacgttacccgttacgtaccgtacgtacgttcgacgtacggnggtaccgggcgtaggaccgg

SEQ ID NO: 286807 - DNA, 614 bp, Homo sapiens
  misc_feature: GYAE6OF02GEB8C.13.37.D04.1.454.CMB.1.raw
  modified_base (232)..(232): a, c, t, g, unknown or other
  misc_feature (232)..(232): n is a, c, g, or t
tcagtcacgtactacacgaccggtgctcgatttagtagcatactgttgggtttggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcacgtaggaaacngcagtgatcgttggacttatagtacttgtctctgtaccaacaccaccagcaacgccccagagtcatcattagtggggacaagtacggcgcgtcgagggtactttccacgtcgtcttcgtctcggtcctaccgtaagttcgtcggacaacgccggccctacctagactaactccgttcgtggtcctacgacggtctaggacgggacgacggtcctcggtaccttagttacgtcgtctcgccttactagtcgtgtacgttacggtttccttcgttggttcggttccgttcgggacgggtacggtaccgtaacggtccgtaccggttacggtacggtccgaaccggtacccgacggtccgtcccggtccccgttcgtcctacccg

SEQ ID NO: 286808 - DNA, 663 bp, Homo sapiens
  misc_feature: GYAE6OF02G64KU.13.37.D04.1.454.CMB.1.raw
  modified_base (239)..(239): a, c, t, g, unknown or other
  misc_feature (239)..(239): n is a, c, g, or t
tcagtcacgtactacacgaccggtgctcgatttagtagcatactgttgggtttggggctggccctcagtaagcagcatcggaggtgcctcagccatggcatggatccctctcttcctcggcgtcctggcttactgctcagcctccatggcctcctataaggtgacccaggcaccctcagtgtccgtgcccccaggacagacacgccatcatcacctgctctggagataaagttgggganaaattgcttcctggtatcagaagagccaggccagtcccctgtggtggtcatttatcaagataccaaacggccctcgagggactcccgtgacgcgtatttctcgttacggttccaacttctggggaattacacgccactccgtgaacccatccgaaacgggtcctacgaacggtacttaagttacggagttaggacggtcttacgtaacgttaagttacttggtaccgtaggttggtacgggacaggtaccaaacctacccgttagtcggttaggtacgtttaccggggtacgggtaacgggaacccgaaggtaccgtacggtacccgttaccgttacggggtacccaacgggtaccccgtaacgggcccgttaccggtccccccgttaggtacccctacgttacccgttccgtttacccccccg

SEQ ID NO: 286809 - DNA, 706 bp, Homo sapiens
  misc_feature: GYAE6OF02I80M0.13.37.D04.1.454.CMB.1.raw
  modified_base (221)..(221): a, c, t, g, unknown or other
  misc_feature (221)..(221): n is a, c, g, or t
  modified_base (267)..(267): a, c, t, g, unknown or other
  misc_feature (267)..(267): n is a, c, g, or t
  modified_base (289)..(289): a, c, t, g, unknown or other
  misc_feature (289)..(289): n is a, c, g, or t
  modified_base (311)..(311): a, c, t, g, unknown or other
  misc_feature (311)..(311): n is a, c, g, or t
  modified_base (334)..(334): a, c, t, g, unknown or other
  misc_feature (334)..(334): n is a, c, g, or t
  modified_base (388)..(388): a, c, t, g, unknown or other
  misc_feature (388)..(388): n is a, c, g, or t
  modified_base (465)..(465): a, c, t, g, unknown or other
  misc_feature (465)..(465): n is a, c, g, or t
tcagtcacgtactacacgaccggtgctcgatttagtagcatactgttgggtttggggcgtggccctcagtagcagccatcggagtgcctcacgccatggcatggatccctctctcctcggctcctgcttacgttttccagcctcatcggcctcctataggtcacccaggccaccctgagtcgtccgcgacccccaggacctagacacgtcccatcgatccncctgacctcgtaggaagtagtaagtggggataacttcgcgttccgnggttacacgaaggaacggaacnccgaacgccgtacgttccccgngggtcgtacgtcctagtttacgnaaacgtcctaaccgaaccggttcccaggtaccggtactcccgagcgtaccggtnttccggtctacggtcaacgtgtacggaacttcgacgtctaaccgtgtaaaccgtacctagacgtaacccgggttacncggactaccgtagtagggtacctaagtccggtaaccttggtaaaccttacgttaaccggtcggttaacgtacgggtttcgggaaccgttacggaactaacccgttacccgaattaacgggtcgtaccggtttaacgggccgggtaaggtaaccgactacggtccgacggttaccgacgtcggtaccgactaacccggtcgtacgttacccggccttccgaagtaccctccgtccgtacccc

SEQ ID NO: 286810 - DNA, 1114 bp, Homo sapiens
  misc_feature: GYAE6OF02I3L08.13.37.D04.1.454.CMB.1.raw
  modified_base (229)..(229): a, c, t, g, unknown or other
  misc_feature (229)..(229): n is a, c, g, or t
tcagtcacgtactacacgaccggtgctcgatttagtagcatactgttgggtttggggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatcctctgcactggaacngcgagtcgatcgttgggacttagtacgtcgttgtccttcctacggtaacccaaccacccaaccccgacggaccgaaccggacccccagaacgttcctacgttacgtaacgttttagggtacgggggtactaaacggttacggggtaccccgggtacccggtaccggtaacggggttacgttttaccccgtaaccgttcccgggttcccgttttacccgttcccgggttaccggggtacccctttacccggtaaaaccgggttccggtttaccggggaaccccgtaaacccgtaccccccgggggttacccctttaaccccgtacccgggtaaacccgttaaacccgtttcccgggtttacccgggtttacccggggtacccccgttttaaaccccgggaccggggggtttaacccgttaaccggggggtaaccggggtaaacccccgggtcggggttaaccccgtttaaccgggttaaacccgttttaaccccgttttaaccccggggtttaccgggttccccgtttaaccgggtacccccgttttaacgttaccgggttaaggttttaccccgggtccggtttttaaccgggtttaccccggttttttacgggttttaaccgggtttccccgggggttttaaacccgggttttccccggggggggttacccgggggtttaacccgggggttaaccccgggtttaaaaccgggtttcccccgggggttaaacccccggttttacccgggggttaaaccccgggtttacccgggtttaacccgggtaacccccccgggggtttaacggggttaacccccccggtttccccccggggttaaaccccccccgggtttccgggggttacccccgtttaaccccccgggg

SEQ ID NO: 286811 - DNA, 747 bp, Homo sapiens
  misc_feature: GYAE6OF02HAVTN.13.37.D04.1.454.CMB.1.raw
tcagtcacgtactacacgaccggtgctcgatttagtagcatactgttgggtttggggctggccctcagtaagcagcatcggaggtgcctcagccatggcatggatccctctcttcctcggcgtcctggcttactgcacaggatccgtgcctctatgagctgactcacgcccaccctcagtcgtccgtcgtccccgaggacagacagccagtcatcacctgctacgtagaaaattaagtggacaagtaataaatactacttccgtagtactacgagtacaaggtaacgtcgacggtccctaacggttcccctggtcgcgttaggtcctactctaatacgaacgtatcaccgaacgcccgtaacccgtaggacgggtaccttaccccgtaggaacgtccgtaacgttttccgtccggtaccggttaccttaacccgtaaccgttaccgggtaaccgggtaaccctttacggaacccctaccctaaccgttccggttaaacgaaccccgtacgtaccggaaacccggggaccccgggtaaacccgtacgggtaacctttaagggtaccgggttaacgtacggggtaccgtaaccgttaacggtaaccttttaacgtacgttaccgtacggtacgggtacgggtacgaccgtacggaacgtacgccgtacgtccgaccgtcgtaggttccgtacgtacggtaccgtacggtaaccgtacggtcctacccggtacgtaacgcccgtaacccg

SEQ ID NO: 286812 - DNA, 205 bp, Homo sapiens
  misc_feature: GYAE6OF02F7B3E.13.37.D04.1.454.CMB.1.raw
  modified_base (174)..(205): a, c, t, g, unknown or other
  misc_feature (174)..(205): n is a, c, g, or t
tcagtcacgtactacacgaccggtgctcgatttagtagcatactgttgggtttgggggaagaggaagactgacggtccccccaggagttcaggtgctgggcacagcggccctgggctgcctggtcaaggactacttcctagtacgtgactgagcgggctggcaaggcgcatagnnnnnnnnnnnnnnnnnnnnnnnnnnnnnnnn

SEQ ID NO: 286813 - DNA, 785 bp, Homo sapiens
  misc_feature: GYAE6OF02GU47A.13.37.D04.1.454.CMB.1.raw
  modified_base (168)..(168): a, c, t, g, unknown or other
  misc_feature (168)..(168): n is a, c, g, or t
  modified_base (293)..(293): a, c, t, g, unknown or other
  misc_feature (293)..(293): n is a, c, g, or t
tcagtcacgtactacacgaccggtgctcgatttagtagcatactgttgggtttggggtctgagagaggagcccagccctgggattttcaggtgttttcatttggtgatcaggactgaacagagagaactcaccatggagtttgggctgaactggctttttcttgtggntattttaagaggtgtccagtgtgaggtgcaactgttggagtcgtgggggagtcgttggttcaggccggtgggggtccctgagctctcgtgtgcagcctcgtggtattttagtttagcgtagttancgcctagtgagtcgtcgggtccgccgtaggccgtaccggaaggggaacgggcgttgggaggttgggttttacgggtattaggtgtcgttgttcgtagtgtagtacgacaataacgttaagtagtcgaccgtaaacgtacccgtttacccgggttaaacgggtcccggtaccttacccgtaaccctacgtacccgttaccccgaaagggtaaccctaaacctaaacttaccccgaaaaacggtaacccgtaaacccgtaccttaaagtttacccgtcgttaacggacccgtaaaagtaacgttacggaaaccgttcgggtaacccggggttaggggaacccgtaaccccggggacggtaacccggtacccggggttaccttttaaaccgcgtaacgttacggtaggaacccgtaaaaggttaccttaagttaacggttaagttgtaacgggttcggtaaccgtaccttacggttaacgttaccctttaaccgg

SEQ ID NO: 286814 - DNA, 573 bp, Homo sapiens
  misc_feature: GYAE6OF02GWABQ.13.37.D04.1.454.CMB.1.raw
  modified_base (223)..(223): a, c, t, g, unknown or other
  misc_feature (223)..(223): n is a, c, g, or t
  modified_base (227)..(227): a, c, t, g, unknown or other
  misc_feature (227)..(227): n is a, c, g, or t
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (289)..(289): a, c, t, g, unknown or other
  misc_feature (289)..(289): n is a, c, g, or t
tcagtcacgtactacacgaccggtgctcgatttagtagcatactgttgggtttggggctggccctcagtaagcagcatcggaggtgcctcagccatggcatggatccctctcttcctcggcgtcctggcttactgctcagcctccatggcctcctataaggtgacccaggcacccctcagtgtccgtgcccccagggaccagacagccatcatcacctgctcngganataagttgggganaattgcttcnggtancagagagccaggccagtcccctgtcggtggtacntttagtcaagataacccaaacgggtcccctcgacgggtactcccgtggacgcgtattctcgttacggttccaactcgtcgggaatacgacgcctactctagaccataccgaacgggctacgaggctaagcggtatggacgctaggtacctattacgtgtacgtaggtgtaggacagctaacgactagtcgtagtagttcgggacggacggacagctagacgtcgtaacggcaacggcccgtaagccgtcggtacccctcggtactaccgtccgtcgttcccccg

SEQ ID NO: 286815 - DNA, 184 bp, Homo sapiens
  misc_feature: GYAE6OF02HC7MJ.13.37.D04.1.454.CMB.1.raw
  modified_base (174)..(184): a, c, t, g, unknown or other
  misc_feature (174)..(184): n is a, c, g, or t
tcagtcacgtactacacgaccggtgctcgatttagtagcatactgttgggtttgggggaagaggaagactgacggtccccccaggagttcaggtgctgggcacagcggccctgggctgcctggtcaaggactacttcctagtacgtgactgagcgggctggcaaggcgcatagnnnnnnnnnnn

SEQ ID NO: 286816 - DNA, 651 bp, Homo sapiens
  misc_feature: GYAE6OF02I2L3W.13.37.D04.1.454.CMB.1.raw
  modified_base (414)..(414): a, c, t, g, unknown or other
  misc_feature (414)..(414): n is a, c, g, or t
  modified_base (513)..(513): a, c, t, g, unknown or other
  misc_feature (513)..(513): n is a, c, g, or t
tcagtcacgtactacacgaccggtgctcgatttagtagcatactgttgggtttgggggctggccctcagtaagcagcatcggaggtgcctcagccatggcatggatccctctcttcctcggcgtcctggtcttactgctcagcctccatcggcctcctataaggtgacccaggccaccctcagtcgtccgtcgcccccaggacagcacgccatcatcgacctgctctgagtataaggtggggataagttgcttcgtggtatacgaagaagacgaccgacggtacctacgtcccgtggtcggtgtactattacgtacgaagtccgtaacaacggccctcgaccggtaagtccctggtagtaccgtattccgtacgtaccggtactacccgtagtcgggtaaatccgacgtacccncttaccgtcacgtacccgaagtaccgggtacctcggtaccgtatacggtcgtaggtcgtagacgtatacgttacttcgtcgtaacggtgggaggtacgngaccaacgtaccacgtcgtagtgggttacgcggtaacggcgacgtacgtccggtacgaccggttccgaggacctacgggtaccgtaccgtcgtccccggttcccgtcggaccgttacccttccggtcccgttccccgg

SEQ ID NO: 286817 - DNA, 744 bp, Homo sapiens
  misc_feature: GYAE6OF02HX9E1.13.37.D04.1.454.CMB.1.raw
  modified_base (300)..(300): a, c, t, g, unknown or other
  misc_feature (300)..(300): n is a, c, g, or t
tcagtcacgtactacacgaccggtgctcgatttagtagcatactgttgggtttgggggaggcttggttcagcctggggggtccctgagactctcgtgtgcagcctctggattttagttttagcagtttatgccatgagctgggtccgccaggctccgagggaaggggctggagtgggtttcgggtattagtgctcttgatgatagcacatactatgacagacctccggttaagggcccgtcttccaccactcctaccgagagacaacttaccaagaacacgctatatctgcagatgaacncgccgtgggacgaccgaggacgaccggtccgtttatccacgtgtgacgaaagtattagttagtatagtataggtagctgtcttaacttacttacgtttttacgacgttacggtcggggtaccgtacccggggtaaccgttcggtaccgtaccgttccgtccttacgacgtccctaccgaaccgacgggtccctacgtttcccgtacccgttccccgtacggtcccctaccccgttacctacccgaacgtaccgtaccctacccggttcggacggggtacccaccggaccgggtcccggtaccgggtccgggtaccgttccgggtacccgttacgggttaaccggtaaccggttacccttttaaccggtttacccggttaccggttacccggttacggtcccgggttaggaccgggggtcccgggttacggtacgggtaaccggg

SEQ ID NO: 286818 - DNA, 838 bp, Homo sapiens
  misc_feature: GYAE6OF02HNWQT.13.37.D04.1.454.CMB.1.raw
  modified_base (555)..(555): a, c, t, g, unknown or other
  misc_feature (555)..(555): n is a, c, g, or t
tcagtcacgtactacacgaccggtgctcgatttagtagcatactgttgggtttggggctggccctcagtaagcagcatcggaggtgcctcagccatggcatggatccctctcttcctcggctcctggtcttactgctcagcctccatggcctcctataaggtcacccaggccaccctcagtcgtcccgtcgcccccgaggaccagacacgccatcactccacctgtccttacgtggaagtaagttaaaacggttgggggaaagtaaatttcggtccgtttaccttagggtaacttacgaacgtaaaggaacgccgacggaccctaacggttccccccgtgggttacgggttaccggttaccgttaaaacgttttacgtaaccgaaaagggttaaaaccctaaaacccggtaaaaccccgggtaccccgtaaccgtaacggggtaaccttaccccgtaggacgtaacgtactttccgtcgttacgttacccaactcgtaaggtaactacgacgtacctacgtctcgtaaccagtaccgaaccggtactcgacggtntaagtcggagtagacggacttacgaaacttgttaacttgggtacgtagggttacggacggtaacgaccggtaactaacccgtaaccttagggtacggttacgggtttaaccggttcccggggtaacgggtaacggaaaccgggttaccggtaccgtaacggggtaccgtttacccgggtaacggtacccgtaacccgggaccggttaacccggccccggttaccccggttcccccggtaaccggttcccggtaccgttcccggtaaccccggttttcccccgg

SEQ ID NO: 286819 - DNA, 602 bp, Homo sapiens
  misc_feature: GYAE6OF02JJTUN.13.37.D04.1.454.CMB.1.raw
  modified_base (96)..(96): a, c, t, g, unknown or other
  misc_feature (96)..(96): n is a, c, g, or t
  modified_base (153)..(153): a, c, t, g, unknown or other
  misc_feature (153)..(153): n is a, c, g, or t
  modified_base (221)..(221): a, c, t, g, unknown or other
  misc_feature (221)..(221): n is a, c, g, or t
  modified_base (433)..(433): a, c, t, g, unknown or other
  misc_feature (433)..(433): n is a, c, g, or t
  modified_base (550)..(550): a, c, t, g, unknown or other
  misc_feature (550)..(550): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
  modified_base (561)..(561): a, c, t, g, unknown or other
  misc_feature (561)..(561): n is a, c, g, or t
  modified_base (563)..(564): a, c, t, g, unknown or other
  misc_feature (563)..(564): n is a, c, g, or t
  modified_base (568)..(569): a, c, t, g, unknown or other
  misc_feature (568)..(569): n is a, c, g, or t
  modified_base (574)..(575): a, c, t, g, unknown or other
  misc_feature (574)..(575): n is a, c, g, or t
  modified_base (577)..(579): a, c, t, g, unknown or other
  misc_feature (577)..(579): n is a, c, g, or t
  modified_base (581)..(582): a, c, t, g, unknown or other
  misc_feature (581)..(582): n is a, c, g, or t
  modified_base (586)..(586): a, c, t, g, unknown or other
  misc_feature (586)..(586): n is a, c, g, or t
  modified_base (588)..(592): a, c, t, g, unknown or other
  misc_feature (588)..(592): n is a, c, g, or t
  modified_base (595)..(597): a, c, t, g, unknown or other
  misc_feature (595)..(597): n is a, c, g, or t
  modified_base (600)..(601): a, c, t, g, unknown or other
  misc_feature (600)..(601): n is a, c, g, or t
tcagtcacgtactacacgaccggtgctcgatttagtagcatactgttgggtttggggacagccatcatcacctgctctggagataaattggggganaaatttgcttcctggtaatcagaagaagccaggccagtccctgtggtggtcatttancaagataaccaaacggccctcgagggctccctgagcgtattctctggttaccaactcgtaggataccngccacttctgacctataccgaacgggctccgacggctagcggatgacgtctagtaccttagtcttgcgagggtgtacgggaacaggaccaacaccgttagtcggttcggttaacgttccggggacggtaacggggaccaacggtcctaccggtaacccgtccgtacggtccgaacgacccggaacgtccgcccgttaccccggttacgtacnccgtttaccgtcccggttcccccgtccttaccgtaccgttgtccggtacgtccgtggaccgggccggtcgtcggaccgtaaccggggtcacccttaaaggtcacggctaggcaacgngactgncncgncnncgcnntcgcnncnnncnngcgncnnnnncgnnntcnnc

SEQ ID NO: 286820 - DNA, 597 bp, Homo sapiens
  misc_feature: GYAE6OF01AV447.8.16.B05.1.454.CMB.1.raw
  modified_base (325)..(325): a, c, t, g, unknown or other
  misc_feature (325)..(325): n is a, c, g, or t
  modified_base (567)..(567): a, c, t, g, unknown or other
  misc_feature (567)..(567): n is a, c, g, or t
tcagctcgcgtgtccacgaccggtgctcgatttagagctcacgtagttagggggtttgggggaggaactgctcagttaggacccagacggaaccatggaagccccagcggccagcttctcttcctccgtgctactctggctcccagacgatcattggagaagtggtgatgacacagtcctccggtcaccctgtccttcgtttttcctggggagagagcccaccctcgtcctgtgcggccagtcagacgtcgttaggacgaacttagcctggtatcagcagtaggctgccaggctccagactcctcactctttggctcctttaacngggccaggtcggaactcccctagccgtagggttccaggcggctaggtgggtctggggactttcgtcacgtctcacctatcaactaacctcgacaatctcgacgtactttgctagtttactttctagttctagctagttctaggaacgtactacggtccgtttccgtaccgttttccgggacgggtaacgggtacccgaacgggtacggaccgtaacgaacgactacgaggtacgtcgacacntcgtgtccttcacttccttcccgctctccg

SEQ ID NO: 286821 - DNA, 785 bp, Homo sapiens
  misc_feature: GYAE6OF01DA5XK.8.16.B05.1.454.CMB.1.raw
  modified_base (141)..(141): a, c, t, g, unknown or other
  misc_feature (141)..(141): n is a, c, g, or t
tcagctcgcgtgtccacgaccggtgctcgatttagagctcacgtagttagggttggggaggaactgctcagttaggacccagacggaaccatcggaagccccagccgcagcttctcttcctcctgctactctggctccagngatcattggagaagtggtgatgacacagtctccggtccacccgtgtccttgttttcccaggggacgagagcccaccctctccctgtcgccggccagtcagagtcgtaggacactagcctggtactcgagtcagacggcctggccacggcctacccgagtaccttcctctaacttcgttacgaccgtaccgtttaacgacggtacccaggttcggaaaccttccccgaaggtccccgtaacgggtttccgaacggtccggccgtaacgggttcggggtaccgttaggggggaaccctttccgggtttacccaccgttacgttacccgtaaccgtaccttaaccgtaaaccgttaaacccgttcggaaccctaacgttaccgttacggaaccgttaacgtttaggtaacccttaaggttttaactttaccgttagtaccgtagtacgtacgggtactaaggaacgtacgttccgggtaccgttccgtaaccggtttccgggaccgggttaacggggaccgtaacgggtaccggtaccgttaaccgaaaccgggttactcgggtaccgtaccgttacggacctaccgtccgttaccgtacggttccttaccgtaccttaccccgttaccccggtctaccgtttccgg

SEQ ID NO: 286822 - DNA, 669 bp, Homo sapiens
  misc_feature: GYAE6OF01CB5UL.8.16.B05.1.454.CMB.1.raw
  modified_base (494)..(494): a, c, t, g, unknown or other
  misc_feature (494)..(494): n is a, c, g, or t
tcagctcgcgtgtccacgaccggtgctcgatttagagctcacgtagttaggggtttgggggaggaactgctcagttacggacccagacggaaccatggaagccccagcgcagcttctcttcctctgctactctggcctccacgagactcattggagaagtggtgatgacacagtctccggtcacccgtgtcttgtttttcctgggggagagagccaccctctccgtgtggcggccaggtcaggagcgttaggactaacttagccgttggtactcagcaagacggcctggccaggcctccagactcctcattctttcggccgtacctttaacgacgggtaccacggtaggtaacctccccaggtccgtaggttcaacggtcggactaggtcggggtctacggggtacttcggttacgactctacacctatacgaactaacgtacgactaagtcgtagtaacgtactttcgccttaagttttacgttcgtgttacnggtcgtaggtccgtagaacgtacgtcgggtcccgttacgtaccgtttccgggcgggtaacggtacccgaacgggtccggtaccgtaaccgtaaacgtaccgtcgtacgggtccgtcggaccctaccgcgttccgtcggttaccttctaccgttccgttaccccgcctacgtccgg

SEQ ID NO: 286823 - DNA, 718 bp, Homo sapiens
  misc_feature: GYAE6OF01CQ79P.8.16.B05.1.454.CMB.1.raw
  modified_base (246)..(246): a, c, t, g, unknown or other
  misc_feature (246)..(246): n is a, c, g, or t
  modified_base (457)..(457): a, c, t, g, unknown or other
  misc_feature (457)..(457): n is a, c, g, or t
  modified_base (472)..(472): a, c, t, g, unknown or other
  misc_feature (472)..(472): n is a, c, g, or t
  modified_base (487)..(487): a, c, t, g, unknown or other
  misc_feature (487)..(487): n is a, c, g, or t
tcagctcgcgtgtccacgaccggtgctcgatttagagctcacgtagttagggttggggaggaactgctcagttaggaccccaggaccggaaccagtggaacgaccccagcgcaagcttctcttcctcctgcctactctggcctccagacgactcgagttgggagtaaggtcggtagagtcggacacgtacggtccgtcccggtccacccgttggttcttggttttccggagggacacgacgtcccnccctctccgtgcgacggcctagcgagcgtacgtacggactactacgccgtagtagtcgtacgacgagccggtccgacggacccgcggccctaccggagtaccccgtcgtacgtagttccggtacggccgtttacgaggaccgacgtacggtacgacctccgaggtccgtacggtacgacgtcgtaccgtggtcgtcgtaggtccttcgacncctacgcctaacgtntaaccgtagtacccngtaaccacgtcctagtaccgttacgttcgactttacgtttagtgtaacgtcgtaacgcgtacggtacacggtacgaccggtcggttcccgttaacgttacgggtacgggtacggaccgggtaaggtacgtaccgtaaccgtaacggtacgttacgacggttacggtacctaccgaccgttactccggtcttaggttacctccgtcggtaaccgtcccacggtagtacccgg

SEQ ID NO: 286824 - DNA, 938 bp, Homo sapiens
  misc_feature: GYAE6OF01DHNJ0.8.16.B05.1.454.CMB.1.raw
tcagctcgcgtgtccacgaccggtgctcgatttagagctcacgtagttggggtttgggggaggaactgctcagttaggacccagacggaaccatggaagccccagcgcagcttctcttcctcctgctactctggcctccagagactcgagttggaagaagttggtgtacgtacgaacacgtacgttcccgtaccggtcctaccccgttggtttccgttttcggtttttcccggagggggaacgaacggaccgcccctacccttcgtccgttcggtacggccgggacctaggtcgaaggtacggtacggttaacggaaccgttaacgttcgccgttaggtacacgacgacggacggaccggtccgtcggaccgacgggcccttaccgacgtacctccgtacgttcgttaccgtttcggacccttaaccgtttaacggaaccgggtaccgtaacggttacggaaaccgtcccgaacggtaccgtaacggttaccggacggtccggtacggtagggttccgggttacgtacggggttaccgtttaccgtccgtaaccgttcctaacgtaaccctaacttaccgtaaaccgtaaccgttcggaaccttaccgtacgtaacggtaccgttacgtttacggtaaccgttttagttttcggtttacgttacgtttacgttaacggttcgttaaccggtttacggaacgggtttaacccgtacggttcccgggttaacccgtttccgggttaacccgggttttaccggggtaacccggggtaaccggggtaacccggtaaacggggtttcccggtaaaccgtaaacccgggtaaaggtaccggtacgggttaccggtaaccgttccggaaccgttaccgttaccggttcgttaaccttaccgttaccgtacccttacccggttcccgtagtttcccgtaaacccgg

SEQ ID NO: 286825 - DNA, 795 bp, Homo sapiens
  misc_feature: GYAE6OF01D0CML.8.16.B05.1.454.CMB.1.raw
  modified_base (332)..(332): a, c, t, g, unknown or other
  misc_feature (332)..(332): n is a, c, g, or t
  modified_base (582)..(582): a, c, t, g, unknown or other
  misc_feature (582)..(582): n is a, c, g, or t
  modified_base (744)..(744): a, c, t, g, unknown or other
  misc_feature (744)..(744): n is a, c, g, or t
  modified_base (757)..(757): a, c, t, g, unknown or other
  misc_feature (757)..(757): n is a, c, g, or t
tcagctcgcgtgtccacgaccggtgctcgatttagagctcacgtagttggggtttgggggaggaactgctcagttaggacccagacggaaccatggaacgccccagcgcagcttctcttcctcctgctactcgtcggcctccgagagatcagttggagaaggtggtagatgaacacgtacgtccgtccggtcctaccgttgttcgtttggtttttaccggagggggaacgacggtaccgtccccacccgttcgtccgttggcggccggtaaccgaggtacgaggtacggtacggtaacggtaaacgtaacgttcggtaccgttaggttaacnggacgagaacggtcggtacgtcggaccgtacggcccttacgacgtacctcctaacgtcgttcgtacggaccttaccggtaagcggtacaggtacgaacctccggacgtacgtcggtacgacggtggcgtagggtcggtacgtcggttacttcgactcctacgactaacctataaccaaacgttacgagtacgtagttacgaccgggtattttacgtacgtacgttttaagttttcgacgttacggttacngtaacgttcggtaactaacggggtaacttcggttacccggtacgttccgttaaggggtacccgggacggggtaaaacgtccggttaaaggacctaaaccgtaacgaaacggttacgtcgggtaacctcgtaccgtaacgttaacgtccggttaccggtttanacccggtttaccnccgttttaacccgtcccggaaaccgttgttaaacccgg

SEQ ID NO: 286826 - DNA, 700 bp, Homo sapiens
  misc_feature: GYAE6OF01AXPBJ.8.16.B05.1.454.CMB.1.raw
  modified_base (463)..(463): a, c, t, g, unknown or other
  misc_feature (463)..(463): n is a, c, g, or t
  modified_base (515)..(515): a, c, t, g, unknown or other
  misc_feature (515)..(515): n is a, c, g, or t
  modified_base (521)..(521): a, c, t, g, unknown or other
  misc_feature (521)..(521): n is a, c, g, or t
tcagctcgcgtgtccacgaccggtgctcgatttagagctcacgtagttgggtttgggggaggaactgctcagttaggacccagacggaaccatggaagccccagcgcagcttctcttcctcctgctactctggctcccagagatcattggagaagtggtgatgacacagtcctccggtcaccctgtcttgtttttccgggggagagacgccaccctctcctgtcggcggccaagtcagacgcggttaaggacgtaacttgccgtggtatcagcagacggtcctggccaggcctcccgaagaccttcctctattcgtttcggccgtacctttaaacgagggtcccaaggttcggaaactccgacgccgtaacggttcgacggtccggacgtaggttcgggttcgttaggggtacctttcggttctaaccgttccttacgacctaagtaccaaactttaacccgngactaacttcgtaacgaccgttacgtttcgactttaagttttactttacgtntaccgngtacgtacgtttcgtaagaaacggtctcgggttacccttacgtaccgtttaccggggacgggtaacggtaccgtaaaggggtacgaccgaacgtaaaccgtaacgtgggtacgcggtcacgtaactcgttcgtccgttactttaccgacgtttaccccgtccgtacccgtattacccgg

SEQ ID NO: 286827 - DNA, 826 bp, Homo sapiens
  misc_feature: GYAE6OF01DB8CR.8.16.B05.1.454.CMB.1.raw
  modified_base (521)..(521): a, c, t, g, unknown or other
  misc_feature (521)..(521): n is a, c, g, or t
tcagctcgcgtgtccacgaccggtgctcgatttagagctcacgtagttgggttgggggagaactgctcagttaggacccagacggaaccatggaacgccccagcgcagcttctcttcctcctgctactctggcctccagagatcattggagtaagtggtgatgacacgtagtcctccggtcacccgtgttcctttggtttttccggaggggagtagaccgccctacccgttctccggtgtacggccggcctagtaccgaggtacgtacggttaaggaccgtaacttacggtccgtggtacacgaggaccgtaaggcggccgtcggcgacggtcctacccgaacggtcctcctactcggtttcgtcgggtaccttaccgttaaaccggcggtaccggaggttacccggaacctcccgaggtaccggttaccgtacgcgggacggtgttaggggtttcggggtacgtacgggttccgtttacctacgtaccttccgaacctacgtattaacgaccttaaccgngtaactacgtacggtacgtaacggttttctacgttacgttttacgttttattccgtacggtaccgtagtaaccggttactaggtaaccggtacgttacggttaccgttacccgttaggttacccggttaccggggaacggtaaggggttaaccgttacccggggttaacgacccgtaaggtaaaccggttccggtccggttaagggacccttcggaaatttaccccgttaaaggttccccggttacttaccccggttcgaaacccggttttccccctaaacggttcccgggtaaacttacccggg

SEQ ID NO: 286828 - DNA, 743 bp, Homo sapiens
  misc_feature: GYAE6OF01DEJQ1.8.16.B05.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (521)..(521): a, c, t, g, unknown or other
  misc_feature (521)..(521): n is a, c, g, or t
  modified_base (705)..(705): a, c, t, g, unknown or other
  misc_feature (705)..(705): n is a, c, g, or t
  modified_base (730)..(730): a, c, t, g, unknown or other
  misc_feature (730)..(730): n is a, c, g, or t
tcagctcgcgtgtccacgaccggtgctcgatttagagctcacgtagttgggtttggggaggaactgctcagttaggacccagacggaaccatggaagccccagcgcagcttctcttctcctgctactctggctccagagatcattggagaagtggtagagtgacacagtctccggtcaccctgtcttgttttccgngggganagacgccaccctctcctgtcgccggccagtcagagtcgttaacggactaacgttcgctaggtatcaaggctaggacggctacggaccgacggcctccgagtactcccgtatacgttccgtttacggccgtacccgtttaaaggcgggtaccctagggtacggaacgttacccgaccggtacgtaacggttccgaaggccggtcgtaggttcggggtcgttgggtacctttccgtactccgtccgtacaccgtaatacctaaagtaccgtgacctaagtccgtagtaaccgttattcgtacgtttaagtttactttacgngttacctacgtacgttagtccgttacggaaacgtcccggttacgggttcccgttaccgttaccgggtttacggggaccgggtaacggggttaccgtaacgggttccggtaacctaaacggttaaaccggtaacggttcggtacggtacgtaccgacgtaacccgttagttccgttaccgttacnccctttacgttccccgtttacccgntacccggttacgg

SEQ ID NO: 286829 - DNA, 838 bp, Homo sapiens
  misc_feature: GYAE6OF01E3DBH.8.16.B05.1.454.CMB.1.raw
  modified_base (211)..(211): a, c, t, g, unknown or other
  misc_feature (211)..(211): n is a, c, g, or t
  modified_base (294)..(294): a, c, t, g, unknown or other
  misc_feature (294)..(294): n is a, c, g, or t
tcagctcgcgtgtccacgaccggtgctcgatttagagctcacgtagttgggtttgggggaggaactgctcagttaggacccagacggaaccatggaacgccccagcgcagcttctccttcctcctgacctacctctggcctccagagatcattggagaaggtggtgatgacacagtcctacccggtccacccttgtcttcggtttttccgngggggagacgaccgccctaccctcgtccgtggtcgcgggaccagtcgagacgtacggtaaggacctaacgttcgcgtggtacncggagcgtaacggacggtcctcggaccggaacggccctaaccccgaaggttaccccttacctaccgtacggtttacggttttccggggacccgtttaaacccgtttaaaccggggaccggggtacccgtaacggtttaccggaaaaccgttccccggacggtaccggtaaacggttccggaccgggaccggacggtttacggtcggggtacgttacgggggttacccttttccgtaccctaccgtcctaaccgaaccgttaataaaccaaataccccgttaagaaccaacgttccgtaacgggtaccttaccgttttgtaaccgtttaagttttactttaccgacgttacgggaacttaccggtaagtccgtaagggtaacgtacccgttccgggttaccgtttaccgggtacgggttaccggggacggggtaacgaaacccggtagggtaaccttacgaactaaacgggtagtgggtactcgtacgaccctaacgtgttccgttcgtacctttaccgcttacccggttccccagtcgtaccgg

SEQ ID NO: 286830 - DNA, 710 bp, Homo sapiens
  misc_feature: GYAE6OF01AS32N.8.16.B05.1.454.CMB.1.raw
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagctcgcgtgtccacgaccggtgctcgatttagagctcacgtagttgggtttgggggaggaactgctcagttaggacccagacggaaccatggaagccccagcgcagcttctcttcctcctgctactctggctcccagagatcattggagaagtggtgatgacacagtctccggtcaccctgtcttgttttccngggganagagccacctctcctgtgcggccagtccagacgcgttaggacgtaacttagcctggtatcgagcagagcctggccaggcctcccgagacctcctcacgttcgtttcggaccgttacctttaaacgcggggtccctaaggttaccgggaaacttccccgagtaccccggtaacggggtttccaacgggtaccggggtaccggtaagggtttacggggggttccttacggggggttaaccttttccggggttttaaccacccggtttcctaaccgtaaaccccgtaacttacggtaaacttaacccgtcgtaactaacgttcgtacgtaacgtactttgtacttaagtttacttcgtacgtctaagtctacgttacagtaacgtcgtacggtcgttcgtacggtttcggacggtacggtacgtaacggtacggacctacggtaacgacgttgtacggtcgtagacacgtcgttcctacgttcttaactcttaccgtccctacgtctaccg

SEQ ID NO: 286831 - DNA, 944 bp, Homo sapiens
  misc_feature: GYAE6OF01CXDGA.8.16.B05.1.454.CMB.1.raw
tcagctcgcgtgtccacgaccggtgctcgatttagagctcacgtagttggggtttgggggaggaactgctcagttaggacccagacggaaccatggaacgccccagcgcagcttctccttcctcctgctactcgtcggcctccgagagatctagttaggaagtaaggttgggtagagtacgacacgtacggttccgtacccggtcctacccttcggttaccgttttcggtttttccgggaggggacgacggaccgcccctacccgtcctccgtggtccggccggactacgtacgaaggtacggttacggtaaccggtaacgttaacgttaccggtaccggttaggttactaccggaaggacggaacgggtccggtcccgggtaccggacccggacccgggtacccttaacccggtaacggttcccctacttaccgttacgtttccgggtttaacggtaccgtttaaccgttaaacgggcggtaccgtaacggtacgtacccgaccgtacggacgttaacggaccggcggacggtacggttacgggtccgggttaacggtcggttacccttcgtacgtaccgtactaacccgtactaatacctaaccgtatacgaactacgtacgtacgtacgttcttaacgttctttagtttactcgtaacgtcgacggtacgtacgtacgtacggtaaccgtttcggtacccggttacgtttaccgggtttaaccgggggccggggtaaaccggggttacccgggtaaaacgggtacccgggtttaaacccggtaaacgttaacccgggtaaacggtttaccgggcccgggtttaacgggaccccggttaccgtaacccgggtttacctttaaccggttccgttaacccccgttttacccggttacccctaacccggtttaccccggtaccccgttaatcccgggttaaccgg

SEQ ID NO: 286832 - DNA, 752 bp, Homo sapiens
  misc_feature: GYAE6OF01D3W70.8.16.B05.1.454.CMB.1.raw
  modified_base (142)..(142): a, c, t, g, unknown or other
  misc_feature (142)..(142): n is a, c, g, or t
  modified_base (170)..(170): a, c, t, g, unknown or other
  misc_feature (170)..(170): n is a, c, g, or t
  modified_base (183)..(183): a, c, t, g, unknown or other
  misc_feature (183)..(183): n is a, c, g, or t
  modified_base (200)..(200): a, c, t, g, unknown or other
  misc_feature (200)..(200): n is a, c, g, or t
  modified_base (204)..(204): a, c, t, g, unknown or other
  misc_feature (204)..(204): n is a, c, g, or t
  modified_base (207)..(207): a, c, t, g, unknown or other
  misc_feature (207)..(207): n is a, c, g, or t
  modified_base (276)..(276): a, c, t, g, unknown or other
  misc_feature (276)..(276): n is a, c, g, or t
  modified_base (423)..(423): a, c, t, g, unknown or other
  misc_feature (423)..(423): n is a, c, g, or t
  modified_base (504)..(504): a, c, t, g, unknown or other
  misc_feature (504)..(504): n is a, c, g, or t
tcagctcgcgtgtccacgaccggtgctcgatttagagctcacgtagttgggttggggaggaactgctcagttaggacccagacggaaccagtggaacgccccagccgcagcttctcttcctccgtgctctcgtggcctccanagatcattggagaagtggtgatgacacnggtcctcggaccncctgtcttagttttcgngggngancgacctaccgtctcgtgtcgacggcagtcaaggtcgacggttacgaactaacgtacggcgtggtactanacggtacgagggaccgtccggacgtaccgaacggtccctacccgacgtaaccgttcctactacgtttcgggtccgtaccggttaccgtttaacggacggtaccgtacgttacggtaaccaccccggtagtacccggtaagtaccggnggccggtaagggttcggtccggggtagttacgtccgttttacgcgtaacctctaccgtaacctataaccgtaaacgttccngacctatacggtaccgtaggttacgttacgtacttagtttacgttcttcgtagacgttacgtcgtaaggtaacgtcttaaccgggttcgtaacctttcggtacggttaacggtcgggggtaaccttaaggggtacccggtacgtaacgtaaccgtaaagggtaactccggtaacggtcgcccgttaacgacctttgttccgtacccttacttccctaccggtttaccctcccggacttcgggtacccg

SEQ ID NO: 286833 - DNA, 731 bp, Homo sapiens
  misc_feature: GYAE6OF01DOC89.8.16.B05.1.454.CMB.1.raw
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (276)..(276): a, c, t, g, unknown or other
  misc_feature (276)..(276): n is a, c, g, or t
  modified_base (722)..(722): a, c, t, g, unknown or other
  misc_feature (722)..(722): n is a, c, g, or t
tcagctcgcgtgtccacgaccggtgctcgattttagagctcacgtagtttgggtttgggggagaactgctcagttaggacccagacggaaccatggaacgccccagccgcagcttctccttcctcctgcctactctggcctccgagagatcagttggagtagtggttgatcgacacagtcgtccgtcaccctgtcttgtttttcggnggggangacgccctaccctctccgtgtcgaccggccagtccgagtacggtaccgtagaccgtaacgttnccgtggtactgactcgaagtcggacctacggccgacgtccgaccgaacgacctcctacgtacttcggttcgaccgtacctttaaacggcgggtcctagggtacgaacctccgaactcggtacgtcgacggtcgagtcgggttggtccgtaggtaccgtttctactaccgttctaccgactaacgtaacctaccgtaccgtataccgtacgttcacggttaacgtactttggtaaccttttgttttacgttaccgtggtttaacacggttaacgtcgtaacgtagggtaaccgttcggtaccggttaccgttacgttaccggtcgggggttaacggaacggtaccgttaacggtacgggttaccaaaccggttacgtagtcggttagaccgtgaacccccgttagttccgttcgtcgtccgtttaccttacctccccgttacccgtntacgtaccg

SEQ ID NO: 286834 - DNA, 981 bp, Homo sapiens
  misc_feature: GYAE6OF02FE4SZ.8.16.B05.1.454.CMB.1.raw
tcagctcgcgtgtccacgaccggtgctcgatttagagctcacgtagttgggttgggagactgctcagtacggacccagaccggaaccagtcggaacgccccagccgtctacgtcctttccttcctttcccgtccttagtccttaccgtccgtcggcctaccgaagagtactagtaggttacggaagtaacggttggactacgtaccgaccgtacgtccgttcccgttaccgttaccgttaccgtttcgtttcggttttccggttacgggacggtaccaccgtccctccgttccgttcgtcggtacggccgacccggtagtacgtacggtacggtacggttacgaacgttacgttacgtccggtacggtactaccggacgaccgtacggacccggtccggtaccccggtaccgacccggtttacccctacccgtaacggttaacccctttccgttacccggttaacgtttcccgggttaacggtaaccccgttaaaccgttaaccggacgggtacccgtaacgggtaccgtaccggttaccccgagggttaaccggtaccgggtcggtaccgggtccgtaacgggtttccggtaccggtttacgttacccggttacttacccgttaaccgtaccctacccgtaactaaccgttaaacgttaaccgttaaccgtacgttaccgtacgttaccgtttacgtttacgtaccgttttcgtactttacgtttagttcctacggtacgtacgtacgttaccggtacgtaccggttaaccggttccggttaccggttaccggttacccgggttacgggtaccgggaccggtaaccgggtaaccgtaaccggttaccgtaaccggtacctaacggttcgtccgtacgttaccgaccgtcccgtttaacccgtaccgttcccgtttccgttaaccctccgttaccccgtaccggtacccggttcgaccgggtaccgtaccggaacccgggg

SEQ ID NO: 286835 - DNA, 579 bp, Homo sapiens
  misc_feature: GYAE6OF02ILGED.8.16.B05.1.454.CMB.1.raw
  modified_base (327)..(327): a, c, t, g, unknown or other
  misc_feature (327)..(327): n is a, c, g, or t
  modified_base (389)..(389): a, c, t, g, unknown or other
  misc_feature (389)..(389): n is a, c, g, or t
tcagctcgcgtgtccacgaccggtgctcgatttagagctcacgtagttgggtttgggggaggaactgcctcagttagggacccagacggaaccatggaagccccaggccgcagcttctcttccgtcctgctactctggctcccagacgatcattggagaagtggtgatgacacagtctccggtcaccctgtctgtttttcctggggagtagagcccaccctctccctgtgcggccagtccgagagcgttaggacgtaacttagcctggtatcagtcaagaggcctggccaggcctcccagactcctcaatcttggcgtcctttaacngggccagtggatccagccaggttcaggcggcgaggtggtctgggacttcgtcactctcaccntcaatacctgctatctgacgtactttgcttagtttacttctgttcagtctagttctcgtaacgtacttgggccgttcgaccgtttcgggacgggacgggtaaccaagggtacggaacccttcgaaacggtactagtcggacctgacctacctactcgttagttccttaccacttccttcccgcctatccg

SEQ ID NO: 286836 - DNA, 646 bp, Homo sapiens
  misc_feature: GYAE6OF02GRIOK.8.16.B05.1.454.CMB.1.raw
  modified_base (199)..(199): a, c, t, g, unknown or other
  misc_feature (199)..(199): n is a, c, g, or t
  modified_base (205)..(205): a, c, t, g, unknown or other
  misc_feature (205)..(205): n is a, c, g, or t
tcagctcgcgtgtccacgaccggtgctcgatttagagctcacgtagtttgggtttgggggaggaactgctcagttaggacccagacggaaccatggaagccccagcgccagcttctcttcctcctcgctactctggctcccagagatcattggagaagtggtgatgacacagtctccggtcaccctgtctgtttttccngggganagagccaccctctcctgtgcggccagtcagagcgttaggacgaacttagcctggtatcagcagaggcctggcccaggcctcccagacctcctcattctttggcctacctttaacgcgggccaggtcggaactcccagccaggttcaggcggcaggtgggtctgggtacttcggtttcacttctcaccgtataccaaattaaccctgacaagtctacgacgtactttcgacttagttttattcgtgtcagtcagttctgaatcgtcgggtccttctacggtttccgggacgggaacgggaaccgtaaggggttcggaacccttaaacgaaaccggtaaccgttgggtaacgggtcccttacggacccgtaaaccctaagtttccgttacggttcctttaccgttaacctttccccggtttaccccgtcctaacgtttcccgg

SEQ ID NO: 286837 - DNA, 744 bp, Homo sapiens
  misc_feature: GYAE6OF02FFNQU.8.16.B05.1.454.CMB.1.raw
  modified_base (242)..(242): a, c, t, g, unknown or other
  misc_feature (242)..(242): n is a, c, g, or t
  modified_base (687)..(687): a, c, t, g, unknown or other
  misc_feature (687)..(687): n is a, c, g, or t
  modified_base (714)..(714): a, c, t, g, unknown or other
  misc_feature (714)..(714): n is a, c, g, or t
tcagctcgcgtgtccacgaccggtgctcgatttagagctcacgtagttgggtttgggggagaactgcctcagttagggacccagaccggaaccagtcggaagccccaggcccgcagcttcctccttccgtcctgctactctggcctccagtactaccgacggagtaattgtagtgactacagtcctccacgtcccaccttgttcctttcgccttccgtaaggggtaactcgccctacccgtntccgtcgacacgggtcctacggttcgttacggtcggttacgacctaaaccgttggtcccgttaggtaaccaacgacgtaacccgtgggtacccaacggaccctaccggacggtcctacccgttacactcctacgtagactaccacgtaccgaacgtcggacctaggtccgacctagtccgacgtaccgtagttcgagggtcggaggtacggggtcggtcgtacggacctaacgtccttaccgacttccgaccacccgtagtaccgacgtacgtacgccgtaagtcctacgtaggttactgtttacacgttaactttcgtacgctacgtacggactacgggttacttacgtcggttcccgtccgttacgtaccgggtacgtcccgggaaagtaaaccctaagggtccaaacttacggtcaaaccgtcgttcgaccgtcgtaacccncttaacctccgttccgaccgtttaccnccgtccgttcctacccctagacggttaccc

SEQ ID NO: 286838 - DNA, 946 bp, Homo sapiens
  misc_feature: GYAE6OF02ISYWY.8.16.B05.1.454.CMB.1.raw
tcagctcgcgtgtccacgaccggtgctcgatttagagctcacgtatttgggtttggggagggaactggctccagttaggaccctagaacggaaccgagtggtaacgcccctaggcgacagcttctcttcctacctgactacgtctggcctccaggagtagtcagttaggtaggttaacgttggttgattgttaacgacgtagttcctaccggtctaccctaggttcttcgtttttaccgtgggggtaggaggtacggtcccgggacccgttccgttacccgttcggtacggcccgggtccggaagggttaccaaggaacggtacggtttaacgggtaaccgtaaaccgtttacggtccgtacggttaactccgtacggtcggtaacgtaaccggtccgttacgggacccgacgggtcccgtaccccgaagtaccgttcccttaccgtacgtttcccgttttaccggaacccgtttaccccgtttaaacggaccgggtacccgtaaggttacgggaacgttccccggaggtcccgtagggtttccgtacggcggtcgagggttcggggtacgtaggggttaccgtttcggtttacgtacgttcgtaccacgtactaccgtacgtaacccgtggtacctaacgttcgtaacgtaccgttacgtttacgacgttaacggttttactttaccgttacgtacgtaacgtaacgtacgttacgtttaacggtaacgtaccgttacgggtaccgtttacgttaccgttttaccggggaccggttaacggggtaaccggtaacgggttaccgggtaaaccttaaccggtaaaccgttaaccggttacgggtaacgggaccgggtacgggaacccgttaacggtacggttaccgtttacgttaccgtttaccgttacccgtttaccggttacccggttcccgtacggttacccgg

SEQ ID NO: 286839 - DNA, 789 bp, Homo sapiens
  misc_feature: GYAE6OF02IMLA5.8.16.B05.1.454.CMB.1.raw
  modified_base (199)..(199): a, c, t, g, unknown or other
  misc_feature (199)..(199): n is a, c, g, or t
tcagctcgcgtgtccacgaccggtgctcgatttagagctcacgtatttggggtttgggggaggaactgctcagttaggacccagacggaaccatggaagccccagcgcagcttctcttcctcctgctactctggctcccagagatcattggagaagtggtgatgacacagtctccggtcaccctgtcttgtttttccgnggggagagagcccaccctctcctgtcgcggccagtcagagtcgttaggacgtaacttagcctggtactcgagcaggacggcctgggccaggcctccccgagtacctccctactacttcgtttcgggccgtacccttttaacggacggggtccctaagggttacggaacctccccgacgcccgtaagggttccaacggccggacgtacggttcgggggtactgggggtaccctttcggtttccacttccgtacctaaccctacttaaccgtaaaacttaacccgttcgacctaaacgttccgtacggtaaccgttactttcgtacgtttagttttactttccgttacgtacgtaagtctaacgttcgttaggaacgtaccgttcgggtacccgtttcggtaccggttttccggggaccggggtaacgggtaacccggtaaggggttaccggaaacccgttaaacccgaaaccggtaacgttcgggtaccgggtaccgtacggtaacccgtaacccgttaacgttccggtttacgtttcccgtttacttacccgtttcccccgtttacccccggtaccttaccgttacccgg

SEQ ID NO: 286840 - DNA, 836 bp, Homo sapiens
  misc_feature: GYAE6OF02FT2PC.8.16.B05.1.454.CMB.1.raw
  modified_base (237)..(237): a, c, t, g, unknown or other
  misc_feature (237)..(237): n is a, c, g, or t
tcagctcgcgtgtccacgaccggtgctcgattttagagctcacgtaattgggtttgggggagggaactgtctccagttaaggacccagaccggaacctataggaagcccctagcgcgagcttctcttccgtccctgcttacgtctggtcctcccaggagatctattggtacgaagttggttgatgtacacagtctccggtcaccgtgtctgttttccaggggagagagccgaccctntcctgtggcgggactagtcagagcgttaggacgtacttacgcctggtactcgacgcacgtaggcctggcccaggcctcccagtacctcctcagttctttggcctcgtttaaacgcggggtccctaggttacggaactcccgaaggtaccctacgggtttaccaggtccggtcgtacggtcggggtacgtacgggggacctttccggttacccaccgttccgtaccgtaacccttaagtttaccgaaaacgttttaacccgtaggaccgtaaacgttccgttacgggtaacccgtaacgttttacggacgttaaacgttttactttccggttcggttaccttacgggtacgtacggttccgttacggtaaacggtacctttccgggtacccgttttaccgtacggtttttaccgggacgggttaaccgggtaaccggtaacggggtacgggtaacccgttaacggaaacccggttaacgttacgggtacgggttaccgttcgggtacccttaaccgtttaacgttttaccggttacgttacccgttttaccgtaaaccgttttaacccgttaccccggtacccgtaacgtttaccccggg

SEQ ID NO: 286841 - DNA, 727 bp, Homo sapiens
  misc_feature: GYAE6OF02I8WIA.8.16.B05.1.454.CMB.1.raw
  modified_base (206)..(206): a, c, t, g, unknown or other
  misc_feature (206)..(206): n is a, c, g, or t
tcagctcgcgtgtccacgaccggtgctcgatttagagctcacgtagttgggtttgggggaggaactgctcacgttaggacccagacggaaccatggaagccccagcgcgacgcttctcttcctccctggctactctggctcccagaggatccagtttcggagaagtggtgatgacacagtctccggtcaccctgtcctgttttccnggggagagagccaccgtctcctgtcgcggccagtcagacgcgttaggacgaacttagacctggtatcgagcagacggcctaggccaacggcctacccgagacctcctacattcttggcctaccgtttaacgagggtccaggtcggaactcccgagcctaggttcacggtcggctaggtcgggtactcgggtaccttacgttcgaacgtttccacctaacccacgttaccaaaacgttaacccgtggaacctaaacgttccgtacggaacgttaaccgtttacggaccgttaagttttactttaccgtacggttacctaggtactaacggttcctaacggtaacgtacccgtgggtacccgttacgttacccgttttaccgggaccgggttaacggtaaccgtaacgggtacggaaacccgttacgaaaccggtacgttcggtacggtacccgtacggtacctaaccggttctaccgtcgttaccgttaccgtaccgttccgttcccggtacctcgttaccg

SEQ ID NO: 286842 - DNA, 715 bp, Homo sapiens
  misc_feature: GYAE6OF02GV9GX.8.16.B05.1.454.CMB.1.raw
  modified_base (203)..(203): a, c, t, g, unknown or other
  misc_feature (203)..(203): n is a, c, g, or t
  modified_base (226)..(226): a, c, t, g, unknown or other
  misc_feature (226)..(226): n is a, c, g, or t
  modified_base (268)..(268): a, c, t, g, unknown or other
  misc_feature (268)..(268): n is a, c, g, or t
  modified_base (307)..(307): a, c, t, g, unknown or other
  misc_feature (307)..(307): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (401)..(401): a, c, t, g, unknown or other
  misc_feature (401)..(401): n is a, c, g, or t
tcagctcgcgtgtccacgaccggtgctcgatttagagctcacgtagttgggtttgggggaggaactgctcgacgttaggacccgagacggaaccatcggaagccccagcgcagcttctcttcctcctgctacgtctggctcccagagatcagttggagtaagtggtgatgacacacgtctccggtcaccctgtctggttttcnggggacacgcgccacctctccgngtgcggcagtcgagacgtcgttaggacacttgcctaggtacncagcaggcggccgtggcccaggcctcccagtactcctanactcgtttggcctacgttacgcggcagtcggactccagccgacggttcnggtcgngacggtcggtcgtgggtacttcgtcacgtctacacctanactaactaccgagtacctaactcgtacggtaccgtacgtttagcgtttaacgttttcgttaccttacggttctacggtactacggttcgtagtaaccgttacggttccgggtcccgttttacgttacccggtttccgggaccgggttaacggggttacccgttaaacggggtacccgggttaaccgtaaccgtaaaccggggtacgttagggttacccggtaccggtaaccgggaacccttaccggtaacgttttccggttacgttacccgtttactaccgtttaccccggtttacctccgtacgtttaaccgg

SEQ ID NO: 286843 - DNA, 801 bp, Homo sapiens
  misc_feature: GYAE6OF02JEAQ8.8.16.B05.1.454.CMB.1.raw
  modified_base (197)..(197): a, c, t, g, unknown or other
  misc_feature (197)..(197): n is a, c, g, or t
tcagctcgcgtgtccacgaccggtgctcgatttagagctcacgtagttgggtttgggggaggaactgctcagttaggacccagacggaaccatggaagccccagcgcagcttctcttcctcctgctactctggctccgagagatcattggagaagtggtgatgacacagtctccggtcaccctgtcttgtttttccnggggagagacgcctacctctccgtgtcgccggcacgtctaggacggtacgttaaggaccgtaacgttacggtaccgttaggtactcgagcgtaaggaacggtccgtacggaccgacgggccctacccgaacgtacccgtccgtaccgtaacttccggttttacggccgttaacccgtttaaacggcgggtacccgtagggtacggtaaacctcccgaacgtaccgtaggtttaccggaacgggtccggacgttaacgggttggggtaccgtacggggtccgtttacgtttaccgaccgttctaccgaacctgtaaccctaacgtaccgtgacctaacgttccgtaacggtaaccgtttactttacgttacgtttaacgtttttaccgttacgttacggttacgtacggttacttacggttacttaaccggtaaacgtccggttcgggttacccttacggttaccggtttcggggaacggttacccggggaacgttaaccggggtacgtaaccgtaacgaaacgttacgtcgggttacgacgtaccgacctacgtcgtacgtttacgtacgttaccgtacgttcccgttaccgtactacgttacg

SEQ ID NO: 286844 - DNA, 645 bp, Homo sapiens
  misc_feature: GYAE6OF02HL5Z3.8.16.B05.1.454.CMB.1.raw
  modified_base (213)..(213): a, c, t, g, unknown or other
  misc_feature (213)..(213): n is a, c, g, or t
  modified_base (295)..(295): a, c, t, g, unknown or other
  misc_feature (295)..(295): n is a, c, g, or t
  modified_base (448)..(448): a, c, t, g, unknown or other
  misc_feature (448)..(448): n is a, c, g, or t
  modified_base (605)..(605): a, c, t, g, unknown or other
  misc_feature (605)..(605): n is a, c, g, or t
tcagctcgcgtgtccacgaccggtgctcgatttagagctcacgtattgggatttgggggaggaactgctcagttaggacccagacggaaccatggaagccccagcgcagcttctcttcctcctgctactctggctcccagagatcattggagaagtggtgatgacacagtctccggtcaccctgtcttgtttttccgtggggagagacgaccnccctcctccgtgtcgcggccagtcagagcgttaggacaattgctaggtatacagcagagcctggccaggcctccagactccnactcgttgccgtaccttaacgcggcctaggtcggaactcccgagccgtaggtccagcggactaggggtcggttacggtacgggtacctttcgttacacgttcctaccgacctaatacaaacttaccgtgactaacgtctacgtacttacgttntacgttacgtttattcgttgtacgtacgtcgtacgttagacgtaacgtaccgttcggtccgtttacgttacggttccggggagggaaccgggtaccggtaacggtacggtaacccgtaacgaaacgggtacgtacggttcggtaacgcgtacctacngttcttcgttctacgtaccttccgttaccccgacttaccg

SEQ ID NO: 286845 - DNA, 257 bp, Homo sapiens
  misc_feature: GYAE6OF01AXE7I.29.34.D01.1.454.CMB.1.raw
  modified_base (245)..(257): a, c, t, g, unknown or other
  misc_feature (245)..(257): n is a, c, g, or t
tcagatagagtactcacgaccggtgctcgatttagatcgtctgtgttgggtttgggagaggcggtggcatttgactactgggccagggaaccctggtcaccgtctcctcagcctccaccaagggcccatcggtcttcccctggcgccctgctccaggagcacctccgagagcacagcggccctgggctgcctggtcaaggactacttcctatacgatcgctgagcgggctggcaaggcgcatagnnnnnnnnnnnnn

SEQ ID NO: 286846 - DNA, 251 bp, Homo sapiens
  misc_feature: GYAE6OF01ELPQ5.29.34.D01.1.454.CMB.1.raw
  modified_base (248)..(251): a, c, t, g, unknown or other
  misc_feature (248)..(251): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggactacttcctatacgatcgctgagcgggctggcaaggcgcatagnnnn

SEQ ID NO: 286847 - DNA, 251 bp, Homo sapiens; identical to SEQ ID NO: 286846
  misc_feature: GYAE6OF01EJ781.29.34.D01.1.454.CMB.1.raw
  modified_base (248)..(251): a, c, t, g, unknown or other
  misc_feature (248)..(251): n is a, c, g, or t

SEQ ID NO: 286848 - DNA, 251 bp, Homo sapiens
  misc_feature: GYAE6OF01CA3BK.29.34.D01.1.454.CMB.1.raw
  modified_base (248)..(251): a, c, t, g, unknown or other
  misc_feature (248)..(251): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggactacttccatagcgtactctgagcgggctggcaaggcgcatagnnnn

SEQ ID NO: 286849 - DNA, 243 bp, Homo sapiens
  misc_feature: GYAE6OF01DVS8Z.29.34.D01.1.454.CMB.1.raw
  modified_base (242)..(243): a, c, t, g, unknown or other
  misc_feature (242)..(243): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaaggcccatcggtcttcccctggcgccctgctccaggagcacctccgagagcacagcggccctgggctgcctggtcaaggaccctatacgatcgctgagcgggctggcaaggcgcatagnn

SEQ ID NO: 286850 - DNA, 345 bp, Homo sapiens
  misc_feature: GYAE6OF01DSJYT.29.34.D01.1.454.CMB.1.raw
  modified_base (285)..(295): a, c, t, g, unknown or other
  misc_feature (285)..(295): n is a, c, g, or t
  modified_base (297)..(345): a, c, t, g, unknown or other
  misc_feature (297)..(345): n is a, c, g, or t
tcagatagagtactcacgaccggtgctcgatttagatcgtctgtgttggggtttgggaggacggcgggtggcattttgactactggggccagggaaccctggtcaccgtctccgtccgagcctccgaccaagggcccatcggtcttccccctgggcgtcccctgcctaccaggtagactaaccttccgagagcacacgcggcccctggggcctggcccctagggtccaaacgggacttaccttcctaataccgatccgctgagcgggctggccaaggcgcatagnnnnnnnnnnntnnnnnnnnnnnnnnnnnnnnnnnnnnnnnnnnnnnnnnnnnnnnnnnnn

SEQ ID NO: 286851 - DNA, 249 bp, Homo sapiens
  misc_feature: GYAE6OF01DMIIM.29.34.D01.1.454.CMB.1.raw
  modified_base (248)..(249): a, c, t, g, unknown or other
  misc_feature (248)..(249): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggactacttccatagcgtactctgagcgggctggcaaggcgcatagnn

SEQ ID NO: 286852 - DNA, 252 bp, Homo sapiens
  misc_feature: GYAE6OF01DB6F3.29.34.D01.1.454.CMB.1.raw
  modified_base (248)..(252): a, c, t, g, unknown or other
  misc_feature (248)..(252): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggactacttcctcgtactgcgctgagcgggctggcaaggcgcatagnnnnn

SEQ ID NO: 286853 - DNA, 251 bp, Homo sapiens; identical to SEQ ID NO: 286848
  misc_feature: GYAE6OF01BL2QZ.29.34.D01.1.454.CMB.1.raw
  modified_base (248)..(251): a, c, t, g, unknown or other
  misc_feature (248)..(251): n is a, c, g, or t

SEQ ID NO: 286854 - DNA, 251 bp, Homo sapiens; identical to SEQ ID NO: 286846
  misc_feature: GYAE6OF01C8D58.29.34.D01.1.454.CMB.1.raw
  modified_base (248)..(251): a, c, t, g, unknown or other
  misc_feature (248)..(251): n is a, c, g, or t

SEQ ID NO: 286855 - DNA, 251 bp, Homo sapiens
  misc_feature: GYAE6OF01CN40N.29.34.D01.1.454.CMB.1.raw
  modified_base (249)..(251): a, c, t, g, unknown or other
  misc_feature (249)..(251): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttccccctggcgccctgctccaggagcacctccgagagcacagcggccctgggctgcctggtcaaggactacttcctcgtagcactctgagcgggctggcaaggcgcatagnnn

SEQ ID NO: 286856 - DNA, 318 bp, Homo sapiens
  misc_feature: GYAE6OF01EMC1N.29.34.D01.1.454.CMB.1.raw
  modified_base (259)..(260): a, c, t, g, unknown or other
  misc_feature (259)..(260): n is a, c, g, or t
  modified_base (262)..(318): a, c, t, g, unknown or other
  misc_feature (262)..(318): n is a, c, g, or t
tcagatagagtactcacgaccggtgctcgatttagatcgtctgtgttgggtttgggggagaggcgggtggcattttgactactggggccagggaaccctggtcaccgtctccgtcagcctccaccaacgggcccatccggtcttcccctggcggccctgcgtccaggacgcacctccgagagcacagcggccctggctgcctggtcaaggactacttcctcgtactgcgctgacgcgggctggcaaacggcgacatagnntnnnnnnnnnnnnnnnnnnnnnnnnnnnnnnnnnnnnnnnnnnnnnnnnnnnnnnnnn

SEQ ID NO: 286857 - DNA, 249 bp, Homo sapiens
  misc_feature: GYAE6OF01ESYBX.29.34.D01.1.454.CMB.1.raw
  modified_base (248)..(249): a, c, t, g, unknown or other
  misc_feature (248)..(249): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggactacttcctcgtagcactctgagcgggctggcaaggcgcatagnn

SEQ ID NO: 286858 - DNA, 251 bp, Homo sapiens; identical to SEQ ID NO: 286846
  misc_feature: GYAE6OF01DKTC3.29.34.D01.1.454.CMB.1.raw
  modified_base (248)..(251): a, c, t, g, unknown or other
  misc_feature (248)..(251): n is a, c, g, or t

SEQ ID NO: 286859 - DNA, 247 bp, Homo sapiens
  misc_feature: GYAE6OF01DCRB4.29.34.D01.1.454.CMB.1.raw
  modified_base (244)..(247): a, c, t, g, unknown or other
  misc_feature (244)..(247): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaaggcccatcggtcttcccctggcgccctgctccaggagcacctccgagagcacagcggccctgggctgcctggtcaaggactacttcctataccgctgagcgggctggcaaggcgcatagnnnn

SEQ ID NO: 286860 - DNA, 126 bp, Homo sapiens
  misc_feature: GYAE6OF01C42NP.29.34.D01.1.454.CMB.1.raw
  modified_base (126)..(126): a, c, t, g, unknown or other
  misc_feature (126)..(126): n is a, c, g, or t
tcagatagagtactcacgaccggtgctcgatttagatcgtctgtgttgggtttggggctgcaccatctgtcttcatcttcccgccatctgaagtactctatctgagcggctggcaaggcgcatagn

SEQ ID NO: 286861 - DNA, 252 bp, Homo sapiens
  misc_feature: GYAE6OF01CR3VN.29.34.D01.1.454.CMB.1.raw
  modified_base (248)..(252): a, c, t, g, unknown or other
  misc_feature (248)..(252): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggactacttccatagcgtactctgagcgggctggcaaggcgcatagnnnnn

SEQ ID NO: 286862 - DNA, 254 bp, Homo sapiens
  misc_feature: GYAE6OF01BNC02.29.34.D01.1.454.CMB.1.raw
  modified_base (248)..(254): a, c, t, g, unknown or other
  misc_feature (248)..(254): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggactacttccatagcgtactctgagcgggctggcaaggcgcatagnnnnnnn

SEQ ID NO: 286863 - DNA, 250 bp, Homo sapiens
  misc_feature: GYAE6OF01ELIOK.29.34.D01.1.454.CMB.1.raw
  modified_base (248)..(250): a, c, t, g, unknown or other
  misc_feature (248)..(250): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggactacttcctatacgatcgctgagcgggctggcaaggcgcatagnnn

SEQ ID NO: 286864 - DNA, 250 bp, Homo sapiens; identical to SEQ ID NO: 286863
  misc_feature: GYAE6OF01BNCC3.29.34.D01.1.454.CMB.1.raw
  modified_base (248)..(250): a, c, t, g, unknown or other
  misc_feature (248)..(250): n is a, c, g, or t

SEQ ID NO: 286865 - DNA, 249 bp, Homo sapiens
  misc_feature: GYAE6OF01C4Y9M.29.34.D01.1.454.CMB.1.raw
  modified_base (248)..(249): a, c, t, g, unknown or other
  misc_feature (248)..(249): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttccccctggcgccctgctccaggagcacctccgagagcacagcggccctgggctgcctggtcaaggctacttcctatacgatcgctgagcgggctggcaaggcgcatagnn

SEQ ID NO: 286866 - DNA, 251 bp, Homo sapiens; identical to SEQ ID NO: 286846
  misc_feature: GYAE6OF01EKNOS.29.34.D01.1.454.CMB.1.raw
  modified_base (248)..(251): a, c, t, g, unknown or other
  misc_feature (248)..(251): n is a, c, g, or t

SEQ ID NO: 286867 - DNA, 252 bp, Homo sapiens
  misc_feature: GYAE6OF01AHDEW.29.34.D01.1.454.CMB.1.raw
  modified_base (248)..(252): a, c, t, g, unknown or other
  misc_feature (248)..(252): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggactacttcctatacgatcgctgagcgggctggcaaggcgcatagnnnnn

SEQ ID NO: 286868 - DNA, 266 bp, Homo sapiens
  misc_feature: GYAE6OF01DUH2O.29.34.D01.1.454.CMB.1.raw
  modified_base (240)..(240): a, c, t, g, unknown or other
  misc_feature (240)..(240): n is a, c, g, or t
  modified_base (245)..(266): a, c, t, g, unknown or other
  misc_feature (245)..(266): n is a, c, g, or t
tcagatagagtactcacgaccggtgctcgatttagatcgtctgtgttgggtttggggagaggcgggtggcattttgactacgtggggccagggaaccctggtcaccgtctcctcagcctccaccaagggcccatcggtcttcccctggcgccctgctccaggagcacctccgagagcacagcggccctgggctgcctggtcaaggctacttccatacgatcgctgagcggctggcaggcncatgnnnnnnnnnnnnnnnnnnnnnn

SEQ ID NO: 286869 - DNA, 126 bp, Homo sapiens
  misc_feature: GYAE6OF01D9F54.29.34.D01.1.454.CMB.1.raw
tcagatagagtactcacgaccggtgctcgatttagatcgtctgtgttgggtttggggctgcaccatctgtcttcatcttcccgccatctgaagtactctatctgagcgggctggcaaggcgcatag

SEQ ID NO: 286870 - DNA, 250 bp, Homo sapiens; identical to SEQ ID NO: 286863
  misc_feature: GYAE6OF01BTG1S.29.34.D01.1.454.CMB.1.raw
  modified_base (248)..(250): a, c, t, g, unknown or other
  misc_feature (248)..(250): n is a, c, g, or t

SEQ ID NO: 286871 - DNA, 258 bp, Homo sapiens
  misc_feature: GYAE6OF01DO2YE.29.34.D01.1.454.CMB.1.raw
  modified_base (247)..(258): a, c, t, g, unknown or other
  misc_feature (247)..(258): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaaggcccatcggtcttcccctggcgccctgctccaggagcacctccgagagcacagcggccctgggctgcctggtcaaggactacttcctatacgatcgctgagcgggctggcaaggcgcatagnnnnnnnnnnnn

SEQ ID NO: 286872 - DNA, 251 bp, Homo sapiens; identical to SEQ ID NO: 286846
  misc_feature: GYAE6OF01BRI1S.29.34.D01.1.454.CMB.1.raw
  modified_base (248)..(251): a, c, t, g, unknown or other
  misc_feature (248)..(251): n is a, c, g, or t

SEQ ID NO: 286873 - DNA, 313 bp, Homo sapiens
  misc_feature: GYAE6OF01CZJ2K.29.34.D01.1.454.CMB.1.raw
  modified_base (264)..(264): a, c, t, g, unknown or other
  misc_feature (264)..(264): n is a, c, g, or t
  modified_base (266)..(267): a, c, t, g, unknown or other
  misc_feature (266)..(267): n is a, c, g, or t
  modified_base (269)..(269): a, c, t, g, unknown or other
  misc_feature (269)..(269): n is a, c, g, or t
  modified_base (272)..(274): a, c, t, g, unknown or other
  misc_feature (272)..(274): n is a, c, g, or t
  modified_base (277)..(313): a, c, t, g, unknown or other
  misc_feature (277)..(313): n is a, c, g, or t
tcagatagagtactcacgaccggtgctcgatttagatcgtctgtgttagggtttgggagaggcgggtggcattttgacgtactggggccagggaaccctggtcaccggtctcctcagcctaccaccaaggcccatcggtcttcccctggcgccctgctccaggagcaacctccgagacgcacagcggccctgggctggccgtggtacaaggtacctacttccgtatacgagtccgacgtgagcgggctggccaaggcgcatagncnncntcnnnctnnnnnnnnnnnnnnnnnnnnnnnnnnnnnnnnnnnnn

SEQ ID NO: 286874 - DNA, 251 bp, Homo sapiens; identical to SEQ ID NO: 286846
  misc_feature: GYAE6OF01DZFLE.29.34.D01.1.454.CMB.1.raw
  modified_base (248)..(251): a, c, t, g, unknown or other
  misc_feature (248)..(251): n is a, c, g, or t

SEQ ID NO: 286875 - DNA, 289 bp, Homo sapiens
  misc_feature: GYAE6OF01BCT5X.29.34.D01.1.454.CMB.1.raw
  modified_base (251)..(289): a, c, t, g, unknown or other
  misc_feature (251)..(289): n is a, c, g, or t
tcagatagagtactcacgaccggtgctcgatttagatcgtctgtgttggggtttgggacgaggcgggtggcatttgactactggggccagggaaccctggtcaccgtctcctcagcctccaccaagggcccatcggtctcccctggcgccctgctccaggagcacctccgagagcaacagcggccctgggctgcctggtcaagggactacttccgtatacgatcgctgagcgggctggcaaggcgcatagnnnnnnnnnnnnnnnnnnnnnnnnnnnnnnnnnnnnnnn

SEQ ID NO: 286876 - DNA, 260 bp, Homo sapiens
  misc_feature: GYAE6OF01D6XX5.29.34.D01.1.454.CMB.1.raw
  modified_base (162)..(162): a, c, t, g, unknown or other
  misc_feature (162)..(162): n is a, c, g, or t
  modified_base (246)..(260): a, c, t, g, unknown or other
  misc_feature (246)..(260): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggancacctccgagagcacagcggccctgggctgcctggtcaaggctacttcatagcgtactctgagcgggctggcaaggcgcatagnnnnnnnnnnnnnnn

SEQ ID NO: 286877 - DNA, 250 bp, Homo sapiens
  misc_feature: GYAE6OF01EEVQF.29.34.D01.1.454.CMB.1.raw
  modified_base (248)..(250): a, c, t, g, unknown or other
  misc_feature (248)..(250): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggactacttccatagcgtactctgagcgggctggcaaggcgcatagnnn

SEQ ID NO: 286878 - DNA, 251 bp, Homo sapiens; identical to SEQ ID NO: 286846
  misc_feature: GYAE6OF01EWWJR.29.34.D01.1.454.CMB.1.raw
  modified_base (248)..(251): a, c, t, g, unknown or other
  misc_feature (248)..(251): n is a, c, g, or t

SEQ ID NO: 286879 - DNA, 250 bp, Homo sapiens
  misc_feature: GYAE6OF01DD7A9.29.34.D01.1.454.CMB.1.raw
  modified_base (247)..(250): a, c, t, g, unknown or other
  misc_feature (247)..(250): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaaggcccatcggtcttcccctggcgccctgctccaggagcacctccgagagcacagcggccctgggctgcctggtcaaggactacttcctatacgatcgctgagcgggctggcaaggcgcatagnnnn

SEQ ID NO: 286880 - DNA, 253 bp, Homo sapiens
  misc_feature: GYAE6OF01AWI35.29.34.D01.1.454.CMB.1.raw
  modified_base (248)..(253): a, c, t, g, unknown or other
  misc_feature (248)..(253): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggactacttccagacgtatcactgagcgggctggcaaggcgcatagnnnnnn

SEQ ID NO: 286881 - DNA, 250 bp, Homo sapiens
  misc_feature: GYAE6OF01B1RYO.29.34.D01.1.454.CMB.1.raw
  modified_base (212)..(212): a, c, t, g, unknown or other
  misc_feature (212)..(212): n is a, c, g, or t
  modified_base (246)..(250): a, c, t, g, unknown or other
  misc_feature (246)..(250): n is a, c, g, or t
tcagatagagtactcacgaccggtgctcgatttagatcgtctgtgttgggtttgggtgccgaagttgctggaggtcacggtcaccacgctgctgagggagtagagtcctgaggactgtaggacagcccatcggtcttccccctggcgccctgctccaggagcacctccgagagcacagcggccctgggctgcctggtcaaggctacttccanatagtagtctgagcgggctggcaaggcgcatagnnnnn

SEQ ID NO: 286882 - DNA, 253 bp, Homo sapiens
  misc_feature: GYAE6OF01A6ZSY.29.34.D01.1.454.CMB.1.raw
  modified_base (248)..(253): a, c, t, g, unknown or other
  misc_feature (248)..(253): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggactacttcctatacgatcgctgagcgggctggcaaggcgcatagnnnnnn

SEQ ID NO: 286883 - DNA, 270 bp, Homo sapiens
  misc_feature: GYAE6OF01BZMAC.29.34.D01.1.454.CMB.1.raw
  modified_base (143)..(143): a, c, t, g, unknown or other
  misc_feature (143)..(143): n is a, c, g, or t
  modified_base (240)..(240): a, c, t, g, unknown or other
  misc_feature (240)..(240): n is a, c, g, or t
  modified_base (246)..(270): a, c, t, g, unknown or other
  misc_feature (246)..(270): n is a, c, g, or t
tcagatagagtactcacgaccggtgctcgatttagatcgtctgtgttgggtttgggaggaggcggtggcattttgactactggggccagggaaccctggtcaccgtctcctcagcctccaccaaggcccatcggtcttccccnggcgccctgctccaggagcacctccgagagcacagcgccctgggctgcctggtcaaggctacttccagacgtatcacgtgagcgggctggcaaggcncatagnnnnnnnnnnnnnnnnnnnnnnnnn

SEQ ID NO: 286884 - DNA, 253 bp, Homo sapiens
  misc_feature: GYAE6OF01AGUU7.29.34.D01.1.454.CMB.1.raw
  modified_base (232)..(232): a, c, t, g, unknown or other
  misc_feature (232)..(232): n is a, c, g, or t
  modified_base (243)..(243): a, c, t, g, unknown or other
  misc_feature (243)..(243): n is a, c, g, or t
  modified_base (248)..(253): a, c, t, g, unknown or other
  misc_feature (248)..(253): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggactacttccatagcgtactctgagcgggntgggcaaggcnatagnnnnnn

SEQ ID NO: 286885 - DNA, 252 bp, Homo sapiens
  misc_feature: GYAE6OF01DNS90.29.34.D01.1.454.CMB.1.raw
  modified_base (247)..(252): a, c, t, g, unknown or other
  misc_feature (247)..(252): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaggactacttccatagcgtactctgagcgggctggcaaggcgcatagnnnnnn

SEQ ID NO: 286886 - DNA, 217 bp, Homo sapiens
  misc_feature: GYAE6OF01AUSIJ.29.34.D01.1.454.CMB.1.raw
  modified_base (96)..(96): a, c, t, g, unknown or other
  misc_feature (96)..(96): n is a, c, g, or t
  modified_base (176)..(217): a, c, t, g, unknown or other
  misc_feature (176)..(217): n is a, c, g, or t
tcagatagagtactcacgaccggtgctcgatttagatcgtctgtgttgggtttgggggaagaggaagactgacggtccccccaggacgttcaggtnctgggcacagcggccctgggctgcctggtcaaggactacttccctagtctacgctgagcgggctggcaaggcgcatagcnnnnnnnnnnnnnnnnnnnnnnnnnnnnnnnnnnnnnnnnnn

SEQ ID NO: 286887 - DNA, 250 bp, Homo sapiens; identical to SEQ ID NO: 286879
  misc_feature: GYAE6OF01CQ8NQ.29.34.D01.1.454.CMB.1.raw
  modified_base (247)..(250): a, c, t, g, unknown or other
  misc_feature (247)..(250): n is a, c, g, or t

SEQ ID NO: 286888 - DNA, 251 bp, Homo sapiens; identical to SEQ ID NO: 286846
  misc_feature: GYAE6OF01C1T7M.29.34.D01.1.454.CMB.1.raw
  modified_base (248)..(251): a, c, t, g, unknown or other
  misc_feature (248)..(251): n is a, c, g, or t

SEQ ID NO: 286889 - DNA, 253 bp, Homo sapiens
  misc_feature: GYAE6OF01C3G3N.29.34.D01.1.454.CMB.1.raw
  modified_base (246)..(253): a, c, t, g, unknown or other
  misc_feature (246)..(253): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaaggcccatcggtcttccccctggcgccctgctccaggagcacctccgagagcacagcggccctgggctgcctggtcaaggctactcctatacgatcgctgagcgggctggcaaggcgcatagnnnnnnnn

SEQ ID NO: 286890 - DNA, 250 bp, Homo sapiens
  misc_feature: GYAE6OF01DYTIA.29.34.D01.1.454.CMB.1.raw
  modified_base (247)..(250): a, c, t, g, unknown or other
  misc_feature (247)..(250): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggactacttccatagcgtactctgagcgggctggcaaggcgcatgnnnn

SEQ ID NO: 286891 - DNA, 302 bp, Homo sapiens
  misc_feature: GYAE6OF01C9UIT.29.34.D01.1.454.CMB.1.raw
  modified_base (267)..(267): a, c, t, g, unknown or other
  misc_feature (267)..(267): n is a, c, g, or t
  modified_base (274)..(302): a, c, t, g, unknown or other
  misc_feature (274)..(302): n is a, c, g, or t
tcagatagagtactcacgaccggtgctcgatttagatcgtctgtgttgggtttgggagaggcgggtggcattttgaatacgtggggccagggaaccctggtccaccgtctcctcacgccctccaaccgaacgggccctattccggtccttcccccgtggccgcccctgcctccaggagcacctccgagagcacagcggccctgggctgcctggtacaaaggtactacttccgtacgtactgcgcgtggacgcgggctggacaaggcntatagcnnnnnnnnnnnnnnnnnnnnnnnnnnnnn

SEQ ID NO: 286892 - DNA, 333 bp, Homo sapiens
  misc_feature: GYAE6OF01CN8ZC.29.34.D01.1.454.CMB.1.raw
  modified_base (177)..(177): a, c, t, g, unknown or other
  misc_feature (177)..(177): n is a, c, g, or t
  modified_base (273)..(276): a, c, t, g, unknown or other
  misc_feature (273)..(276): n is a, c, g, or t
  modified_base (278)..(333): a, c, t, g, unknown or other
  misc_feature (278)..(333): n is a, c, g, or t
tcagatagagtactcacgaccggtgctcgatttagatcgtctgtgttggggtttggggagaggcgggtggcgattttgactactggggccagggaaccctggtcgacccgtctccctcgacgccctccgaccaacgggcccatccggtccttcccccgtggcgccctgcctccaggngcacctccgagagcacacgcggcccctgggctcgccctggtcaaggcctaacgttccgtaatacgatcgctgagcgggctggccaaggcgcaatgnnnnannnnnnnnnnnnnnnnnnnnnnnnnnnnnnnnnnnnnnnnnnnnnnnnnnnnnnnn

SEQ ID NO: 286893 - DNA, 257 bp, Homo sapiens
  misc_feature: GYAE6OF01BIN9K.29.34.D01.1.454.CMB.1.raw
  modified_base (248)..(257): a, c, t, g, unknown or other
  misc_feature (248)..(257): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggactacttcctatacgatcgctgagcgggctggcaaggcgcatagnnnnnnnnnn

SEQ ID NO: 286894 - DNA, 250 bp, Homo sapiens; identical to SEQ ID NO: 286863
  misc_feature: GYAE6OF01EY5JH.29.34.D01.1.454.CMB.1.raw
  modified_base (248)..(250): a, c, t, g, unknown or other
  misc_feature (248)..(250): n is a, c, g, or t

SEQ ID NO: 286895 - DNA, 257 bp, Homo sapiens
  misc_feature: GYAE6OF01CEBV1.29.34.D01.1.454.CMB.1.raw
  modified_base (249)..(257): a, c, t, g, unknown or other
  misc_feature (249)..(257): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttccccctggcgccctgctccaggagcacctccgagagcacagcggccctgggctgcctggtcaaggactacttcctatacgatcgctgagcgggctggcaaggcgcatagnnnnnnnnn

SEQ ID NO: 286896 - DNA, 262 bp, Homo sapiens
  misc_feature: GYAE6OF01CJUIS.29.34.D01.1.454.CMB.1.raw
  modified_base (252)..(262): a, c, t, g, unknown or other
  misc_feature (252)..(262): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgcctccaggagcacctccgagagcacagccggccctgggctgcctggtcaaaggactacttcctatacgatcgctgagcgggctggacaaggcgcatagnnnnnnnnnnn

SEQ ID NO: 286897 - DNA, 248 bp, Homo sapiens
  misc_feature: GYAE6OF01DFYOC.29.34.D01.1.454.CMB.1.raw
  modified_base (238)..(238): a, c, t, g, unknown or other
  misc_feature (238)..(238): n is a, c, g, or t
  modified_base (244)..(248): a, c, t, g, unknown or other
  misc_feature (244)..(248): n is a, c, g, or t
tcagatagagtactcacgaccggtgctcgatttagatcgtctgtgttgggtttgggagaggcgggtggctattttgactactggggccagggaaccctggtcaccgtctcctcagcctccaccaacggcccatcggtcttcccctggcgccctgctccaggagcacctccgagagcacagcggcctgggctgcctggtcaaggctactccagacgtatcactgagcggctggcaggcncatagnnnnn

SEQ ID NO: 286898 - DNA, 253 bp, Homo sapiens
  misc_feature: GYAE6OF01A1VCJ.29.34.D01.1.454.CMB.1.raw
  modified_base (246)..(253): a, c, t, g, unknown or other
  misc_feature (246)..(253): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggctacttccatagcgtactctgagcggctggcaaggcgcatagnnnnnnnn

SEQ ID NO: 286899 - DNA, 257 bp, Homo sapiens
  misc_feature: GYAE6OF01C4IWN.29.34.D01.1.454.CMB.1.raw
  modified_base (249)..(257): a, c, t, g, unknown or other
  misc_feature (249)..(257): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttccccctggcgccctgctccaggagcacctccgagagcacagcggccctggggctgcctggtcaaggctacttccatagcgtactctgagcgggctggcaaggcgcatagnnnnnnnnn

SEQ ID NO: 286900 - DNA, 304 bp, Homo sapiens
  misc_feature: GYAE6OF01AHMN4.29.34.D01.1.454.CMB.1.raw
  modified_base (240)..(240): a, c, t, g, unknown or other
  misc_feature (240)..(240): n is a, c, g, or t
  modified_base (273)..(304): a, c, t, g, unknown or other
  misc_feature (273)..(304): n is a, c, g, or t
tcagatagagtactcacgaccggtgctcgatttagatcgtctgtgttggggtttgggagaggcgggtggcattttgactactggggccagggaaccctggtcaccgtctcctcagcctccaccaagggccccatcggtccttcccccgtggcgcccctgcctccagggagcaccctccgagacgcacgacgccggcccctggggcctgccctgggtcaacggtactacttcctagtacgntcgactgacggcgggctggcaaggcgactatgnnnnnnnnnnnnnnnnnnnnnnnnnnnnnnnn

SEQ ID NO: 286901 - DNA, 249 bp, Homo sapiens
  misc_feature: GYAE6OF01B7FCD.29.34.D01.1.454.CMB.1.raw
  modified_base (247)..(249): a, c, t, g, unknown or other
  misc_feature (247)..(249): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaaggcccatcggtcttcccctggcgccctgctccaggagcacctccgagagcacagcggccctgggctgcctggtcaaggactacttcctatacgatcgctgagcgggctggcaaggcgcatagnnn

SEQ ID NO: 286902 - DNA, 265 bp, Homo sapiens
  misc_feature: GYAE6OF01C7IT4.29.34.D01.1.454.CMB.1.raw
  modified_base (248)..(265): a, c, t, g, unknown or other
  misc_feature (248)..(265): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaaggcccatcggtcttccccctggcgccctgctccaggagcacctccgagagcacagcggccctgggctgcctggtcaaggactacttcctatacgatcgctgagcgggctggcaaggcgcatagnnnnnnnnnnnnnnnnnn

SEQ ID NO: 286903 - DNA, 265 bp, Homo sapiens
  misc_feature: GYAE6OF01EQK1E.29.34.D01.1.454.CMB.1.raw
  modified_base (234)..(234): a, c, t, g, unknown or other
  misc_feature (234)..(234): n is a, c, g, or t
  modified_base (250)..(265): a, c, t, g, unknown or other
  misc_feature (250)..(265): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttccccctggcgccctgctccaggagcacctccgagagcacagcggccctgggctgcctggtcaaaggactacttcctatacgatcgctgagcgggntggcaaggcacatagnnnnnnnnnnnnnnnn

SEQ ID NO: 286904 - DNA, 263 bp, Homo sapiens
  misc_feature: GYAE6OF01A1GPK.29.34.D01.1.454.CMB.1.raw
  modified_base (253)..(263): a, c, t, g, unknown or other
  misc_feature (253)..(263): n is a, c, g, or t
tcagatagagtactcacgaccggtgctcgatttagatcgtctgtgttgggtttgggagaggcgggtggcattttgactactggggccagggagccctggtcaccgtctcctcagcctccaccaagggcccaccggtccttccccctggcgccctgctccaggagcacctccgagagcacagccgccctgggctgcctggtacaaggactacttccatagcgtactctgaggcgggctggacaaggcgcagtgnnnnnnnnnnn

SEQ ID NO: 286905 - DNA, 250 bp, Homo sapiens
  misc_feature: GYAE6OF01ECNSI.29.34.D01.1.454.CMB.1.raw
  modified_base (246)..(250): a, c, t, g, unknown or other
  misc_feature (246)..(250): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggctacttcctatacgatcgctgagcgggctggcaagcgcatagnnnnn

SEQ ID NO: 286906 - DNA, 327 bp, Homo sapiens
  misc_feature: GYAE6OF01BR48H.29.34.D01.1.454.CMB.1.raw
  modified_base (153)..(153): a, c, t, g, unknown or other
  misc_feature (153)..(153): n is a, c, g, or t
  modified_base (170)..(170): a, c, t, g, unknown or other
  misc_feature (170)..(170): n is a, c, g, or t
  modified_base (172)..(172): a, c, t, g, unknown or other
  misc_feature (172)..(172): n is a, c, g, or t
  modified_base (178)..(178): a, c, t, g, unknown or other
  misc_feature (178)..(178): n is a, c, g, or t
  modified_base (180)..(180): a, c, t, g, unknown or other
  misc_feature (180)..(180): n is a, c, g, or t
  modified_base (184)..(184): a, c, t, g, unknown or other
  misc_feature (184)..(184): n is a, c, g, or t
  modified_base (209)..(209): a, c, t, g, unknown or other
  misc_feature (209)..(209): n is a, c, g, or t
  modified_base (259)..(259): a, c, t, g, unknown or other
  misc_feature (259)..(259): n is a, c, g, or t
  modified_base (261)..(327): a, c, t, g, unknown or other
  misc_feature (261)..(327): n is a, c, g, or t
tcagatagagtactcacgaccggtgctcgatttagatcgtctgtgttgggtttgggagaggcgggtggcattttgactactggggccagggaacccctgggtaccaccgtctcctcgacgccctccaccaacgggcccatcggtcctccccgnggcgccctgctccaggncncctcgngncacngcgcctggctgcctggcaaggactnttcatacgatcgcagcggtccgggctgggaccagggccactagtagcagntnnnnnnnnnnnnnnnnnnnnnnnnnnnnnnnnnnnnnnnnnnnnnnnnnnnnnnnnnnnnnnnnnnn

SEQ ID NO: 286907 - DNA, 245 bp, Homo sapiens
  misc_feature: GYAE6OF02G13RX.29.34.D01.1.454.CMB.1.raw
  modified_base (243)..(245): a, c, t, g, unknown or other
  misc_feature (243)..(245): n is a, c, g, or t
tcagatagagtactcacgaccggtgctcgatttagatcgtctgtgttgggtttgggagaggcggtggcatttgactactgggccagggaaccctggtcaccgtctcctcagcctccaccaagggcccatcggtcttccctggcgccctgctccaggagcacctccgagagcacagcggccctgggctgcctggtcaaggacacttcctcgtactgcgctgagcgggctggcaaggcgcatagnnn

SEQ ID NO: 286908 - DNA, 247 bp, Homo sapiens
  misc_feature: GYAE6OF02ITMB5.29.34.D01.1.454.CMB.1.raw
  modified_base (246)..(247): a, c, t, g, unknown or other
  misc_feature (246)..(247): n is a, c, g, or t
tcagatagagtactcacgaccggtgctcgatttagatcgtctgtgttgggtttgggtgccgaagttgctggaggtcacggtcaccacgctgctgagggagtagagtcctgaggactgtaggacagcccatcggtcttcccctggcgccctgctccaggagcacctccgagagcacagcggccctgggctgcctggtcaaggactacttccagacagcgtactgagcgggctggcaaggcgcatagnn

SEQ ID NO: 286909 - DNA, 249 bp, Homo sapiens
  misc_feature: GYAE6OF02I0MW4.29.34.D01.1.454.CMB.1.raw
  modified_base (248)..(249): a, c, t, g, unknown or other
  misc_feature (248)..(249): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggactacttcctatacgatcgctgagcgggctggcaaggcgcatagnn

SEQ ID NO: 286910 - DNA, 247 bp, Homo sapiens
  misc_feature: GYAE6OF02H1DDJ.29.34.D01.1.454.CMB.1.raw
  modified_base (246)..(247): a, c, t, g, unknown or other
  misc_feature (246)..(247): n is a, c, g, or t
tcagatagagtactcacgaccggtgctcgatttagatcgtctgtgttgggtttgggtgccgaagttgctggaggtcacggtcaccacgctgctgagggagtagagtcctgaggactgtaggacagcccatcggtcttcccctggcgccctgctccaggagcacctccgagagcacagcggcactgggctgcctggtcaaggactacttccacgtgatcgactgagcgggctggcaaggcgcatagnn

SEQ ID NO: 286911 - DNA, 249 bp, Homo sapiens; identical to SEQ ID NO: 286909
  misc_feature: GYAE6OF02FSRKM.29.34.D01.1.454.CMB.1.raw
  modified_base (248)..(249): a, c, t, g, unknown or other
  misc_feature (248)..(249): n is a, c, g, or t

SEQ ID NO: 286912 - DNA, 248 bp, Homo sapiens
  misc_feature: GYAE6OF02GD6MT.29.34.D01.1.454.CMB.1.raw
  modified_base (247)..(248): a, c, t, g, unknown or other
  misc_feature (247)..(248): n is a, c, g, or t
tcagatagagtactcacgaccggtgctcgatttagatcgtctgtgttgggtttgggagaggcgggtggcattttgactactgggccagggaaccctggtcaccgtctcctcagcctccaccaagggcccatcggtcttcccctggcgccctgctccaggagcacctccgagagcacagcggccctgggctgcctggtcaaggactacttcctatacgatcgctgagcgggctggcaaggcgcatagnn

SEQ ID NO: 286913 - DNA, 284 bp, Homo sapiens
  misc_feature: GYAE6OF02IS5SL.29.34.D01.1.454.CMB.1.raw
  modified_base (163)..(163): a, c, t, g, unknown or other
  misc_feature (163)..(163): n is a, c, g, or t
  modified_base (249)..(284): a, c, t, g, unknown or other
  misc_feature (249)..(284): n is a, c, g, or t
tcagatagagtactcacgaccggtgctcgatttagatcgtctgtggttgggtttgggagagggcgggtggcattttgacgtactggggccagggaaccctggtcaccgtcctcctcagcctccaccaaggcccatcggtcttcccctgcgccctgctccaggngcacctcgagagcacagccggccctgggctgcctggtcaaggctacttcctatacgatcgctgagcgggctggcaaggcgcatagnnnnnnnnnnnnnnnnnnnnnnnnnnnnnnnnnnnn

SEQ ID NO: 286914 - DNA, 251 bp, Homo sapiens; identical to SEQ ID NO: 286846
  misc_feature: GYAE6OF02I8RNF.29.34.D01.1.454.CMB.1.raw
  modified_base (248)..(251): a, c, t, g, unknown or other
  misc_feature (248)..(251): n is a, c, g, or t

SEQ ID NO: 286915 - DNA, 249 bp, Homo sapiens
  misc_feature: GYAE6OF02F7K55.29.34.D01.1.454.CMB.1.raw
  modified_base (248)..(249): a, c, t, g, unknown or other
  misc_feature (248)..(249): n is a, c, g, or t
tcagatagagtactcacgaccggtgctcgatttagatcgtctgtgttgggtttgggagaggcgggtgacattttgactactggggccagggaaccctggtcaccgtctcctcagcctccaccaagggcccatcggtcttcccctggcgccctgctccaggagcacctccgagagcacagcggccctgggctgcctggtcaaggactacttccatagcgtactctgagcgggctggcaaggcgcatagnn

SEQ ID NO: 286916 - DNA, 263 bp, Homo sapiens
  misc_feature: GYAE6OF02FE0SX.29.34.D01.1.454.CMB.1.raw
  modified_base (248)..(263): a, c, t, g, unknown or other
  misc_feature (248)..(263): n is a, c, g, or t
tcagatagagtactcacgaccggtgctcgatttagatcgtctgtgttgggtttgggagaggcggtggcattttgactactggggccagggaaccctggtcaccgtctcctcagcctccaccaagggcccatcggtcttcccctggcgccctgctccaggagcacctccgagagcacagccggccctgggctgcctggtcaaggctacttccgatagcgtactctgagcgggctggcaaggcgcatagnnnnnnnnnnnnnnnn

SEQ ID NO: 286917 - DNA, 265 bp, Homo sapiens
  misc_feature: GYAE6OF02HFWA0.29.34.D01.1.454.CMB.1.raw
  modified_base (249)..(265): a, c, t, g, unknown or other
  misc_feature (249)..(265): n is a, c, g, or t
tcagatagagtactcacgaccggtgctcgatttagatcgtctgtgttgggtttgggagaggcgggtggcattttgactactggggccagggaaccctggtcaccgtctcctcacgcctccaccaaggcccagtcggtcttcccctggcgccctgctccaggagcacctccgagagcacagcggccctgggctgcctggtcaaggactacttcctatacgatcgctgagcgggctggcaaggcgcatagnnnnnnnnnnnnnnnnn

SEQ ID NO: 286918 - DNA, 304 bp, Homo sapiens
  misc_feature: GYAE6OF02GRD6I.29.34.D01.1.454.CMB.1.raw
  modified_base (251)..(253): a, c, t, g, unknown or other
  misc_feature (251)..(253): n is a, c, g, or t
  modified_base (255)..(304): a, c, t, g, unknown or other
  misc_feature (255)..(304): n is a, c, g, or t
tcagatagagtactcacgaccggtgctcgatttagatcgtctgtgttggggtttgggagagggcgggtggcatttgactactggggccagggaaccctggtcaccgtcctcctcacgcctccaccaacggcccatcggtcttcccctggcgccctgctccaggagcacctcgagagcacagcggccctgggcctgcctggtcaaggctacttccatagcgtactctgagcgggctggcaagggcgcatagnnnannnnnnnnnnnnnnnnnnnnnnnnnnnnnnnnnnnnnnnnnnnnnnnnnn

SEQ ID NO: 286919 - DNA, 250 bp, Homo sapiens
  misc_feature: GYAE6OF02INGAF.29.34.D01.1.454.CMB.1.raw
  modified_base (248)..(250): a, c, t, g, unknown or other
  misc_feature (248)..(250): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggactacttcctcgtactgcgctgagcgggctggcaaggcgcatagnnn

SEQ ID NO: 286920 - DNA, 305 bp, Homo sapiens
  misc_feature: GYAE6OF02HW10O.29.34.D01.1.454.CMB.1.raw
  modified_base (299)..(305): a, c, t, g, unknown or other
  misc_feature (299)..(305): n is a, c, g, or t
tcagatagagtactcacgaccggtgctcgatttagatcgtctgtgttgggtttgggagaggcgggtggcattttgactactggggccagggaaccctggtcaccgtctccctcacgcctccaaccgaacgggcccagtccggttcccttcccccgtggcccgtccctgcctccgagggacgccaccctccggaagacgccacgacggccggcccgtgggctcgccgttggtacgaaacggtaccttaccttacctaataccgatccgctggacggcgggctggacgaaggcgacatagnnnnnnn

SEQ ID NO: 286921 - DNA, 129 bp, Homo sapiens
  misc_feature: GYAE6OF02JSUNW.29.34.D01.1.454.CMB.1.raw
  modified_base (126)..(129): a, c, t, g, unknown or other
  misc_feature (126)..(129): n is a, c, g, or t
tcagatagagtactcacgaccggtgctcgatttagatcgtctgtgttgggttggggctgcaccatctgtcttcatcttcccgccatctgaagtactctatctgagcgggctggcaaggcgcatagnnnn

SEQ ID NO: 286922 - DNA, 283 bp, Homo sapiens
  misc_feature: GYAE6OF02JV0GB.29.34.D01.1.454.CMB.1.raw
  modified_base (161)..(161): a, c, t, g, unknown or other
  misc_feature (161)..(161): n is a, c, g, or t
  modified_base (225)..(225): a, c, t, g, unknown or other
  misc_feature (225)..(225): n is a, c, g, or t
  modified_base (247)..(283): a, c, t, g, unknown or other
  misc_feature (247)..(283): n is a, c, g, or t
tcagatagagtactcacgaccggtgctcgatttagatcgtctgtggttgggtttgggagaggcgggtggcattttgactactggggccaggaaccctggtcaccgtctcctcagcctcaccaaggcccatcggtcttcccctggcgccctgctccaggtancacctccgagagcacagcggccctgggctgcctggtcaaggctacttcctatacgatcgctgancgggctggcaaaggcgcatagnnnnnnnnnnnnnnnnnnnnnnnnnnnnnnnnnnnnn

SEQ ID NO: 286923 - DNA, 250 bp, Homo sapiens
  misc_feature: GYAE6OF02HPN1N.29.34.D01.1.454.CMB.1.raw
  modified_base (249)..(250): a, c, t, g, unknown or other
  misc_feature (249)..(250): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttccccctggcgccctgctccaggagcacctccgagagcacagcggccctgggctgcctggtcaaggactacttccatagcgtactctgagcgggctggcaaggcgcatagnn

SEQ ID NO: 286924 - DNA, 149 bp, Homo sapiens
  misc_feature: GYAE6OF02GVG0P.29.34.D01.1.454.CMB.1.raw
  modified_base (128)..(149): a, c, t, g, unknown or other
  misc_feature (128)..(149): n is a, c, g, or t
tcagatagagtactcacgaccggtgctcgatttagatcgtctgtgttgggtttgggggctgcaccatctgtcttcatcttcccgccatctgaagtactctatctgagcgggctggcaaggcgcatagnnnnnnnnnnnnnnnnnnnnnn

SEQ ID NO: 286925 - DNA, 251 bp, Homo sapiens; identical to SEQ ID NO: 286846
  misc_feature: GYAE6OF02GP8W4.29.34.D01.1.454.CMB.1.raw
  modified_base (248)..(251): a, c, t, g, unknown or other
  misc_feature (248)..(251): n is a, c, g, or t

SEQ ID NO: 286926 - DNA, 250 bp, Homo sapiens; identical to SEQ ID NO: 286877
  misc_feature: GYAE6OF02FYMVE.29.34.D01.1.454.CMB.1.raw
  modified_base (248)..(250): a, c, t, g, unknown or other
  misc_feature (248)..(250): n is a, c, g, or t

SEQ ID NO: 286927 - DNA, 251 bp, Homo sapiens; identical to SEQ ID NO: 286846
  misc_feature: GYAE6OF02I5GU8.29.34.D01.1.454.CMB.1.raw
  modified_base (248)..(251): a, c, t, g, unknown or other
  misc_feature (248)..(251): n is a, c, g, or t

SEQ ID NO: 286928 - DNA, 251 bp, Homo sapiens
  misc_feature: GYAE6OF02IG7L7.29.34.D01.1.454.CMB.1.raw
  modified_base (247)..(251): a, c, t, g, unknown or other
  misc_feature (247)..(251): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggctacttcctatacgatcgctgagcgggctggcaaggcgcatagnnnnn

SEQ ID NO: 286929 - DNA, 252 bp, Homo sapiens
  misc_feature: GYAE6OF02F7P8O.29.34.D01.1.454.CMB.1.raw
  modified_base (249)..(252): a, c, t, g, unknown or other
  misc_feature (249)..(252): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttccccctggcgccctgctccaggagcacctccgagagcacagcggccctgggctgcctggtcaaggactacttcctatacgatcgctgagcgggctggcaaggcgcatagnnnn

SEQ ID NO: 286930 - DNA, 249 bp, Homo sapiens; identical to SEQ ID NO: 286909
  misc_feature: GYAE6OF02GFXKT.29.34.D01.1.454.CMB.1.raw
  modified_base (248)..(249): a, c, t, g, unknown or other
  misc_feature (248)..(249): n is a, c, g, or t

SEQ ID NO: 286931 - DNA, 250 bp, Homo sapiens
  misc_feature: GYAE6OF02GDU9G.29.34.D01.1.454.CMB.1.raw
  modified_base (247)..(250): a, c, t, g, unknown or other
  misc_feature (247)..(250): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggctacttcctatacgatcgctgagcgggctggcaaggcgcatagnnnn

SEQ ID NO: 286932 - DNA, 250 bp, Homo sapiens; identical to SEQ ID NO: 286863
  misc_feature: GYAE6OF02F8F7F.29.34.D01.1.454.CMB.1.raw
  modified_base (248)..(250): a, c, t, g, unknown or other
  misc_feature (248)..(250): n is a, c, g, or t

SEQ ID NO: 286933 - DNA, 127 bp, Homo sapiens
  misc_feature: GYAE6OF02ICJY1.29.34.D01.1.454.CMB.1.raw
tcagatagagtactcacgaccggtgctcgatttagatcgtctgtgttgggtttgggggctgcaccatctgtcttcatcttcccgccatctgaagtactctatctgagcgggctggcaaggcgcatag

SEQ ID NO: 286934 - DNA, 264 bp, Homo sapiens
  misc_feature: GYAE6OF02I7AST.29.34.D01.1.454.CMB.1.raw
  modified_base (248)..(264): a, c, t, g, unknown or other
  misc_feature (248)..(264): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggctacttcctcgtactgccgctgagcgggctggcaaggcacatagnnnnnnnnnnnnnnnnn

SEQ ID NO: 286935 - DNA, 127 bp, Homo sapiens
  misc_feature: GYAE6OF02FLOQO.29.34.D01.1.454.CMB.1.raw
  modified_base (127)..(127): a, c, t, g, unknown or other
  misc_feature (127)..(127): n is a, c, g, or t
tcagatagagtactcacgaccggtgctcgatttagatcgtctgtgttgggtttggggctgcaccatctgtcttcatcttcccgccatctgaagtactctatctgagcgggctggcaaggcgcatagn

SEQ ID NO: 286936 - DNA, 253 bp, Homo sapiens; identical to SEQ ID NO: 286882
  misc_feature: GYAE6OF02G6PKW.29.34.D01.1.454.CMB.1.raw
  modified_base (248)..(253): a, c, t, g, unknown or other
  misc_feature (248)..(253): n is a, c, g, or t

SEQ ID NO: 286937 - DNA, 252 bp, Homo sapiens
  misc_feature: GYAE6OF02HUPVK.29.34.D01.1.454.CMB.1.raw
  modified_base (231)..(231): a, c, t, g, unknown or other
  misc_feature (231)..(231): n is a, c, g, or t
  modified_base (247)..(252): a, c, t, g, unknown or other
  misc_feature (247)..(252): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaaggcccatcggtcttcccctggcgccctgctccaggagcacctccgagagcacagcggccctgggctgcctggtcaaggactacttcctatacgatcgctgagcgggntggcaaggcgcatagnnnnnn

SEQ ID NO: 286938 - DNA, 194 bp, Homo sapiens
  misc_feature: GYAE6OF02FZDVB.29.34.D01.1.454.CMB.1.raw
  modified_base (174)..(194): a, c, t, g, unknown or other
  misc_feature (174)..(194): n is a, c, g, or t
tcagatagagtactcacgaccggtgctcgatttagatcgtctgtgttgggtttgggggaagaggaagactgacggtccccccaggagttcaggtgctgggcacagcggccctgggctgcctggtcaaggactacttccctagtctacgctgagcgggctggcaaggcgcatagnnnnnnnnnnnnnnnnnnnnn

SEQ ID NO: 286939 - DNA, 252 bp, Homo sapiens; identical to SEQ ID NO: 286852
  misc_feature: GYAE6OF02GWDF0.29.34.D01.1.454.CMB.1.raw
  modified_base (248)..(252): a, c, t, g, unknown or other
  misc_feature (248)..(252): n is a, c, g, or t

SEQ ID NO: 286940 - DNA, 270 bp, Homo sapiens
  misc_feature: GYAE6OF02H724W.29.34.D01.1.454.CMB.1.raw
  modified_base (251)..(270): a, c, t, g, unknown or other
  misc_feature (251)..(270): n is a, c, g, or t
tcagatagagtactcacgaccggtgctcgatttagatcgtctgtgttgggtttgggagaggcgggtggcattttgactactggggccagggaaccctggtcaccgtctcctcagcctccaaccaagggcccatcggtcttcccctggcgccctgctccaggagcacctccgagagcacagccggccctgggctgcctggtacaggactacttccatacgatcgctgagcgggctggcaaggcgcaagtagnnnnnnnnnnnnnnnnnnnn

SEQ ID NO: 286941 - DNA, 275 bp, Homo sapiens
  misc_feature: GYAE6OF02HIGAL.29.34.D01.1.454.CMB.1.raw
  modified_base (143)..(143): a, c, t, g, unknown or other
  misc_feature (143)..(143): n is a, c, g, or t
  modified_base (242)..(242): a, c, t, g, unknown or other
  misc_feature (242)..(242): n is a, c, g, or t
  modified_base (250)..(254): a, c, t, g, unknown or other
  misc_feature (250)..(254): n is a, c, g, or t
  modified_base (257)..(275): a, c, t, g, unknown or other
  misc_feature (257)..(275): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaaggcccatcggtcttccccnggcgccctgctccaggagcacctccgagagcacagcggccctgggctgcctggtcaaggactacttcctatacgatcgctgagcgggctggacaaggcncaagtagnnnnnaannnnnnnnnnnnnnnnnnn

SEQ ID NO: 286942 - DNA, 261 bp, Homo sapiens
  misc_feature: GYAE6OF02HJBW4.29.34.D01.1.454.CMB.1.raw
  modified_base (249)..(261): a, c, t, g, unknown or other
  misc_feature (249)..(261): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttccccctggcgccctgctccaggagcacctccgagagcacagcggccctgggctgcctggtcaaggactacttcctatacgatcgctgagcgggctggcaaggcgcatagnnnnnnnnnnnnn

SEQ ID NO: 286943 - DNA, 287 bp, Homo sapiens
  misc_feature: GYAE6OF02HU3XH.29.34.D01.1.454.CMB.1.raw
  modified_base (225)..(225): a, c, t, g, unknown or other
  misc_feature (225)..(225): n is a, c, g, or t
  modified_base (251)..(287): a, c, t, g, unknown or other
  misc_feature (251)..(287): n is a, c, g, or t
tcagatagagtactcacgaccggtgctcgatttagatcgtctgtgttggggtttgggagaggcgggtggcattttgactactggggccagggaaccctggtcaaccgtctcctcagcctccaccaagggccccatcggtcttcccccgtggcgcccctgctccgaggagcacctccgagagcacagcggccctgggctgcctggtcaaggactacttccatacgntcgctgagcggctggcaggcgcatgnnnnnnnnnnnnnnnnnnnnnnnnnnnnnnnnnnnnn

SEQ ID NO: 286944 - DNA, 269 bp, Homo sapiens
  misc_feature: GYAE6OF02JHA5P.29.34.D01.1.454.CMB.1.raw
  modified_base (221)..(221): a, c, t, g, unknown or other
  misc_feature (221)..(221): n is a, c, g, or t
  modified_base (248)..(269): a, c, t, g, unknown or other
  misc_feature (248)..(269): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaaggcccatcggtcttccccctggcgccctgctccaggagcacctccgagagcacagcggccctgggctgcctggtcaaggctacttcctcgtactgcnctgagcgggctgcgaaggcgcagtagnnnnnnnnnnnnnnnnnnnnnn

SEQ ID NO: 286945 - DNA, 280 bp, Homo sapiens
  misc_feature: GYAE6OF02GGV1G.29.34.D01.1.454.CMB.1.raw
  modified_base (255)..(280): a, c, t, g, unknown or other
  misc_feature (255)..(280): n is a, c, g, or t
tcagatagagtactcacgaccggtgctcgatttagatcgtctgtggttgggtttgggagaggcgggtggctattttgactactggggccagggaaccctggtcaccgtctcctcagcctccaccaagggcccatcggtcttccccctggcgcccctgcctccaggagcacctccgagagcacagcggccctgggctgcctggtcaaggctacttccatagccgtactctggagcgggctggcaagggcgcatagnnnnnnnnnnnnnnnnnnnnnnnnnn

SEQ ID NO: 286946 - DNA, 255 bp, Homo sapiens
  misc_feature: GYAE6OF02IH3ZR.29.34.D01.1.454.CMB.1.raw
  modified_base (247)..(255): a, c, t, g, unknown or other
  misc_feature (247)..(255): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggactacttcctatacgatcgctgagcgggctggcaggcgcatagnnnnnnnnn

SEQ ID NO: 286947 - DNA, 255 bp, Homo sapiens
  misc_feature: GYAE6OF02HRIX9.29.34.D01.1.454.CMB.1.raw
  modified_base (219)..(219): a, c, t, g, unknown or other
  misc_feature (219)..(219): n is a, c, g, or t
  modified_base (248)..(255): a, c, t, g, unknown or other
  misc_feature (248)..(255): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggactacttcctatacgntcgctgagcgggctggacaggcgcatagnnnnnnnn

SEQ ID NO: 286948 - DNA, 254 bp, Homo sapiens
  misc_feature: GYAE6OF02HUG5P.29.34.D01.1.454.CMB.1.raw
  modified_base (242)..(242): a, c, t, g, unknown or other
  misc_feature (242)..(242): n is a, c, g, or t
  modified_base (247)..(254): a, c, t, g, unknown or other
  misc_feature (247)..(254): n is a, c, g, or t
tcagatagagtactcacgaccggtgctcgatttagatcgtctgtgttgggtttgggagaggcgggtggcattttgactactggggccagggaaccctggtcaccgtctcctcagcctccaccaaggcccatcggtcttcccctggcgccctgctccaggagcacctccgagagcacagcggccctgggctgcctggtcaaggactacttcctatacgatcgctgagcgggctggcaaggcgnatagnnnnnnnn

SEQ ID NO: 286949 - DNA, 268 bp, Homo sapiens
  misc_feature: GYAE6OF02HC2RQ.29.34.D01.1.454.CMB.1.raw
  modified_base (251)..(268): a, c, t, g, unknown or other
  misc_feature (251)..(268): n is a, c, g, or t
tcagatagagtactcacgaccggtgctcgatttagatcgtctgtgttgggtttgggagaggcgggtggcattttgactactggggccagggaaccctggtcaccgtctccctcagcctccaccaaggcccatcggtcttcccctggcgccctgctccaggagcacctccgagagcacagcggccctgggctgcctggtcaaggcttacttcctatacgatcgctggagcgggctgggcaaggcgacatagnnnnnnnnnnnnnnnnnn

SEQ ID NO: 286950 - DNA, 303 bp, Homo sapiens
  misc_feature: GYAE6OF02HPJE0.29.34.D01.1.454.CMB.1.raw
  modified_base (183)..(183): a, c, t, g, unknown or other
  misc_feature (183)..(183): n is a, c, g, or t
  modified_base (268)..(303): a, c, t, g, unknown or other
  misc_feature (268)..(303): n is a, c, g, or t
tcagatagagtactcacgaccggtgctcgatttagatcgtctgtgttgggtttgggagaggcgggtggcatttttgactacgtggggccagggaaccctggtcaccgtctcctcacgcctccaccaagggcccatcggtccttcccctggcgccctgctccgagagcacctccgagagcacgngcggccctgggcctgccgtggtaccaaggaccttaccttccttatacgactcgctgacggcgggctggacgaaggcgtcaatagnnnnnnnnnnnnnnnnnnnnnnnnnnnnnnnnnnnn

SEQ ID NO: 286951 - DNA, 262 bp, Homo sapiens
  misc_feature: GYAE6OF02IAUZX.29.34.D01.1.454.CMB.1.raw
  modified_base (163)..(163): a, c, t, g, unknown or other
  misc_feature (163)..(163): n is a, c, g, or t
  modified_base (245)..(262): a, c, t, g, unknown or other
  misc_feature (245)..(262): n is a, c, g, or t
tcagatagagtactcacgaccggtgctcgatttagatcgtctgtgttgggtttgggagaggcgggtggcattttgactactggggccagggaaccctggtcaccgtctccctcacgcctccaccaagggcccatcggtcttccctggcgccctgctccaggancacctcgagagcacagcgcctgggctgcctggtcaaggcctacgtcctatacgatcgctgacgcggctggcaaggcgcatgnnnnnnnnnnnnnnnnnn

SEQ ID NO: 286952 - DNA, 287 bp, Homo sapiens
  misc_feature: GYAE6OF02F5KUY.29.34.D01.1.454.CMB.1.raw
  modified_base (163)..(163): a, c, t, g, unknown or other
  misc_feature (163)..(163): n is a, c, g, or t
  modified_base (251)..(287): a, c, t, g, unknown or other
  misc_feature (251)..(287): n is a, c, g, or t
tcagatagagtactcacgaccggtgctcgatttagatcgtctgtgttgggtttgggagaggcgggtggcattttgactacgtggggccagggaaccctggtcaccgtctcctcagcctccaccaagggcccatcggtcttccccctggcgccctgctccaggncacctccgagagcacagcggccctgggctgcctggtacaaggactacttcctatacgatcgctgagcgggctggacaaggcgcatagnnnnnnnnnnnnnnnnnnnnnnnnnnnnnnnnnnnnn

SEQ ID NO: 286953 - DNA, 418 bp, Homo sapiens
  misc_feature: GYAE6OF01C5O98.39.9.A09.1.454.CMB.1.raw
  modified_base (414)..(418): a, c, t, g, unknown or other
  misc_feature (414)..(418): n is a, c, g, or t
tcagtcgcactagtcacgaccggtgctcgatttagcgagacgcgcaggggaaggtcaccatctcctgctctggaagcacctccaacattgggattaattatgtatcctggtaccagcaactcccaggtacagcccccaaactcctcatttatgacgatgataagcgactctctgggattcctgaccgattctctggctccaagtctggcacgtcagccaccctgggctcaccggactccagtctggggacgaggccgattattactgcgcagcatgggatacctccctgagtggtggggtgttcggcggagggaccagctgaacgtcctaggtcagcccaaggctcgccccctcggtcactctcgttcccgcctcctcactagtcgcgactgagcgggctggcaaggcgcatgnnnnn

SEQ ID NO: 286954 - DNA, 424 bp, Homo sapiens
  misc_feature: GYAE6OF01B5JID.39.9.A09.1.454.CMB.1.raw
  modified_base (415)..(424): a, c, t, g, unknown or other
  misc_feature (415)..(424): n is a, c, g, or t
tcagtcgcactagtcacgaccggtgctcgatttagcgagacgcgcaggggaaggtcaccatctcctgctctggaagcacctccaacattgggattaattatgtatcctggtaccagcaactcccaggtacagcccccaaactcctcatttatgacgatgataagcgactctctgggattcctgaccgattctctggctccaagtctggcacgtcagccaccctgggcgtcaccggactccagtctggggacgaggccgattattactgcgcagcatgggatacctccctgagtggtggggtgttcggcggaggaccaagctgaccgtcctaggtcagcccaaggcctgccccctcggtcactctgttcccacctcctcactagtgcactgagcgggctggcaaggcgacagtagnnnnnnnnnn

SEQ ID NO: 286955 - DNA, 432 bp, Homo sapiens
  misc_feature: GYAE6OF02IRHIM.39.9.A09.1.454.CMB.1.raw
  modified_base (421)..(432): a, c, t, g, unknown or other
  misc_feature (421)..(432): n is a, c, g, or t
tcagtcgcactagtcacgaccggtgctcgatttagcgagacgcgcaggggaaggtcaccatctcctgctctggaagcacctccaacattgggattaattatgtatcctggtaccagcaactcccaggtacagcccccaaactcctcatttatgacgatgataagcgactctctgggattcctgaccgattctctggctccaagtctggcacgtcagccaccctgggctcaccggactccagtctggggacaggccgattattactgcgcagcatgggatacctccctgagtggtggggtgttcgggcggagggaccaagctgaccgtccgtaggtcagcccaaggctcgccccctcggtcactctcgttcccgccctcctcactagtgcgactgacgcgggctgggacaagggcgcatagnnnnnnnnnnnn

SEQ ID NO: 286956 - DNA, 129 bp, Homo sapiens
  misc_feature: GYAE6OF01CZ64D.49.62.F07.1.454.CMB.1.raw
  modified_base (119)..(119): a, c, t, g, unknown or other
  misc_feature (119)..(119): n is a, c, g, or t
  modified_base (125)..(129): a, c, t, g, unknown or other
  misc_feature (125)..(129): n is a, c, g, or t
tcagagtcgagagacacgaccggtgctcgatttagtagtcgcataaagggaaggggctggccctgacgtgtttctgttcccgccctcctctctctcgactctgagcggctggcaaggcncatagnnnnn

SEQ ID NO: 286957 - DNA, 503 bp, Homo sapiens
  misc_feature: GYAE6OF01DDGDN.49.62.F07.1.454.CMB.1.raw
  modified_base (495)..(495): a, c, t, g, unknown or other
  misc_feature (495)..(495): n is a, c, g, or t
tcagagtcgagagacacgaccggtgctcgatttagtagtcgcataaagggaaaggggctgtgggtccaggaggcagaactctgggtgtctcaccatggcctggatccctctacttcttcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtactttatgtcttcggaacttgacgaccaaggtcaccgtctgggtcagcccaaggccaacccnctgctacc

SEQ ID NO: 286958 - DNA, 497 bp, Homo sapiens
  misc_feature: GYAE6OF01DJQ6D.49.62.F07.1.454.CMB.1.raw
  modified_base (240)..(240): a, c, t, g, unknown or other
  misc_feature (240)..(240): n is a, c, g, or t
  modified_base (313)..(313): a, c, t, g, unknown or other
  misc_feature (313)..(313): n is a, c, g, or t
  modified_base (416)..(416): a, c, t, g, unknown or other
  misc_feature (416)..(416): n is a, c, g, or t
  modified_base (489)..(489): a, c, t, g, unknown or other
  misc_feature (489)..(489): n is a, c, g, or t
tcagagtcgagagacacgaccggtgctcgatttagtagtcgcataaagggaaaggggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggccaggcccctgtgttggtgatgtataaagacactgagaggccctnagggatccctgagcgattctctggctccaggtcagggacaacggtcacattggcatcagtggagtccaggcagaggacgaggctgactattatgtcaatcaangaacaccattggtaacttatgtcttacggaatgcgacaaggtcaccgtcctgggcacgcccaaggccaacccntcgctacc

SEQ ID NO: 286959 - DNA, 525 bp, Homo sapiens
  misc_feature: GYAE6OF01EN9VZ.49.62.F07.1.454.CMB.1.raw
  modified_base (246)..(246): a, c, t, g, unknown or other
  misc_feature (246)..(246): n is a, c, g, or t
tcagagtcgagagacacgaccggtgctcgatttagtagtcgcataaagggaaagggggctggtgggtccaggacggcagaactctgggtgtctcaccatggcctggatccctctacttctccccctcctcactctctgcacaggtctctgaggcctcctatgagctgacacagccaccctggtgtcagtgtccccaggacagacggccgaggatcacctgctcgtggacatgcattcgccaaacgntatgcttattggtaccagcagaagccgggccaggcccctgtgttggtgtatgtataaagacactggagaggccctcgagggactccctgagcgattctctggctacaggtcagggacaacggtcacgagttggcctatcagtcgacgtcaggcagaggacgaggctgactattatgtacaatcaacagaacacattcggtacttatgtacttcggtaactgccgactaggtccaccgtcgtggacacgacccgaaggacccaaccccactcgtctaccg

SEQ ID NO: 286960 - DNA, 512 bp, Homo sapiens
  misc_feature: GYAE6OF01B8R7J.49.62.F07.1.454.CMB.1.raw
  modified_base (501)..(501): a, c, t, g, unknown or other
  misc_feature (501)..(501): n is a, c, g, or t
tcagagtcgagagacacgaccggtgctcgatttagtagtcgcataaagggaaagggggcgtgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggcccctcagggatccctgagcgattctctggctccaggtcagggacaacggtcacattggccatcagtggagtccaggcagaggacgaggctgactattatgtacaatcaacagacaccattaggtacttatgtcttcggaactgacgacaaggtcaccgtctggtccagccccgtaaggccccaacccnctcgtctaccg

SEQ ID NO: 286961 - DNA, 503 bp, Homo sapiens
  misc_feature: GYAE6OF01B2V02.49.62.F07.1.454.CMB.1.raw
  modified_base (242)..(242): a, c, t, g, unknown or other
  misc_feature (242)..(242): n is a, c, g, or t
  modified_base (495)..(495): a, c, t, g, unknown or other
  misc_feature (495)..(495): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaaggcccaaccccnctgctacc

SEQ ID NO: 286962 - DNA, 545 bp, Homo sapiens
  misc_feature: GYAE6OF01AVZ00.49.62.F07.1.454.CMB.1.raw
tcagagtcgagagacacgaccggtgctcgatttagtagtcgcataaagggaaagggggcgtgtgggtccaggaggcagaactcgtgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcgagggatccctgagcgattctctggctccgaggtcaggggacacggtcacattggccatcagtggagtcaggcagaggacgaggctagacttattattgtactaagtacaacagaaccacctagtttaggtactttatgttacttcggaaactggacgaaccgaaggtcctaccggttctcgggtaccacggtacccgaaacgggccccaaacccacgtcgcctaccg

SEQ ID NO: 286963 - DNA, 504 bp, Homo sapiens
  misc_feature: GYAE6OF01DT3AO.49.62.F07.1.454.CMB.1.raw
  modified_base (495)..(495): a, c, t, g, unknown or other
  misc_feature (495)..(495): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagcactgagaggccctcagggatcccctgagcgattctctggctccaggtcagggacaacggtcacattggccatcagtggagtccaggcagaggacgaggctggactattattgacaatcaacagacaccattggtacttatgtcttcgaactgcgacaaggtcaccgtcctgggtccagcccaaggcccaacccnctgtctacc

SEQ ID NO: 286964 - DNA, 521 bp, Homo sapiens
  misc_feature: GYAE6OF01DBKN1.49.62.F07.1.454.CMB.1.raw
  modified_base (242)..(242): a, c, t, g, unknown or other
  misc_feature (242)..(242): n is a, c, g, or t
tcagagtcgagagacacgaccggtgctcgatttagtagtcgcataaagggaaaggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgntatgcttattggtaccagcagaagccgggccaggcccctgtgttggtgatgtataaagacactgagagccctcagggatccctgagcgattctctggctccaggtcagggacaacggtcacattggaccatcagtggagtccaggcagaggacgaggctgactattattgtcaatcaacagacaacctattcggtacttatgttcttacggaacttgaccgaccaaggtccaacccggttcctgggtccagcccaaggaccccaacccactgtcctacc

SEQ ID NO: 286965 - DNA, 505 bp, Homo sapiens
  misc_feature: GYAE6OF01EIXYN.49.62.F07.1.454.CMB.1.raw
  modified_base (496)..(496): a, c, t, g, unknown or other
  misc_feature (496)..(496): n is a, c, g, or t
tcagagtcgagagacacgaccggtgctcgatttagtagtcgcataaagggaaaggggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagaacaccattggtacttatgtcttcggaactgcgaccaaggtcaaccgtctgggtcagcccaaggcccaaccccntcgctaccg

SEQ ID NO: 286966 - DNA, 531 bp, Homo sapiens
  misc_feature: GYAE6OF01B3Z0U.49.62.F07.1.454.CMB.1.raw
  modified_base (254)..(254): a, c, t, g, unknown or other
  misc_feature (254)..(254): n is a, c, g, or t
  modified_base (518)..(518): a, c, t, g, unknown or other
  misc_feature (518)..(518): n is a, c, g, or t
tcagagtcgagagacacgaccggtgctcgatttagtagtcgcataaagggaaaagggggctaggtggggtccaggaggacaagaactctgggtgtctcaccatggccttggatccctcctacttctccccctcctcactctctgcacagggctctgaggccctcctatgagctgacacagcccaccctcggtgtcagtgtcccccaggacagacggccaggatcacctgctctggagatgcattgccaaaccgntatgcttattggtaccagcagaagccgggccaggcccctgtgttggtgatgtataaagacactgagaggccctcgagggactccctgagcgattcctctggctccgaggtcagggacacggtcacattggccatcagtggagtccgaggcaggaggacgaggctgactattattgtacaatcaactagacaccattaggtacttatcgtcttacggatgccgaccgaaggtccaccgtcgtggcacgacccacgacccaacccncgtcgtctacccg

SEQ ID NO: 286967 - DNA, 538 bp, Homo sapiens
  misc_feature: GYAE6OF01BI9WW.49.62.F07.1.454.CMB.1.raw
  modified_base (428)..(428): a, c, t, g, unknown or other
  misc_feature (428)..(428): n is a, c, g, or t
tcagagtcgagagacacgaccggtgctcgatttagtagtcgcataaagggaaaggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccggccaggcccctgtgttggtgatgtataaagacactgagaggccctcaagggatccctgagcgtattctctggctccgaggtcagggacaacggtcacattcggccatcagtggagtccaggcagaggacgaggctgactattattgtacaatcaacganacactagttagttaacttagtcgtacgttacgacgtcgaccgaacgtacggtcctaccgttcggtcggtacgacgaacccgaacgaccccaacccgtactcgtctacccg

SEQ ID NO: 286968 - DNA, 552 bp, Homo sapiens
  misc_feature: GYAE6OF01EMEJH.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggccccagtgttggtgatgtataaagacactgagaggccctcgagggactccctgagcgattctctggctccgaggtcagggacaacggtcacagttcggccatcgagtggagtccgaggcaggaggacgaggctgactattatgtacaatcaacagaacaccagttgtaacttagtgtcttacggaactggaccgaaccgtaaggtcccaccggttccgtcggggttaccacggaccccgtaaacggaccccaaaccccgacttccgtcctaccccg

SEQ ID NO: 286969 - DNA, 511 bp, Homo sapiens
  misc_feature: GYAE6OF01C0QKO.49.62.F07.1.454.CMB.1.raw
  modified_base (243)..(243): a, c, t, g, unknown or other
  misc_feature (243)..(243): n is a, c, g, or t
  modified_base (424)..(424): a, c, t, g, unknown or other
  misc_feature (424)..(424): n is a, c, g, or t
  modified_base (500)..(500): a, c, t, g, unknown or other
  misc_feature (500)..(500): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgntatgcttattggtaccagcagaagccgggccaggcccctgtgttggtgatgtataaagacactgagaggccctcgagggactcccgtgagcgattctctggctcaggtcagggacacggtcacattcggcatcaggtggagtccaggcaggaggacgaggctgactatattgtacatcaanagacactagttgtattatgtctcggaactgcacgaaggtcaccgtcgtcggacacggcccaacggaccccaacccnctgtcctaccg

SEQ ID NO: 286970 - DNA, 511 bp, Homo sapiens
  misc_feature: GYAE6OF01D239T.49.62.F07.1.454.CMB.1.raw
  modified_base (243)..(243): a, c, t, g, unknown or other
  misc_feature (243)..(243): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgntatgcttattggtaccagcagaagccgggccaggcccctgtgttggtgatgtataaagacactgagaggccctcagggatcccctgagcgattctctggctccaggtcagggacaacggtcacattggccatcagtggagtccaggcagaggacgaggctgactattattgtcaatcaacagacaccattggtacttatgtcttcggaactgcgaccaaggtccaccgtctgggtcagaccccaaggacccaaccccactcgtctacc

SEQ ID NO: 286971 - DNA, 614 bp, Homo sapiens
  misc_feature: GYAE6OF01D43I3.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccggccaggcccctgtgttggtgatgtaataaagacactgagacggccctcgagggactccccgtgacggcgtattcctcgtggcctccgaggtcgaagggacaacggtcacgtattcgggaccagtcgaaggttcggaacgtccgagggacgaaggaacgggacggaggctgaacttagtttagttcgtactaatccaacacgaacctacctagtttacggttaactttattcgttaccgtttacggaacttcggaccgtaaccgtaaacggtcctacccggttccgtcggggtccaacggaccccgaaacggaccccaaaccccgtaccgttcgtcccttaacccg

SEQ ID NO: 286972 - DNA, 553 bp, Homo sapiens
  misc_feature: GYAE6OF01CZTX3.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaagcaatatgcttactggtaccagcagaagccaggccaggccctgtctgatcatttataagactttgagagggcctcgacggacccctgagcgtattctacgtcggctccagctcagcgaacaacagtcacgttgaccatcagtgagtccggcagaggacgaggcgtgactattacgtgtacagtcatcaggactaggtaacgtcggactacgtttagtcgttacgttagttcgggacgggtacgggaaccaaggccgtacgacccggttaccgtacgggtaccaacggccccgaaagggtcccgtacccccggg

SEQ ID NO: 286973 - DNA, 515 bp, Homo sapiens
  misc_feature: GYAE6OF01D12TE.49.62.F07.1.454.CMB.1.raw
  modified_base (316)..(316): a, c, t, g, unknown or other
  misc_feature (316)..(316): n is a, c, g, or t
  modified_base (425)..(425): a, c, t, g, unknown or other
  misc_feature (425)..(425): n is a, c, g, or t
  modified_base (506)..(506): a, c, t, g, unknown or other
  misc_feature (506)..(506): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctnagggatcccgtgagcgattctctggctccgaggtcagggacaacggtcacattggccatcgagtggagtccaggcagaggacgaggctgactattattgtacaatcaanagacactattgtacttatgtcttcggaactgacgaccgaaggtccaccgtcgtgggtccacgcccgaaggacccaaccccntgtcctacc

SEQ ID NO: 286974 - DNA, 573 bp, Homo sapiens
  misc_feature: GYAE6OF01A659W.49.62.F07.1.454.CMB.1.raw
  modified_base (242)..(242): a, c, t, g, unknown or other
  misc_feature (242)..(242): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgtggtgatgtataaagacactgagaggccctcgagggactcccgtgagcgattctctggctccgaggtcagggacaacggtcacattcggccagtcaggtggagtccgaggcaggaggacgaggctgactattagttgtacaatacaacagaaccacctagtttacggttaactttagtcgttacttacggaacttggaccgaaccgtaacggtcctacccggttccgtcggggtaccctacggacccccgtaacgggaccccctaaacccccacgttcgtccgtacccg

SEQ ID NO: 286975 - DNA, 609 bp, Homo sapiens
  misc_feature: GYAE6OF01B23ZT.49.62.F07.1.454.CMB.1.raw
  modified_base (178)..(178): a, c, t, g, unknown or other
  misc_feature (178)..(178): n is a, c, g, or t
  modified_base (238)..(238): a, c, t, g, unknown or other
  misc_feature (238)..(238): n is a, c, g, or t
  modified_base (351)..(351): a, c, t, g, unknown or other
  misc_feature (351)..(351): n is a, c, g, or t
tcagagtcgagagacacgaccggtgctcgatttagtagtcgcataaagggaaaggggctgtgggtccaggaggcagaactctgggtgtctcaccatggcctggatccctctacttctccccctctcactctctgcacaggctctgaggcctcctatgagctgacacagccacctggtntcagtgtccccaggcagcggccaggactcacctgctctggagatgcattcgccaaaccgntatcgcttatggtaccagcagaacgccgggcaaggcccctaggtcgttcggtgattgtagtaaagctacgtgacggtacggccctagagggtactcccgtgacgtcgtattcncgtcggctcgacggtcgacggtactaacggtcacgtacgttcggacctagtccgagtcggacgtccgaggtcgaacggacgacgtaggtcgtagacttaagttacgttgtacctaacgtacgaacgtacgtacctaaccgtagtttacggtaactttagtcgtacgttaccggaacttgacccgtaacgtaggttccaccggttcgtacgggttccaacgtacccgaacggtacccaacccgtgtccgtacgttaccg

SEQ ID NO: 286976 - DNA, 531 bp, Homo sapiens
  misc_feature: GYAE6OF01B66DB.49.62.F07.1.454.CMB.1.raw
  modified_base (244)..(244): a, c, t, g, unknown or other
  misc_feature (244)..(244): n is a, c, g, or t
  modified_base (518)..(518): a, c, t, g, unknown or other
  misc_feature (518)..(518): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgaccaaacgntatgcttattggtaccagcagaagccgggccaggcccctgtgttggtgatgtataaagacactgagaggccctcgagggatcccgtgagcgattcgtctggctccaggtcagggacaacggtcacgattggccatcagtggagtccgaggcagaggacgaggctgactattattgtacaatcaacagacacgtattaggtacttagtcgtacttcggaactgacgaaccgaggttcacccgttcgtcgggtcacgcccgaacggcccaaacccnctcgtcctacccg

SEQ ID NO: 286977 - DNA, 503 bp, Homo sapiens
  misc_feature: GYAE6OF01B6RCQ.49.62.F07.1.454.CMB.1.raw
  modified_base (242)..(242): a, c, t, g, unknown or other
  misc_feature (242)..(242): n is a, c, g, or t
  modified_base (315)..(315): a, c, t, g, unknown or other
  misc_feature (315)..(315): n is a, c, g, or t
  modified_base (417)..(417): a, c, t, g, unknown or other
  misc_feature (417)..(417): n is a, c, g, or t
  modified_base (494)..(494): a, c, t, g, unknown or other
  misc_feature (494)..(494): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggccaggcccctgtgttggtgatgtataaagacactgagaggccctnagggatcccgtgagcgattctactggctcgaggtcagggacaacggtcacattggcatcagtgagtcagcagaggacgaggctgactattatgtcaatcaanagacaccattggtacttatgtctcggaactgcgacctaaggtcacgtcgtgggtccaggcccaagggccccaacccnctgtcaccg

SEQ ID NO: 286978 - DNA, 497 bp, Homo sapiens
  misc_feature: GYAE6OF01EGDOZ.49.62.F07.1.454.CMB.1.raw
  modified_base (488)..(488): a, c, t, g, unknown or other
  misc_feature (488)..(488): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattatgtcaatcaacagacacattggtacttatgtcttcggaactgcgaccaaggtcacgtctggcagcccaagcccaacccnctgtctacg

SEQ ID NO: 286979 - DNA, 512 bp, Homo sapiens
  misc_feature: GYAE6OF01COT55.49.62.F07.1.454.CMB.1.raw
  modified_base (243)..(243): a, c, t, g, unknown or other
  misc_feature (243)..(243): n is a, c, g, or t
  modified_base (425)..(425): a, c, t, g, unknown or other
  misc_feature (425)..(425): n is a, c, g, or t
  modified_base (503)..(503): a, c, t, g, unknown or other
  misc_feature (503)..(503): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaaccgntatgcttattggtaccagcagaagccgggccaggcccctgtgttggtgatgtataaagacactgagaggccctcagggatccctgagcgattctctggctcaggtcagggacacggtcacattggccatcagtggagtccagggcaggaggacgaggctagactattattgtacaatacaanagacaccattggtacttatgtcttcggaatgacgaccaaggtccaccgtcctgggtccagccccaaggcccaaccccnctgtctacc

SEQ ID NO: 286980 - DNA, 508 bp, Homo sapiens
  misc_feature: GYAE6OF01AIOTB.49.62.F07.1.454.CMB.1.raw
  modified_base (499)..(499): a, c, t, g, unknown or other
  misc_feature (499)..(499): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggactccctgagcgattctctggctccaggtcagggacaacggtcacattggccatcagtggagtccaggcaggaggacgaggctgactattatgtcaatcaacagacaccattgtacttatcgtcttacggaactgacgaccaaggtccaccgtcgtggcacgcccgaaggcccaacccnctcgctacg

SEQ ID NO: 286981 - DNA, 532 bp, Homo sapiens
  misc_feature: GYAE6OF01A7T9Y.49.62.F07.1.454.CMB.1.raw
  modified_base (242)..(242): a, c, t, g, unknown or other
  misc_feature (242)..(242): n is a, c, g, or t
  modified_base (316)..(316): a, c, t, g, unknown or other
  misc_feature (316)..(316): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctnagggactccctgagcgattctctggctccaggtcaagggacaacggtcacattggccatcagtggatccgaggcagaggacgaggctgactattattgtacaatcaacagaaccaccattaggttaccttagtgtcttacggaacttgcgaacctaaggtctaccgtccgtgggtccacgacccgtaacggacccaaccccacgtcgtcctacccg

SEQ ID NO: 286982 - DNA, 530 bp, Homo sapiens
  misc_feature: GYAE6OF01DXUBM.49.62.F07.1.454.CMB.1.raw
  modified_base (243)..(243): a, c, t, g, unknown or other
  misc_feature (243)..(243): n is a, c, g, or t
  modified_base (317)..(317): a, c, t, g, unknown or other
  misc_feature (317)..(317): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgntatgcttattggtaccagcagaagccgggccaggcccctgtgttggtgatgtataaagacactgagaggccctnagggatccctgagcgattctctggctccaggtcagggacaacggtcacattggccatcagtggagtccaggcaggaggacgaggctgactattattgtcaatcaacagaacaccattggtaactttatgtcttcggaacttgaccgaacctaaggtccaccggtccgtgggtaccagaccccgtaagggaccccaaccccacgtgtcctaccg

SEQ ID NO: 286983 - DNA, 517 bp, Homo sapiens
  misc_feature: GYAE6OF01C0BC9.49.62.F07.1.454.CMB.1.raw
  modified_base (241)..(241): a, c, t, g, unknown or other
  misc_feature (241)..(241): n is a, c, g, or t
  modified_base (401)..(401): a, c, t, g, unknown or other
  misc_feature (401)..(401): n is a, c, g, or t
  modified_base (413)..(413): a, c, t, g, unknown or other
  misc_feature (413)..(413): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccgggccaggcccctgtgttggtgatggtataaagacactgagaggccctgagggatccctgagcgattctctggctccgaggtcagggacacggtcacagttcggcatcgaggtggagtccaggcgagaggacgnggctgacttatnttgtacaatcaacagacaacctagttcggttattagtgtcttacggaactgacgacaggtcaccgtcgtggtcacgcccgaacggacccacccactgtcctacg

SEQ ID NO: 286984 - DNA, 574 bp, Homo sapiens
  misc_feature: GYAE6OF01BD49X.49.62.F07.1.454.CMB.1.raw
  modified_base (243)..(243): a, c, t, g, unknown or other
  misc_feature (243)..(243): n is a, c, g, or t
  modified_base (332)..(332): a, c, t, g, unknown or other
  misc_feature (332)..(332): n is a, c, g, or t
  modified_base (358)..(358): a, c, t, g, unknown or other
  misc_feature (358)..(358): n is a, c, g, or t
tcagagtcgagagacacgaccggtgctcgatttagtagtcgcataaagggaaaggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccaaaaccgntatgcttattggtaccagcagaagccggcaggcccctgtgttggtgatgtataaagacactgagagcctcagggatcctgagcgattcnctggctcgaggtcaggacaacgtcanattggccagtcagtggagtacccgaggcaaggaggacgaaggctgactattattgtacaatacaacagaacacctagtttacggtaactttatcgttaccgttacggtaactcgaccgtaaccgtaaggttacccacccggttaccggtcgggttacccaacggtaccccgaaacgggaccccaaaccccccgtagttaccgtaccgttaaccccg

SEQ ID NO: 286985 - DNA, 620 bp, Homo sapiens
  misc_feature: GYAE6OF01B2QBJ.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaccgatatgtcttattcggtaccagcagaacggccgggccacggcccctggtggttggtagatagtaataaagactactggagacggccctacgagggtactcccgtagacgcgtacttcgtacgtggcctaccgacggtacgaacgggaaccgtaaccggtacaacgtacgttcggacctatcgaggtggacgtccgaggcgaggacggacgaggctagtacttattagtgtacaataccaacgagaaccacgtagttacggttaccttagttcgttacgtaccggtaatcggaccgtaaccgtacggtcctacccggttccgtcgggaccaaccggaccccgtaaccggaccccaaacccctacgtccgtcctacccg

SEQ ID NO: 286986 - DNA, 499 bp, Homo sapiens
  misc_feature: GYAE6OF01AD97H.49.62.F07.1.454.CMB.1.raw
  modified_base (490)..(490): a, c, t, g, unknown or other
  misc_feature (490)..(490): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtataaagacactgagaggccctcagggatccctgagcgattctctggctccgaggtcagggacaacggtcacattggccatcagtggagtccaggcaggaggacgaggctgactattattgtacaatcaacagaacactattgtacttatgtcttcgatgcacaggtcaccgtctggcagcccaacggccaacccnctgtctacc

SEQ ID NO: 286987 - DNA, 610 bp, Homo sapiens
  misc_feature: GYAE6OF01DSZ8P.49.62.F07.1.454.CMB.1.raw
  modified_base (244)..(244): a, c, t, g, unknown or other
  misc_feature (244)..(244): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaaccgntatgcttattggtaccagcagaacgccggccacggcccctgtgttggtgatgtagtaaagacacgtggagacggccctacgagggtactcccgtgacgcgtatttcctcgtcggcctccgaggtcgaagggacacggtcacgtagttcggcctatcgagtggacgtccgagggcaggaggacgaggctgtaacttagttacttgtacaataccaacacgaacactagtttcggtaactttagtcgttacgttacggaacttggaccgtaaccgtaacggtccctaacccggttcccgttgggacccgtaaccggacccccgtaaacgggaccccctaaacccccgtcgttaccgtccttaaccccg

SEQ ID NO: 286988 - DNA, 506 bp, Homo sapiens
  misc_feature: GYAE6OF01BJNV9.49.62.F07.1.454.CMB.1.raw
  modified_base (496)..(496): a, c, t, g, unknown or other
  misc_feature (496)..(496): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagcactgagaggccctcagggatccctgacgcgattctctggctccgaggtcagggacaacggtcacattggccatcagtggagtccaggcagaggacgaggctgactattatgtacaatcaacagacaccagttgtacttatgtcttcgactgcgaccaaggtcaccgtctgggtcacgcccgaaggcccaacccnctgtctaccg

SEQ ID NO: 286989 - DNA, 509 bp, Homo sapiens
  misc_feature: GYAE6OF01ATOHP.49.62.F07.1.454.CMB.1.raw
  modified_base (499)..(499): a, c, t, g, unknown or other
  misc_feature (499)..(499): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccccctgtgttggtgatgtataaagacactgagaggccctcagggatcccctgagcgattctctggctccaggtcagggacaacggtcacattggccatcagtggagtccaggcagaggacgaggctgactattatgtcaatcaacagacaccattggtaacttatgtcttcggaactgcgaccaaggtccaccgtctgggtcaggcccaaggcccaaacccnctgtctaccg

SEQ ID NO: 286990 - DNA, 626 bp, Homo sapiens
  misc_feature: GYAE6OF01DQPCA.49.62.F07.1.454.CMB.1.raw
  modified_base (181)..(181): a, c, t, g, unknown or other
  misc_feature (181)..(181): n is a, c, g, or t
  modified_base (241)..(241): a, c, t, g, unknown or other
  misc_feature (241)..(241): n is a, c, g, or t
tcagagtcgagagacacgaccggtgctcgatttagtagtcgcataaagggaaagggggctagtgggtccaggaggcagaactctgggtgtctcaccatggcctggatccctctacttctcccctctcacttctctgcacaggctctgaggcctcctatgagctgacacagccaccctggtntcagtcgtcccaggacagacggccaggatcacctgctctggagatgcattgaccaaacgntatgacttaattggtaccagcaaggaacggccgggaccacggcccctggtcgttggtgtagtggtaataaagacacgtggagacggtcctagagggtactccgtagagtcgtattcgtcgtggctacgaggtcgaggacacggtcaactgttacgcctagtcgaggtaggacgtaccgaggtacaaggacggacgaggctagaacttagttattcgactaatcaaacagaacctacctagtttacggtaactttagttcgttaccgttacggtaactcggaccgtaaaccgtaacggttcccgtaacccggttcggttacggggtcctaaccggtaccccgaaacgggtcccccaaaccccgtcgttacggtcccttaaccccgg

SEQ ID NO: 286991 - DNA, 527 bp, Homo sapiens
  misc_feature: GYAE6OF01CGZ4Z.49.62.F07.1.454.CMB.1.raw
  modified_base (361)..(361): a, c, t, g, unknown or other
  misc_feature (361)..(361): n is a, c, g, or t
  modified_base (384)..(384): a, c, t, g, unknown or other
  misc_feature (384)..(384): n is a, c, g, or t
tcagagtcgagagacacgaccggtgctcgatttagtagtcgcataaagggaaaggggctgtgggtccaggaggcagaactctgggtgtctcaccatggcctggatccctctacttctcccctccctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggcacggccctgtgtggtgatgtataaagacactgagacggccctcgagggactccctgagcgattctctggctcaggtcaggacacggtcanattggccatcagtgagtccaggnagaggacgaggctgactagttattgtacaatcaaactagaacacctaagttgtaacttagtgtacttacggaactgacgaccgtaaggtcctaccgtcgtcggtcacgaccccgtaacggcccaaaccccactcgtcctaccg

SEQ ID NO: 286992 - DNA, 501 bp, Homo sapiens
  misc_feature: GYAE6OF01B3HZY.49.62.F07.1.454.CMB.1.raw
  modified_base (242)..(242): a, c, t, g, unknown or other
  misc_feature (242)..(242): n is a, c, g, or t
  modified_base (491)..(491): a, c, t, g, unknown or other
  misc_feature (491)..(491): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgtggtgatgtataaagacactgagaggccctcagggatcccctgagcgattctctggctccaggtcagggacaacggtcacattggccatcagtggagtccaggcagaggacgaggctgactattattgtcaatcaacagacaccattggtacttatgtcttcggaactgcacaggtcaccgtcgtggtcagcccaaggcccaacccnctgtctaccg

SEQ ID NO: 286993 - DNA, 126 bp, Homo sapiens
  misc_feature: GYAE6OF01CX9AO.49.62.F07.1.454.CMB.1.raw
tcagagtcgagagacacgaccggtgctcgatttagtagtcgcataaagggaaaggggctggccctgacgtgtttctgttcccaccctcctctctctcgactctgagcgggctggcaaggcgcatag

SEQ ID NO: 286994 - DNA, 640 bp, Homo sapiens
  misc_feature: GYAE6OF01DEFS3.49.62.F07.1.454.CMB.1.raw
  modified_base (244)..(244): a, c, t, g, unknown or other
  misc_feature (244)..(244): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctggagatgcattcgaccaaaaccgntatgtcttagttaggtaccagcaaggaacgccgggaccacggcccctggtcggttggtgatagtaataaagacacgtgagacggccctacgagggtactcccgtagacgtcgtattccgtcgtcggcctaccgaggtacgaacgggtaacgaacgggtcaacgtagttcggacctagtcgagtgggtaacgtccgaggcgaggacggacggaggctagacttagttagttagtacaactacaacaacggaacctaaccgtaagttttacggtaactttacgttcgttaccgttacgggtaacctcggaccggtaaccgtaacggtccgtacccggttcggttcgggtacccacggaccccgaaccggaccccaaccccgtactcgttacctacccg

SEQ ID NO: 286995 - DNA, 530 bp, Homo sapiens
  misc_feature: GYAE6OF01BN0VI.49.62.F07.1.454.CMB.1.raw
  modified_base (243)..(243): a, c, t, g, unknown or other
  misc_feature (243)..(243): n is a, c, g, or t
  modified_base (518)..(518): a, c, t, g, unknown or other
  misc_feature (518)..(518): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgntatgcttattggtaccagcagaagccgggccaggcccctgtgttggtgatgtaataaagacactgagaggccctcgagggatccctgagcgattctctggctcaggtcagggacaaacggtcacgattcggctatcagtggacgtccagggcagaggacgaggctgactattagtgtacaatcaacagacacattggtacttatgtacttacggaactgaccgacaaggtccaaccgtccgtgggtaccaggaccccgaaggaccccaaaccccnctcgtctacccg

SEQ ID NO: 286996 - DNA, 686 bp, Homo sapiens
  misc_feature: GYAE6OF01CL4QD.49.62.F07.1.454.CMB.1.raw
  modified_base (298)..(298): a, c, t, g, unknown or other
  misc_feature (298)..(298): n is a, c, g, or t
tcagagtcgagagacacgaccggtgctcgatttagtagtcgcataaagggaaagggggctgtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgaccaaaccgatatgcttatgtacagcagaacgccggccaggccctgtgttggtgatagtataaanacactgagacggccctcgagggactcccgtgacgtcgtacttctcgtcggctccgtaggtcgaacggaactaacgggtcaacgtagttcggacctacgtacgaggttaggacgtccgagggacgaggaagggtaaccggaggtacgtaggtaaacgttaactttaaggtttcgaacctaagtaacgaaacctaagaaccctaaccgttaagtttaccggtttaaatttaagttaccggttacgtttaacccgggaactttcgggaaacccggtaaacccggtaaacggttaccccggaacccggtttaccgttccgggggttacccaaccgggacccccgaaaccgggaccccctaaaccccgttacgtaccgttaccgttaaccccg

SEQ ID NO: 286997 - DNA, 569 bp, Homo sapiens
  misc_feature: GYAE6OF01CVBS1.49.62.F07.1.454.CMB.1.raw
  modified_base (245)..(245): a, c, t, g, unknown or other
  misc_feature (245)..(245): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgaccaaaaccgntatgcttattggtaccagcagaagccggccaggccctgtgttggtgatgtaataaagacactgagacggccctcgagggactcccgtagagcgtattctcgtcggcctccgagggtcagggaacaacggtcaactagttcggaccatcgagtcggacgtccgaggccaaggacggacgaggctagaacttattagttgtacaatcaacagactactagttcgtattagttcgtcttacggaactcgaccgtaacgaacggtccaccggtccgtcgggtccacggacccgaaacggaccccaacccctacgtcgtccgtaacccg

SEQ ID NO: 286998 - DNA, 584 bp, Homo sapiens
  misc_feature: GYAE6OF01EDNGE.49.62.F07.1.454.CMB.1.raw
  modified_base (226)..(226): a, c, t, g, unknown or other
  misc_feature (226)..(226): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctgganatgcattgccaaaacgatatgcttattggtaccagcagaagccgggccaggcccctgtgttggtgatgtataaagacactgagaggccctcagggactcccgtgagcgattctctggctcaggtcagggacaacggtcacattggaccatcagtggagtccaggcaggaggacgaggctggactattattgtacaatcaacagaaccacctagtttacggtaactttattacgttctttaccggaacttgacccggaaccgtaaacgggtcctaaccccggttcccgttggggttacccaagggaccccccaaaggggacccccaaaaccccccgtacttaccggtcccgtaaccccg

SEQ ID NO: 286999 - DNA, 589 bp, Homo sapiens
  misc_feature: GYAE6OF01BUPA6.49.62.F07.1.454.CMB.1.raw
  modified_base (444)..(444): a, c, t, g, unknown or other
  misc_feature (444)..(444): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtggagatgctattcgacccaaaaccgatatgtacttattggtaaccagcaaggaacgccgggccacggcccctgtgttggtgatgtataaagacactgaggacggccctcgagggctcccgtgacgcgtattcgtcgtggcctcgaggtcgagggaccgaacggtcactagttcgccatcgaggtcggacgtccgaggcaaggacggacggagctgaactnttagtgtacaatcaacagaaccactagttggtacttagtcgttacgttcggtaactcggaccgaaaccgacggtcctacccggttccgtcgggtaccaaccggaccccgaacggacccccaaacccctcgttccgtcctaacccg

SEQ ID NO: 287000 - DNA, 522 bp, Homo sapiens
  misc_feature: GYAE6OF01BDLGK.49.62.F07.1.454.CMB.1.raw
  modified_base (512)..(512): a, c, t, g, unknown or other
  misc_feature (512)..(512): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccaggcccctgtgttggtgatgtataaagacactgagacggccctcgagggatccctgagcgattctctggctccaggtcagggacaacggtcacattggccatcgagtggagtccaggcaggaggacgaggctggacttagttattgtacaatcaacagaccaccattggtactttatcgttacttacggactgccgaccaaggtcaccgtccgtgggtcagacccgaagcccaaaccccnctcgtctacc

SEQ ID NO: 287001 - DNA, 634 bp, Homo sapiens
  misc_feature: GYAE6OF01CL4VR.49.62.F07.1.454.CMB.1.raw
  modified_base (246)..(246): a, c, t, g, unknown or other
  misc_feature (246)..(246): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcattcgaccaaaacgntatgtcttagttcggtaccagcaagaacggccgggccacggccctggtgttggtgatagtaataaagacacgtagagacggccctacgagggtactccgtgacgtcgtattcgtcgtggcctaccgaggtcgaagggtaacgtaacggtcaacgtagttcggacctagtacgaggttcggacgtaccgaggacgagggacgggacgaggctaggtacttagttagttacgtactaataccgtaaacgacgtaacctacgttaagttacggttaacttgttacgttacgtacggtaactcggaccgaaccgtaacggtccctacccggttacgtgggtacccaccggtaccccaacgggacccccaaacccgtctcgttacctaccccg

SEQ ID NO: 287002 - DNA, 642 bp, Homo sapiens
  misc_feature: GYAE6OF01ENND0.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgatatgtcttattggtaccagcaagaacgccgggccacggcccctgtggttggtgatgtaataaagacacgtagagacggccctacgagggactcccgtagacgcgtattctcgtggctcgaggtcgaggacaacggtcactagttcgacatcgaggtacggacgtaccgagggacaaggaacgggaacggaggtacgtaggtaacttaatttagttaggttaactaaacttaccgaaacgtaacgaacctaaccgtaagtttacgggttaactttagttcggttaccgtttacgggaacgttcggaccggtaaccgtaacggtacccgtacccggttccggtcgggtacccgaacgaccccgaaccggaaccccaaacccctaccgttcgtccgtacccg

SEQ ID NO: 287003 - DNA, 604 bp, Homo sapiens
  misc_feature: GYAE6OF01BRGRO.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccacggcccctgtgttggtgagtgtataaagacactgaggacggccctgagggactcccgtagagcgtatttctcgtcggcctccgtagggtccgaagggaacctaaccgggtcaactagttcggacctatcgaggtggacgtccgagggcaaggacggacgaggctgacttattattgtacaataccaacacgaaccacctagtttacggttaactttagtgttacttacggtaactcggtaccgaacccgtaacggtcctaacccggttccggtcggggtacccaacggaccccgaaacgggaccccaaaccccgcttcggtcctaacccg

SEQ ID NO: 287004 - DNA, 715 bp, Homo sapiens
  misc_feature: GYAE6OF01CUXTQ.49.62.F07.1.454.CMB.1.raw
  modified_base (247)..(247): a, c, t, g, unknown or other
  misc_feature (247)..(247): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgacggcctcctatgagctgacacagcccaccctggtgtcagtcgtcccaggacagacggccaggatcacctgctcgtggagatgctattcgaccaaaacgntatgtcttagttacggtaccagacaggaacggccggaccgacggtccccgtggttggttaggtgtagtagtaataaagacacgtagaggacggccctagacgggtactccgtgacgacgtattcgtcgtcggtcctcgaggtcgaggacgacggtacaacgtacgttacgactagtacgtaggtcggtacgtaccgaaggcgaaggacggaacggacggtctacggtaacttaagtttacgttacgtaactaactaacgaaacgtaacgtaacctaaccgttaagtttacggttaacgtttacgttacggtttaccgttacgggtaaaccgtacgggaaacccggtaaccggtaaaccgggttcccgttaaccccgggttacccggtacggggttaccccaaccgggtaacccccgtaaaccgggtaaccccctaacccccggtaacgttacccgtacccgtaacccg

SEQ ID NO: 287005 - DNA, 657 bp, Homo sapiens
  misc_feature: GYAE6OF01CID23.49.62.F07.1.454.CMB.1.raw
  modified_base (302)..(302): a, c, t, g, unknown or other
  misc_feature (302)..(302): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctcgtggagatgctattcgaccaaaccgatatgtactttagtaggtaccagcaagaacggccggccacggcccttttttggngttggtgatagtataaagcacgtgagacggccctgagggtactccgtgacgcgtattctcgtggcctccgaggtaccgaagggacctaacggtcaacgtagttcggacctagtcgaggttcggacgtccgagggtccgaagggacggaacggaggtctagtaacgttaatttacgttagtacaatacaaacgacgaacctaacgttagtttacggttaactttagttcgtttaccgttaacggtaacgtcggaaccgtaaccgtaacgggtccctaacccggttccggtacgggtacccaccggtaccccgtaaaccgggacccccctaaaccccgtactccgtcccgtaacccg

SEQ ID NO: 287006 - DNA, 533 bp, Homo sapiens
  misc_feature: GYAE6OF01EF4GY.49.62.F07.1.454.CMB.1.raw
  modified_base (242)..(242): a, c, t, g, unknown or other
  misc_feature (242)..(242): n is a, c, g, or t
  modified_base (522)..(522): a, c, t, g, unknown or other
  misc_feature (522)..(522): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggccaggcccctgtgttggtgatgtataaagacactgagacggccctcgagggactcccgtgacgcgattctctggcctcgaggtcagggacaacggtcacattcggccatcgagtggagtccgaggcaggaggacgaggctagactattattgtacaatcaacagacaacctagttggtacttatgttcttacggaactgacgaccaaggtccaccggtcgtgggccacgaccccgaacggaccccaaccccnctgtcctaccg

SEQ ID NO: 287007 - DNA, 803 bp, Homo sapiens
  misc_feature: GYAE6OF01C8C5A.49.62.F07.1.454.CMB.1.raw
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaaccgntatgcttattggtaccagcagaagccggccaggcccctgtgttggtgatgtaataaagacagtgagacggccctacgaggactacccgtgacgcgtacttccgtcgtacgggccttaccgaacgggttaccgaacggggtaaccgtaaacccgggtaccgtaaacgtacgtttacggggaccctaacgttaccgtaacggttacggggaaccggtttaaccccggaacggggtaacccggaaaggggaaacggggtaaaccgggaaggggtacccgttaagggtaaacccgttttaaagtttaacgttttacggttaaacctaaaagtttaccaaaaccgtaacggaaccctaacccgttaagtttaccgggttaacctttaggtttaccgtttaccgttaaccgggttaaaccgtacggtacccggtaaaccccgtaacggggtttaacccgtaaccccgggtttaccccggttacggggtttacccgaaaccggacccccggtaaaccgggaacccccctaaacccccgtaacccgttcggtaccccttaacccccg

SEQ ID NO: 287008 - DNA, 672 bp, Homo sapiens
  misc_feature: GYAE6OF01B1MKS.49.62.F07.1.454.CMB.1.raw
  modified_base (115)..(115): a, c, t, g, unknown or other
  misc_feature (115)..(115): n is a, c, g, or t
  modified_base (247)..(247): a, c, t, g, unknown or other
  misc_feature (247)..(247): n is a, c, g, or t
  modified_base (266)..(266): a, c, t, g, unknown or other
  misc_feature (266)..(266): n is a, c, g, or t
  modified_base (311)..(311): a, c, t, g, unknown or other
  misc_feature (311)..(311): n is a, c, g, or t
tcagagtcgagagacacgaccggtgctcgatttagtagtcgcataaagggaaagggggctgtgggtccgaggtaggcagaactctgggtgtctcaccatggcctaggaatccctntacttctcccctctcactctctgcacaggctctgaggcctctatgagctgacacagtcacccgtcggtgtctgtgtacctcagggacagacggccacggatcacctgctgtggcgatcgctatgaccaaaanatatgtcttactggtaccngcagacgcacggccgaggcccctgtacgttggtagtacgtttaanaaagtactttgagtacggtccctcgaaccggaccctgacgacgtagttctcgtgctcgagctacgaggacacgcgtcaaccttcgaaccactacaggtcgacgtccggacacggacggacgtaggctacgggaacttacgtacgtcgtaccgtacgttccgactaggtaccgaaggtccgtaagggttcggtaacgttaagtttacggtaggtttaccggttacggttacggggacgggtaacggggtacccgttaaccggtacggttaacgggttaccccgttagggtttacccggtaccggtaaaccggtccccggtaaaaggggttccccgttccggttacccccccgggttaaccgg

SEQ ID NO: 287009 - DNA, 773 bp, Homo sapiens
  misc_feature: GYAE6OF01CR5E0.49.62.F07.1.454.CMB.1.raw
  modified_base (258)..(258): a, c, t, g, unknown or other
  misc_feature (258)..(258): n is a, c, g, or t
tcagagtcgagagacacgaccggtgctcgatttagtagtcgcataaagggaaagggggctgtgggtccaggaggcagaactctgggtgtctcaccatggcctgatccctctacttcctccccctcctcactctctgcacaggctctgacggcctcctatgagctgacacacgcccacccgttcggtgtcagtcgtcccccaggacagaccggccaggactcacctgctcgtaggatatgactattcgacccaaacgtntactgtacctttagttacggtaaccagacgaaggtaaccgggcccgggaccgaaccgggtccccgttggttcgggttacgggtagtaacgttaggtaaacgtaaaacggacctaacgtagggaacggccggtaccccgtaagggtaacgggtaccttaccccggtaggtaccggtacgttacgtttccgtacgtccgggtacctacccggtaagggttaccggaaacggggtaacccgtaccgggtacctaacgtacggtttaccgggaccctaagttaccgaagggttcggtaaccgtcccggaaggtaccgaagggtaacgggaaccggtacggtcgtaaggttaacctttaagtttacgtttacgaaccgtaataccgaaacgtaacgtaccgtaaccgttagttaccggttacttacgtacggttaccgttacgaagtcgtaccgacgtaccgtccgtaccggtcgtacggtcaccgacccgacggtaacccaccgacgtgtacctacccg

SEQ ID NO: 287010 - DNA, 648 bp, Homo sapiens
  misc_feature: GYAE6OF01CHJ85.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcgacctgctctggagatgcattgaccaaacgatatgcttattggtaccagcagaacgccggccaggcccctgtgttggtgatgtataaagacactgagacggccctacgagggactcccgtgagcgtaacttctacgtcggcctaccgaggtacgaacgggaaccaacgggtcaacgtagttcggacctatcgaggtggacgtccgaagggcgaaggacgggacggacggcgtaggtaacttagtttagttcgtacaattaccgaaacaacgaacctaaccgtaagtttacggttaactttagttacgttaccgttaaccggtaactcggtaacccgaacccgtaaacgggttccctaacccgggttccgtcggggtacccgaaccgtaccccggaaaccgggaccccaaacccccgtacgtcgtcccttaacccg

SEQ ID NO: 287011 - DNA, 558 bp, Homo sapiens
  misc_feature: GYAE6OF01BCBA9.49.62.F07.1.454.CMB.1.raw
  modified_base (244)..(244): a, c, t, g, unknown or other
  misc_feature (244)..(244): n is a, c, g, or t
  modified_base (297)..(297): a, c, t, g, unknown or other
  misc_feature (297)..(297): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctctggagatgcattgaccaaacgntatgtcttattggtaccagcagaagccggccaggccctgtgttggtgatgtanaaagacactgagacggccctgagggactcccgtgacgtcgacttctctggcctccgaggtcgaagggacaacggtcatagtcgcatcgagtggagtccgaggcaggaggacgaggctagacttattagttagtacaactacaacgagaccactattacggttacttattcgtctaacggtactcggtacctacgtaacgtcctaccggttcgtcgggtacaacggccccgaaacggccccaaacccgtctcgtacctaccg

SEQ ID NO: 287012 - DNA, 155 bp, Homo sapiens
  misc_feature: GYAE6OF01A6ED6.49.62.F07.1.454.CMB.1.raw
  modified_base (152)..(155): a, c, t, g, unknown or other
  misc_feature (152)..(155): n is a, c, g, or t
tcagagtcgagagacacgaccggtgctcgatttagtagtcgcataaagggaaagggtttagtagtccataaagggaaaggggctggccctgacgtgtttctgttcccgccctcctctctctcgactctgagcgggctggcaaggcgcatagnnnn

SEQ ID NO: 287013 - DNA, 810 bp, Homo sapiens
  misc_feature: GYAE6OF01D84GR.49.62.F07.1.454.CMB.1.raw
tcagagtcgagagacacgaccggtgctcgatttagtagtcgcataaagggaaaggggcgtgtgggtccaggaggcagaactctgggtgtctcaccactggcctggatccctctacttctccccctcctcactctctgcacaggctctgaggcctcctatgagctgacacagcccaccctggtgtcagtcgtccccgaggacagacggaccaggactccacctgctcgtacggagatgcattcgacccaaaacgatatgtcttagttcggtaccagacagaacggccggggaccacggccccgttgttcggtttggtagtagttagttaataaaacgactaacgtaggacggaacggtcccccgtgaacgggtaccttcccgtaggacggtcgtaacgtttccgtacgtcggtccgttaccggaacggtaccggaacgggaaccgtaaaccggtaccgtaacgtacgtttacggaccctaagttaccaggggttacggaacggttaccggaagggcccgaaagggtaaccgggaacgggaacggtcgttacggtaacttaagtttaacgtttcggtaaccgtaaacgttaccaaacgaaccgtaaacaaccccgtaagtttaccgggtttaaaccttttacgtacgtttaccggttaaccggttaaacctacgggtacccgtaaacccgtaaacgggttacccgtaaccccgggttaccccggttacggggttacccgaacccggtaacccccggtaaacggggaccccccaaaacccccccggtaccgttaaccggttacccgtaacccg

SEQ ID NO: 287014 - DNA, 566 bp, Homo sapiens
  misc_feature: GYAE6OF01CR6LJ.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccggcaggcccctgtgttggtgatgtataaagacactgagacggccctcgagggactccctgagcgtattctctggcctccgaggtcagggacaacggtcactattggaccatcgagtggagtccaggcagagggacgaggctaggacttagttattgtacaatacaacacgaactacctaagtttggtaactttagtgttccttacgggaaaccttgaccgtaccgtaacggtccgaaccgttcccgtgggtaccacgacccccgaaggaccccaaccccgtacgtcgtcctaacccg

SEQ ID NO: 287015 - DNA, 576 bp, Homo sapiens
  misc_feature: GYAE6OF01BWW5M.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaaccgatatgcttattggtaccagcagaagccgggccacggcccctggtcgttggtgatgtaataaagacactgagacggccctcgagggactccccgtgacgcgtattctcgtggcctaccgaggtcgagggacaacggtcactagttcggcctatcgaggtggagtccgaggcaaggaggacgaggctagactattatgtacaatcaacagaccacctagttggtactttagtcgttcttacggaactggaccgtaaccgtaaggtccgacccggtccgttcgggaccaaccggacccgtaaacggaccccaaacccctcgtccgtaccgtacccg

SEQ ID NO: 287016 - DNA, 638 bp, Homo sapiens
  misc_feature: GYAE6OF01AYMK5.49.62.F07.1.454.CMB.1.raw
  modified_base (212)..(212): a, c, t, g, unknown or other
  misc_feature (212)..(212): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggntcacctgctcgtggagatgcattcgaccaaaccgatatgcttattcggtaccagcaagaacggccgggccacggcccctgtggttggtgagttgtaataaacgactacgtaggaaggacggccctagacgggtactccccgtgacgcgtacttcctcgtcggcctaccgacggtacgacgggaccaaccggtcaacgtacgttcggacctatcgaggtacggacgtccgaaggacgaggaggacggaggctagtacgtatttacgttgtcacggtccgacaaggtacacggacgtagtcggacgttagttagtcggtacgttaggttccgggaagggtacgggtaaccgttacggtcgtaccggtacccgttccgtacggttacccgacggtaccccggaacggtcccgtcccggttaccccccgg

SEQ ID NO: 287017 - DNA, 591 bp, Homo sapiens
  misc_feature: GYAE6OF01D3V4N.49.62.F07.1.454.CMB.1.raw
  modified_base (243)..(243): a, c, t, g, unknown or other
  misc_feature (243)..(243): n is a, c, g, or t
  modified_base (333)..(333): a, c, t, g, unknown or other
  misc_feature (333)..(333): n is a, c, g, or t
  modified_base (344)..(344): a, c, t, g, unknown or other
  misc_feature (344)..(344): n is a, c, g, or t
  modified_base (453)..(453): a, c, t, g, unknown or other
  misc_feature (453)..(453): n is a, c, g, or t
  modified_base (575)..(575): a, c, t, g, unknown or other
  misc_feature (575)..(575): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgntaatgcttagttggtaccagcaagaagccggccaggcccctggtggttggtgatgtaataaagcactgagacggccctcgagggctccgngagcgattctntcggctccgaggtcaacgggacaaacggtcacgtagttcggcctatcgagtggacgtaccgaggacaaggaggacgaggctaggactagtttagtgtactaatacaaanacgaactacctaagtttaggttaactttagtcgttcttacggaactcggaccgtaaccgtaacggtcccgtacggttccgtacgggtcgaaacgtcccccgaaacgggaccccaaacccccncgttcgtcctaacccg

SEQ ID NO: 287018 - DNA, 646 bp, Homo sapiens
  misc_feature: GYAE6OF01DAIPA.49.62.F07.1.454.CMB.1.raw
  modified_base (182)..(182): a, c, t, g, unknown or other
  misc_feature (182)..(182): n is a, c, g, or t
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtntcagtgtccccaggacagacggccaggatcacctgctctgganatgcattcgaccaaaacgntatgcttatggtaccagcaaggaagccgggaccacggcccctggtgttggtgatgtaataaagacactggagcggccctagagggtactacccgtggacgtcgtatttcctcgtcggcctccgtagggtccgaaggggaacctaacgggtcaacgtagttcggaccctagtacgagtcgggacgtccgaggcaggacggacgaggctggacttagtattgtacaatacaacacgaactaaccgtagtttacggttacttagttcgttaccgttaaccgggaacttcggacccgtaaccgtaaacgggtccgtaaccccgggttccggttaccggggtacctaaccggacccccgtaaacgggtaccccccaaaccccgtaccgtcggttaccctaaccccgg

SEQ ID NO: 287019 - DNA, 739 bp, Homo sapiens
  misc_feature: GYAE6OF01CHNAN.49.62.F07.1.454.CMB.1.raw
  modified_base (243)..(243): a, c, t, g, unknown or other
  misc_feature (243)..(243): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagagccggccacggcccctgtgtggtgatgtataaagacacgtgagacggccctcgagggactcccgtgacgcggtatttccgtcgtcggtaccctccgtacgggttaccgaacggggtaaccgaaaccgggttaccaacgtacgtttaccggaccctaacgttccgtaggttcgggaacggttaccccgaggggtacgaacgggaaggggaaccggtacgggacgttacggtaactttaagtttaacgtttacgttaaccaattaaccgaaacgtaacgtaaccgtaacccttaacgtttacggttaaccgtttaagttcgttaccgtttaaccgggtacttacgggtacccggtaacccggttaaaccggttcccgtaccccggtttacccggtacggggttacccgaacccggtacccccgtaaacgggacccccctaaacccccgtaaccgttcccgttaccgttacccccgg

SEQ ID NO: 287020 - DNA, 593 bp, Homo sapiens
  misc_feature: GYAE6OF01CZ50Y.49.62.F07.1.454.CMB.1.raw
  modified_base (225)..(225): a, c, t, g, unknown or other
  misc_feature (225)..(225): n is a, c, g, or t
  modified_base (240)..(240): a, c, t, g, unknown or other
  misc_feature (240)..(240): n is a, c, g, or t
  modified_base (427)..(427): a, c, t, g, unknown or other
  misc_feature (427)..(427): n is a, c, g, or t
  modified_base (446)..(446): a, c, t, g, unknown or other
  misc_feature (446)..(446): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggantgcattgccaaacgntatgcttatggtaccagcagaacgccggccacggccctgtgttggtgatgtaataaagacactggagacggccctgagggactcccgtagagtcgtacgttctcgtcggcctccgacgggttcgagggaactaccgggtcacgtagttcggacagtcgaggtggacgtccgaggacgaggaggacgnggctggaacttattagttntacaataccaacacgacaactgttacgtacttagttcgttacgtacggtaactggtaccgaaccgtaacggtcctaacccggttccgtgggtaccctacggccccgaaaccggtaccccaaaccccgtacttccgtacccgtacccg

SEQ ID NO: 287021 - DNA, 718 bp, Homo sapiens
  misc_feature: GYAE6OF01BKNJD.49.62.F07.1.454.CMB.1.raw
  modified_base (234)..(234): a, c, t, g, unknown or other
  misc_feature (234)..(234): n is a, c, g, or t
  modified_base (253)..(253): a, c, t, g, unknown or other
  misc_feature (253)..(253): n is a, c, g, or t
tcagagtcgagagacacgaccggtgctcgatttagtagtcgcataaagggaaagggggctgtgggtccaggaggcagaactctggggtgtctcaccatggcctggatccctctacttctccccctcctcactctctgcacaggctctgaggcctcctatgagctgacacacgcccacccgtcggtgtcagtcgtccccgaggacaggaccggccaggactcacctgctgtgganatgacattcgaccaaacgntatgtactttagttacggtaccagacgaaggaacggccgggaccgacggtccccgttggttggttcggtgaagttagtaaagtaaacgactaacgtaggacggaccggtcccgtacgacgggtactcccgtaggacgtcgtacttccgtcgtcggtcctaccggtacggtacgaacgggtaccgtaaacggtaccgtacgtaacggttcggacctagttacggacggttacggtaccgtaccggtacgggaacggaagggaacgggacggaggtcgtacggttaacttaagtttacgttacgtacctaactaacaacgacgaaccgttacctaagtttacggttaactttagttacgttacggttacgaacgtcgaaccggtaaccgaacggttcccgtacggttaccggtcgtaccgaccggaacccgtaaccgacccctaacccgtcgtacgtcccttacccg

SEQ ID NO: 287022 - DNA, 625 bp, Homo sapiens
  misc_feature: GYAE6OF01ALKRX.49.62.F07.1.454.CMB.1.raw
  modified_base (244)..(244): a, c, t, g, unknown or other
  misc_feature (244)..(244): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaaccgntatgcttattggtaccagcagaacgccgggccacggcccctgtgttggtgatgtataaagacacgtgagacggccctgagggactcccgtgacgcgtattcgtcgtcggctccgaggtcaagggaccaacgggtcaacagttcggacctagtcgaggtggacgtccgaggcaggaggacgaggctagacttattagttagtactaataccgaactacgaacctaaccgtagtttacggtaactttagttacgttaccgttaccggaaacgttcggaccgtaacccgtaacgggtcccgtaccccgggttaccgtcggggttacccaaccggaccccgtaaaccgggacccccaaacccccgtacgttcgtccctaaccccg

SEQ ID NO: 287023 - DNA, 572 bp, Homo sapiens
  misc_feature: GYAE6OF01CMMN6.49.62.F07.1.454.CMB.1.raw
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (444)..(444): a, c, t, g, unknown or other
  misc_feature (444)..(444): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgganatgcattgaccaaaacgntatgcttattggtaccagcaagaagccggcacggcccctggtgttggtgatgtaataaagacactgagacggccctgagggactcccgtgagcgtattctctcggctccgaggtcgaacgggacaacggtcacacgttgaccatcgaggtggacgtcgaggcaggacggacgaggctagactattatgtacaataccaanacgacacctagttcgtacttatcgttactcggtactgtaccgacgtaaacggtcctaacccgtcggttcgggacctaccggaccccgaaacggacccccaaaccccgtaccttcgtacccgtaacccg

SEQ ID NO: 287024 - DNA, 697 bp, Homo sapiens
  misc_feature: GYAE6OF01A7UVT.49.62.F07.1.454.CMB.1.raw
  modified_base (211)..(211): a, c, t, g, unknown or other
  misc_feature (211)..(211): n is a, c, g, or t
  modified_base (227)..(227): a, c, t, g, unknown or other
  misc_feature (227)..(227): n is a, c, g, or t
  modified_base (248)..(248): a, c, t, g, unknown or other
  misc_feature (248)..(248): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacgccaggntccactgctcgtgganatgctagttcgaccaaaacgntagtcgtcttagttcgtaccagcaagaacgccggccacggccctgtcgttggtgtagtgtaataaacgactacgtaggacggacggcccgtacgaagggtacctcccgtaggacgacgtacttccgtcgtcggtcctccgacggtacgaacggaacgtaacggtacaacgtacggttcggacctagtcggtaggttacgggtacgtaccggaggtaccgaagggtaacggacggaggtactaggtaactttaagtttagttacgtaactaacgtaccaactacgaacctaaccgtaagtttacgttaactttagttacgttaccgttaacggtaaccgtacggtaccgtaaacccggtaaccggtcccgtaacccggttccggtcgggtaccaacccgggtaacccgaacccgggacccctaaaccccgcgttacccgtcgttaccccg

SEQ ID NO: 287025 - DNA, 693 bp, Homo sapiens
  misc_feature: GYAE6OF01C7WGH.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcacctgctcgtggagatgcattcgaccaaacgatatgtcttatggtaccagcaagacgccggcacggccctgtggttggtgagtgtaactaaagacacgtaggacgacggcctaggacggtactcccgtgacgtcgtacttcgtcgtcggtcctcgtaacggtacgaagggaaccgtaaccggtcgaacgtacggttcggaccctagtaccgtagggtcggacgtaccgacgggacgaagggaacggacgaggtcgtaggtaacttagttagtgtacaagtaccaaacgacgtaacctaccgtagtttacggttaaccttagttacggttacggttaaccgggaacttaccgggaacccgttaaaccgaaacgggttccccgtaacccgggttcccggtaccggggttacccgaacccgggtaacccccgtaaaccgggacccccgtaaaaccccctccggttaaccgtcccttaaccccgg

SEQ ID NO: 287026 - DNA, 589 bp, Homo sapiens
  misc_feature: GYAE6OF01BQYSH.49.62.F07.1.454.CMB.1.raw
  modified_base (243)..(243): a, c, t, g, unknown or other
  misc_feature (243)..(243): n is a, c, g, or t
  modified_base (576)..(576): a, c, t, g, unknown or other
  misc_feature (576)..(576): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgntatgcttattggtaccagcagaagccggcacggccctgtgttggtgatgtataaagacacgtgagacggccctacgagggactcccgtgagcgattcgtcgtggcctcgtaggtacgagggaactaacgggtcaacgtagtttcgggaccctaagtccgaggtcggacgtccgaggcgaaggacggacgaggactagacttattagtagtacaatacaacgtagaactacctaagttcggtaacttatcgtacgttacggaacgtcgacgtaaccgaaaggttccgaccgttccggtggtcctaacggacccgtaaacggacccaaaccccgntcgtcctaacccg

SEQ ID NO: 287027 - DNA, 646 bp, Homo sapiens
  misc_feature: GYAE6OF01CTMRA.49.62.F07.1.454.CMB.1.raw
  modified_base (246)..(246): a, c, t, g, unknown or other
  misc_feature (246)..(246): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgctattcgaccaaaacgntatgactttaagttggtaccagcaagaacggccgggccacggcccctgtggttggtgatgtaataaagcacgtgagcggcctagaggactccgtagacgcgtatttctcgtggcctcgaggtcgaaggacctacgggtcaacgtagttcggacctagtacgaggtggaacgtccgaaggtcgaacggaagggaacgcgggtctaggtaacctttaagtttacgtttagtactaaacttacaaacgaacgtaacctaacgttagtttacgggttaactttattcggttaccgtttacggaaccgttcggacccggtaaccgtaacggttacctacccggttcggtacgggtaccacggacccgtaaccgaccccgtaaccctacgtcgtcccgttaacccg

SEQ ID NO: 287028 - DNA, 614 bp, Homo sapiens
  misc_feature: GYAE6OF01B49CG.49.62.F07.1.454.CMB.1.raw
  modified_base (228)..(228): a, c, t, g, unknown or other
  misc_feature (228)..(228): n is a, c, g, or t
  modified_base (284)..(284): a, c, t, g, unknown or other
  misc_feature (284)..(284): n is a, c, g, or t
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
tcagagtcgagagacacgaccggtgctcgatttagtagtcgcataaaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtcccccaggacagacggccaggatcacctgctctgganatgcattgccaaacgatatgcttatggtaccagcagagccggccagccctgtgtgngatgtataaagcactgagacgccctcgacggactccgngacgcgattcncgtggcctcgaggtcgaagggaccacggtcactagttcggaccatcgagtggacgtccgagggcaaggaggacgaggctaggtacttaatttagttgtacaaattcaaactgaacctaccgtagtttacgggttaactttagttacggttactttacgggaacccttaggacccgtaaaccgtaacgggttcccgaacccgggttccgtacggggttacccaacccggtaccccgaaaccgggtaccccctaaaccccgtccgttcgtacccttaacccgg

SEQ ID NO: 287029 - DNA, 607 bp, Homo sapiens
  misc_feature: GYAE6OF01CE278.49.62.F07.1.454.CMB.1.raw
  modified_base (244)..(244): a, c, t, g, unknown or other
  misc_feature (244)..(244): n is a, c, g, or t
  modified_base (389)..(389): a, c, t, g, unknown or other
  misc_feature (389)..(389): n is a, c, g, or t
  modified_base (402)..(402): a, c, t, g, unknown or other
  misc_feature (402)..(402): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgntatgcttattggtaccagacaagaagccggggccacggcccctgttgtggtgagtgtaataaagacataggagacggccctcgaagggacttcccgtaggagccgtattcctcgtggctcgaggtcgaaggacacggtcaacgtnttcggctatacgngtggacgtaccgaggcaggagggaacgaggctagacttagtttatagtacaagtacaagacgtaaccacctagtttacggttaattagttacgttaccgttacggaaacgttcggaaccgtaacgtaacgggtcctaacccggttccgtagggtacccaacgaccccgtaacggaaccccctaaccccgacgtccgtcgtacccg

SEQ ID NO: 287030 - DNA, 739 bp, Homo sapiens
  misc_feature: GYAE6OF01CZS2U.49.62.F07.1.454.CMB.1.raw
  modified_base (244)..(244): a, c, t, g, unknown or other
  misc_feature (244)..(244): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgntagtgactttagtacggtaccagcaaggaacgccggccacggccctgtgttggtgatagtataaagacacgtgagacggccctcgagggtactcccgtaggagcgtacttcgtcgtcggcctaccgacggtacgacgggaacgtaacggttcaacgtacgtttcgggacctaagtaccgtaagggttacgggaccgtaccggagggtacgaacggggaacgggaaccgggacggtccgtaacggttaacgttaagttttacgttacggtaccaccggttacccggacgaaccggtaacgaaggtcccgtagggtacggtacgtttaaggtttacgttcggtttaccgggttaacggttacccgggggtacggggtaaaccgggttaccgttacccgggacccggttacgggtaacccccggtttaccggttacgggtaccccggtaaccggtaacccccggtaacgggtccccggttaccccgggtaccccccgg

SEQ ID NO: 287031 - DNA, 820 bp, Homo sapiens
  misc_feature: GYAE6OF01DJCZU.49.62.F07.1.454.CMB.1.raw
  modified_base (141)..(141): a, c, t, g, unknown or other
  misc_feature (141)..(141): n is a, c, g, or t
tcagagtcgagagacacgaccggtgctcgatttagtagtcgcataaagggaaagggggctgtgggtccaggaggcagaactctgggtgtctcaccatggcccgtgactcctctacttcctcccctctcactctctgcacgnggtcctcgtaggcggtccctacctatggacgtctcgaaccacgaccgacccctaccccgttgggtcgtacgacggttcccgtaccccgaaggacgaacgggacccggaccgaaggaccttacccaccgtcggtcccttcggtagggaatacgtgaccttagtaccgaaacccgaaaacgtattacgtgtacctttagttaccggtaccagtacgaacggaaccggcccggaccgacccggtcccgttggttcggttggtagtagttaagttaaagtaaaacgacgtacgtaggacggacccggtcccgtaacggaacgggtcccttaccgaggacgacgttacgttcgtcgtcggtacccttaccggtaacggtaccgggtaacggtaaaccgtaccggtaaccaacggttacgtcggtaacctacgttacggtagggtcgtaaccgtcggaacggacgacgggaaacgggacggtacggtactacggtaactttaagtttaggttactaaacgtaactaacgaaacgaaacgtaaccctaaacgtttaggttacggtttaaccttagttacggttaccgtaacggtacgtacgacccgtaacgtaccggtaccgtacccgtcggtacggtaccgaccgacccgtaacgaaccccctacctacgtccgtacccgtaccg

SEQ ID NO: 287032 - DNA, 752 bp, Homo sapiens
  misc_feature: GYAE6OF01DJ9MO.49.62.F07.1.454.CMB.1.raw
  modified_base (253)..(253): a, c, t, g, unknown or other
  misc_feature (253)..(253): n is a, c, g, or t
tcagagtcgagagacacgaccggtgctcgatttagtagtcgcataaagggaaagggggctgtgggtccaggaggcagaactctgggtgtctcaccatggcctggactccctctacttcctcccctcctcactctctgcacaggctctgacggcctctatgacgctgacacacgcccaccgtcggtgtcagtccgtacccgaggacacggaccggccgaaggactccaccgtcgctcgtaggagacgtcgactntacgaaccaaacgtatagtcgttactttacgttacggtaccacgacgaacggaaccggcccgggacccgtaacccggtcccgttgggttcggttttacgggtaggtaacgttaagtaaacgtaaaacggacctaacggtaggacggaccggtacccgtacggaacgggtacctacccgtaggacgtaccgttactttcgtccgtcggcctaccggtacggtaaccggaacgggtaaccaccgggtaccaacgttacgttaccgggactaacgtacggtaggtacggtaaccggtccggaagggaccggaaggaacgggacgacggttacgtacgttaacttaacgtttagttacgtaactaactacgaacgaaccgtactaaccgttagtttacggtactttacgtacgttacgtacggtacgtacgaccgaacgtacggtcctaccggtcggtacggccgaacgacccgaaccgaaccctaccacgtcgtcctacccg

SEQ ID NO: 287033 - DNA, 727 bp, Homo sapiens
  misc_feature: GYAE6OF01DJ56B.49.62.F07.1.454.CMB.1.raw
  modified_base (245)..(245): a, c, t, g, unknown or other
  misc_feature (245)..(245): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtatcagtcgtccccaggacagacggccaggatcacctgctctggagatgcattcgaccaaaacgntatgcttattggtaccagcagaacgccgggccacggtccccgtggttcggtttggtgtacgttaggtaaataaaagacgtaacgtaggaaggacggaccccttcgaacgggacttccccgtaggacgaccggtactttccgtcgtcgggtcctaccgtacgggtccgaacggggaaccgtaacgggtactaaccgtagttcggaccctagtcgtaaggtcggaacggtaccgagggacaagggaacgggaacggacggtctacgtaactttaagttatttacggtactaaacgtactaaacgaacgaacctaacccgttagtttacggttaactttaagttcggttaccgtttaacgggaaaccttcgggaaccgtaacccgtaacgggtccgtaaccccggttcccggttcggggtacccaaccgggaccccgtaaaccgggtaccccctaaaccccgaccgtttccgtaccttaaccccg

SEQ ID NO: 287034 - DNA, 896 bp, Homo sapiens
  misc_feature: GYAE6OF01CUB4F.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttcctccccctcctcactctctgcacaggctctgacggcctcctatgagctgacacacgcccaccctcggtgtcagtcgtccccaggacagacggccaggactcacctgcctcgtggagatgactagttcgaccaaaacgatatgtacttttagttacggtaaccagcgaacggaacggcccggggccgaaccggtccccgttggttggttgggtagtagttagtaataaacggactaacgtaggacggaccggtacccctacggaacgggtaccttaccccgtaggacgtaccgttacgttttccgtcgttcgggtacccgttaccggtaacgggttaccggaaacggggtaacccgtaaaccggggttaccaaccggttaacggtttaccgggacccttacgttaccggtaacggggttacggggaaccggttacccggaaacgggggaccgtaaggggaaacggggaaccgggtacgggtacccggttaacggtaaaccgttttaagttttaacggtttacggttaaacctaaacgttaacccgaaaaccgtaaccgttaaaccctaacccggtttaaagtttaccgggtttaaaccttttaggttaccgtttaccggtttaacggtaaaccgttccggtaacccgtaacccggtaaacgggttccccgtaacccggggtttccccggttacgggggtaacccctaacccgggaaccccccggtaaacccgaaccccccgtaacccccttaccggttcccgttaacccgttaacccccg

SEQ ID NO: 287035 - DNA, 753 bp, Homo sapiens
  misc_feature: GYAE6OF01A78VD.49.62.F07.1.454.CMB.1.raw
  modified_base (331)..(331): a, c, t, g, unknown or other
  misc_feature (331)..(331): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacgaggctctgaggcctctatgagctgacacacgcccacccgtcggtgtcagtcgtccccgaggacacggacggccaggactccgacctgctcgtggagatgactattcgaccaaaaccgtatatgtcttaattggtaaccagcagaacgccgggccacggcccctagtgttggtgtagtagtataaagacacngagacgccctacgagggactccgtagacgcgtacttcgtcgtacggtccgtaccgtacggtacggaacgggtaaccgaaccgggtacgtaaccgtagtttacgggaccctaagttacgtaacgggttacgggtaccgttacccgaaggggtaccgaacgggaaccggggaacggtaacgggtccgtaagggttaaccgttaagttttacgtttaacgttactaaacgttaccgaaacgtaaccgaaaccgtacccgtagtttaacgggtttaactttaagttcggttaccgtttacggaaccgttcggtaacccggtaaaccgtaacggttaccctacccggttacccggtcgggtaaccgtaccgggaaccccgtaaaccgggtaccccaaacccctaccgttccgttacccgtaaccccg

SEQ ID NO: 287036 - DNA, 612 bp, Homo sapiens
  misc_feature: GYAE6OF01BKQUX.49.62.F07.1.454.CMB.1.raw
  modified_base (223)..(223): a, c, t, g, unknown or other
  misc_feature (223)..(223): n is a, c, g, or t
  modified_base (244)..(244): a, c, t, g, unknown or other
  misc_feature (244)..(244): n is a, c, g, or t
tcagagtcgagagacacgaccggtgctcgatttagtagtcgcataaagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcactgctcgtgganatgactattcgaccaaaacgntatgcttatggtaccagacagaacgccggcacgccctgtgttggtgatgtaataagacacgtgagacggccctagagggacttcccgtagacgcgtacttcctcgtcgctaccgtaggtcgaagggaaccaacggtcaacgtagttcggacctagtacgaggtaggacgtacccgagggcgaacggacggacggtaggactaggtaacttagtttaagtcgtaactaataacctaagaccgtactaacctagttacggttaacttattacgtacgttaacgagttcgaccggaactaacggtcgtaccggtaccttgggaccaccggacccgacgaccccctaccgactacggactccgtccgtaccc

SEQ ID NO: 287037 - DNA, 741 bp, Homo sapiens
  misc_feature: GYAE6OF01DJ1UZ.49.62.F07.1.454.CMB.1.raw
tcagagtcgagagacacgaccggtgctcgatttagtagtcgcataaagggaaagggggtgggtccaggaggcagaactctgggtgtctcaccatggcctggatccctctacttctccccctctcactctctgcacaggctctgaggcctcctatgagctgacacagccacctcggtgtcagtctccccaggacagacggccaggatccaccgtgctcgtaggacgtatcgactagttcggaaccaaaccgtataagtggtacctttagttacggtaaccacgacgaacgaaacggcccgggacctaacggtccccgttggttcggttcggtacgtaagttacgttaaaagtaaaacgtaccgtaacgtacggaacgtaccggtacccgtacggaacgggtaacctcccggtaggacgtcgtaacgttcgtcgtcggtcctaccgaggtcgaacggtaacgtacggtacacgtagtacggactatcgagtcggtacgccggaggtcgaagggtacggacgtacggtactacgtaacgttagtttacgtacgtactaaacgtacgaaacgaccgtaactaacccgtagtttacgttaactttacgttcgttaccgttacggtaacgtccggtaacgtaccgttaacggacccgttaccggtaccgttggggaacctccggaacccgtaccggaacccctaaacccctaggttaccgtaccctaccgttccccgttaacccccg

SEQ ID NO: 287038 - DNA, 696 bp, Homo sapiens
  misc_feature: GYAE6OF01A0SNK.49.62.F07.1.454.CMB.1.raw
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
  modified_base (305)..(305): a, c, t, g, unknown or other
  misc_feature (305)..(305): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctcgnggagatgctattcgaccaaaccgntatgcttattggtaccagcagaacggccgggccacggcccctggtgttggtgatgtaanaaagacacgtaggacgacggccctgacgggtactcccgtagacgtacgtactttccgtcgtcggccgtaccgtacgggtaccggaacgggtaaccgtaaccggtacaacgtacgtttcggacctaatacggaggtcgggacgtaccggtaagggaccgaagggacgggaaccgtacggacgttacgtaacttaagttttaagtacgtaacgaacttaaccaacgaacgaacccttaacgttagtttaacggttaactttagttacggttacgttaacggtacgttaccggaaccgtaaccggtaacggttccccgaaccggttcggtacgggtaccaacccggaacccgaaaccccggtacccaaacccgtaccgtcgtacccttaacccg

SEQ ID NO: 287039 - DNA, 737 bp, Homo sapiens
  misc_feature: GYAE6OF01DKZ0N.49.62.F07.1.454.CMB.1.raw
  modified_base (270)..(270): a, c, t, g, unknown or other
  misc_feature (270)..(270): n is a, c, g, or t
tcagagtcgagagacacgaccggtgctcgatttagtagtcgcataaagggaaagggggctgtgggtccaggaggcagaactctgggtgtctcaccatggcctggatccctctacttcctccccctcctcactctctgcacaggctctgacggcctcctatgagctgacacacgcccacccgtcggtgtcagtccgtccccgaggacacggaccggccaggactccacctcgcttcgtagggagtagtgactacttcgaacccaaaccgtnttatcgtacttagttacggaccagacgaacggacggcccgggaccgtaccggtccccgttggttggttcggtagtagttagtaataaaacgacgtacgtacggaacggaccggtcccgtacggaacgggtacctcccgtaggacggtaccgtacgtttccgtcgtcggtacctacggtacggtaccgaacgggtaaccgtaaacccggtcgtaacgttacggtacggacctagtaccggtaggacggtacgtaccggacggacgaagggtaacggcggtaacggtcgagttaagttaacgtttatacgtaacaaactaccgaaacgacgtaaacctaccgttaagttttacggtaaccttaggttacgtttccgtaacggtacgtacggaccgtaaccggaacggtccccgtacggtccgtacgggccaccggaccccgaaccgacccaaccctcgttcgacctccc

SEQ ID NO: 287040 - DNA, 621 bp, Homo sapiens
  misc_feature: GYAE6OF01A0Q2Q.49.62.F07.1.454.CMB.1.raw
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
tcagagtcgagagacacgaccggtgctcgatttagtagtcgcataaagggaaaggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtgganatgcattgaccaaaacgntatgcttagttcgtaccagcagaacgccggccacggcccctgtcgttggtgatagtaataaagacactggacgacggcctgaggactccgtgacgcgtattcgtctcggcctcgaggtcgaaggacaaccggtcacgtagttcggacctatcgaggtggacgtcgaggcgaaggacggacgaggctagtacttagttagttacgtactaactacgaaacgacgaaccgtacctaagtttacggttaactttacgtacgttaccgttaccggtaacgttcggacccggtaaccgtaacgggtccctacccggttccgtccgggtaccaaccggaccccgaaccggacccctaaccccgacgttccgtacccgtacccg

SEQ ID NO: 287041 - DNA, 693 bp, Homo sapiens
  misc_feature: GYAE6OF01CEBHU.49.62.F07.1.454.CMB.1.raw
  modified_base (108)..(108): a, c, t, g, unknown or other
  misc_feature (108)..(108): n is a, c, g, or t
  modified_base (175)..(175): a, c, t, g, unknown or other
  misc_feature (175)..(175): n is a, c, g, or t
  modified_base (237)..(237): a, c, t, g, unknown or other
  misc_feature (237)..(237): n is a, c, g, or t
  modified_base (618)..(618): a, c, t, g, unknown or other
  misc_feature (618)..(618): n is a, c, g, or t
tcagagtcgagagacacgaccggtgctcgatttagtagtcgcataaagggaaagggggtgggtccaggaggcagaactctgggtgtctcaccatggcctggatccctntacttctccccctctcactctctgcacaggctctgagcctcctatgagctgacacagccacctggtntcagtcgtccccaggacagccggcaggatcacctgctcgtggagatgctattgaccaaacgntactgtacttagttcggaacagacaggaacggccgggccacggtcccgtggtggtggtcgagttagtaataaagacacgtgacggacggtacccctaggacgggactcccggtagacgaccgtatttcctcggtcgtaccttcccgaggtccgaacggggtaacaacggttcaactgtcggcagtcgagtaggacgtaccgaggtacgaggacggacggtaggacctagtacttagtttacgtataacgtaactaaccgaagaacgaactaaccgtaacgtttagggttaacctttagttacgttacgtttaacccggacttaccgggacgtaaacccggtaaacggttccgtacccgggttaccggttcggggtaacccncccgggttaaacccgaacccgggttaacccctaaccccgtacgttaccgtacccttcggtacccctttaccccgg

SEQ ID NO: 287042 - DNA, 820 bp, Homo sapiens
  misc_feature: GYAE6OF01AZOXU.49.62.F07.1.454.CMB.1.raw
  modified_base (232)..(232): a, c, t, g, unknown or other
  misc_feature (232)..(232): n is a, c, g, or t
  modified_base (790)..(790): a, c, t, g, unknown or other
  misc_feature (790)..(790): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagcccacccgtggtgtcagtcgtccccaggacaggaccggccaggactccacctgctcgtgganatgctattcgaccaaaccgtatagtcgtactttagttcggtaccagaccgaaggaacggccgggaccacggtccccttaggttcgttcgggtgtagttaggtaaactaaacgactacgtaggaacggaccggtcccgtaggaacgggtcctaccgtagacgtcggtactttccgtcgtcggtacctaccggtaggtaccgaacgggtaacctaaccgggtcaacggtacgttcggacctagtacgtagggtacggtacgtaccggaggcgaacgggtaacgggacggtacggtacgttacggtaacgtttaacgtttacggttacgtaacctaacgtaaccgtaacgtaaccgtaacccgtaaccgtttaaggttttaaccggttaaaccttttagttaccggttaccggtttaaccgggtaaacccgttaccgggtaacccggtaaacccggtaaccgggttaccccggtaaccccgggtttacccggtaacggggtacccccgtaaacccggtaacccccggtaaaacccggtacccccccttaaaacccccggtnttaaccccggttaccccgtttaacccccgg

SEQ ID NO: 287043 - DNA, 605 bp, Homo sapiens
  misc_feature: GYAE6OF01BOS0G.49.62.F07.1.454.CMB.1.raw
  modified_base (384)..(384): a, c, t, g, unknown or other
  misc_feature (384)..(384): n is a, c, g, or t
tcagagtcgagagacacgaccggtgctcgatttagtagtcgcataaagggaaagggggctgtgggtccaggaggcagaactctgggtgtctcaccatggcctggatccctctacttcctccccccctcactctctgcacaggctctgaggcctcctatgagctgacacagccaccctcggtgtcagtcgtcccaggacagacggccaggactcacctgctcgtggagatgcattcgaccaaacgtatatgacttattggtaccagcagaagccggcaggccctgtgttggtgatgtataacgacacgtgagcggccctgaggtactcccgtgacgtcgtattctacgtcgctcgaggtcgagggacaacgtcactagtcgctancgagtcggacgtccgaggacgtagacggacgaggcgtagtaacttattagttgtactaattaccaaagaacgaacgtaacctagtttacggttaactttacgttgttaccgttacggaccgttaggacccgtaacgtaaccggtccgtacccgtaccggttagggcccaacggtaccccaaacggccccgaaacccctagtcctaccgtaccttaccccgg

SEQ ID NO: 287044 - DNA, 608 bp, Homo sapiens
  misc_feature: GYAE6OF01DX66T.49.62.F07.1.454.CMB.1.raw
  modified_base (182)..(182): a, c, t, g, unknown or other
  misc_feature (182)..(182): n is a, c, g, or t
  modified_base (577)..(577): a, c, t, g, unknown or other
  misc_feature (577)..(577): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtntcagtcgtcccccaggacagacggccaggactcacctgctcgtggagatgctattcgaccaaaccgatatgtacttattggtaccagcagacgccggaccacggcccctggtgttcggtagtagtacgtaagtaaacgacgtacgtgaggaccggacccctacggacgggtactccccgtaggacggtacgtactttccgtcgtcggtcctccgaggtaccgaacgggaactacggtcacgtagttcggactagtcgtagtcggacgtccgagacgaggaggacgaggctagtactagttattcgtactaactacaacacgaactaccgtagttacgtacttgtacgttacgtacgactcgacgtaccgtacggtcctaccgttcgtcggtaccncgaccgacggacccaaccctctcgtcctacc

SEQ ID NO: 287045 - DNA, 945 bp, Homo sapiens
  misc_feature: GYAE6OF01DL2GX.49.62.F07.1.454.CMB.1.raw
  modified_base (169)..(169): a, c, t, g, unknown or other
  misc_feature (169)..(169): n is a, c, g, or t
  modified_base (259)..(259): a, c, t, g, unknown or other
  misc_feature (259)..(259): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacngcccacccgtcggtgtcaggtctccccgaggacaggacggccaggactccacctgcctcgtggagatcgctaattcggaccaaaaccgtnttacgtgtacgtttacgttcggtaacccagacgaacggaaccggcccgggtaccgaccggtccccgttggttcggttgggtagtaacgttaggttaaacgtaaaacggtacctacgttacggaacggtaccggtacccgttacggaacgggtaccttcccgtaggacggtaccgttactttccgtacggttccggacctttcccggaacgggtaccggtaaacggggaacccgtaaacggttaaccgtaacggttacggtttaccggacccgttaacgttacggtaacgggtacgggtaaccgtacccggaaaggggtacccgaaggggaaccgggtaaccggtacggggtaaccgttacggtttaaaccgttttaaaggtttaacgtttaccggtaaaccgttaaacgtaacccgttaaacgaacccgtaaacccgttaaccgttaacggtttttaaccgggtttaaacccttttaagggtttacccggtttaccggtttaaaccgggtaaccggttacccgggtaaacccgttaaacccgggtaacccggggtttacccgttaacccccggggttttccggttaacccggggtaacccctaaccccgggtaaacccccggtaacccggttaacccccccgtaaaccccgtaccgtttaccccgggttacccctttaacccccgg

SEQ ID NO: 287046 - DNA, 630 bp, Homo sapiens
  misc_feature: GYAE6OF01BWDX8.49.62.F07.1.454.CMB.1.raw
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgaccacagcccaccctcggtgtcagtcgtcccccaggacagacggccaggatcacctgctcgtgganatgctattcgccaaaaccgntatgtcttattcggtaccagcaagaacgccggaccacggcccctgtcgttggtgatgtaataaagacactgagacggccctgaagggtactcccgtgacgcgtattcctcgtcggctccgaggtcgaagggacaacggtcacattcggcctatcgagtggacgtcgaggcaaggaggacgaggcgtagtacttatttattagtacaattccaaacacgtaacctaaccgtagtttacggttaactttagttacgttcgttaacggtactcggtaccgaaaccgtaacggtaccgtaacccggtccggttcggggttacccaaccggtacccccgaaacgggaccccctaaaacccccgtacgttccgtcccttaaccccg

SEQ ID NO: 287047 - DNA, 673 bp, Homo sapiens
  misc_feature: GYAE6OF01BP1JQ.49.62.F07.1.454.CMB.1.raw
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
tcagagtcgagagacacgaccggtgctcgatttagtagtcgcataaaagggaaagggggctgtgggtccaggaggcagaactctgggtgtctcaccatggcctggatccctctacttctccccctcctcactctctgcacaggctctgaggcctcctatgagctgacacacgcccaccctcggtgtcagtcgtccccaggacagacggccaggatcacctgctcgtgganatgctattcgaccaaacgntatgtcttattggtaccagcagaacgccggccgacggccctgtgttggtgatagtaagtaacgacagtacggagacggccctgagggctccgtaggacgcgtattcgtcgtcggtccgtaccgtaggacgtaagggaaccgtaaccggtcaacgtacgttcggacctaagtccgtaggttcgggaacgtcccggaggacgaagggaacgggaacgaccgggactaggtaacttaacgtttacgtcgtacctcggtaccgacgacgtacgacggacgtaggttcggacttaacggtttgtaccggttacggttagttaccggggaggggtaaccgggtcctttacggccggttcggacccccggtttcgtacgggtaccctacggaacccccgtaacgggtcccgtaccccggttaccccccggg

SEQ ID NO: 287048 - DNA, 749 bp, Homo sapiens
  misc_feature: GYAE6OF01C21GX.49.62.F07.1.454.CMB.1.raw
  modified_base (111)..(111): a, c, t, g, unknown or other
  misc_feature (111)..(111): n is a, c, g, or t
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
tcagagtcgagagacacgaccggtgctcgatttagtagtcgcataaagggaaagggggctgtgggtccaggaggcagaactctgggtgtctcaccatggcctggatccctntacttcctccccctcctcactctctgcacaggctctgacggcctcctatgagctgaccacagcccaccctggtgtcagtcgtcccaggacagacggccaggatccgacctgccttcgtggagatgctagttcgaccaaacgtntangtacgttagtacggtaccagcgaaggaacggccggccgaccggtccccttggttcggttggtagtacgttagtaataaacggacgtaaccgtaggacggtaccggtacccgtacgaacggggaccttaccggtaggacgtacgtactttccgttcgtcggtcccgtacgaacgggttaccggaacgggtaaccgtaccggtacaaccgtagttcggacctacgttaggacgggtggtacgtaccgagggtacgaagggaacgggaaccgggagtccggttaagtaaccgtttaagttacgtttacgtaactaactaacgtaactaaccggtaacacccgtttaagttccggttaacgtttattaccgggttacgttacggttaaaccgtcggaaccgtaaccgtaacggtcccgtaacccggtacggtgggttacccaaccggacccggtaaacccacccccgtaacccttacggtccgttacccgtacccg

SEQ ID NO: 287049 - DNA, 624 bp, Homo sapiens
  misc_feature: GYAE6OF01BBTPT.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgctattcgaccaaaccgatatgtacttattcggtaccagcaagaacggccgggaccacggcccctgtcggttggtgattagtaataaacgactacgtgagacggccctagacgggactcccgtagacgcgtacttcgtcgtcggctccgtaggtacgacggaacgtacggtacacgtagtacggccaacgtcgaggttacggacgtaccgagggaccaagggacggaaggacggctagtaacttatttagtagtactaataccaacgacgaacctacgtagttacgttaacttagttcgtacgttacgaagtcgtaccgaaccgtaacggtccctacgtccggtcggtaccacgaaccccgaacggaccccaaacccgtcttcgacccgtacccg

SEQ ID NO: 287050 - DNA, 559 bp, Homo sapiens
  misc_feature: GYAE6OF01AMZI7.49.62.F07.1.454.CMB.1.raw
  modified_base (547)..(547): a, c, t, g, unknown or other
  misc_feature (547)..(547): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgatatgcttattggtaccagcagaagccggccaggcccctgtgttggtgatgtataaagacactgagacggccctgagggactcccgtgagcgacttctcgtggcctcgaggtcgagggacaacggtcactagttggccatcgaggtggacgtacgaggcaggacggacggaggctagacttattattgtacaatacaacgagaccactagttcggttaacttagttacgttacgttacggaactggaccgtaaccgaacggtcctaccggttcgtcgggtaccacgacccgaacgcccaacccnctcgtcctaccg

SEQ ID NO: 287051 - DNA, 682 bp, Homo sapiens
  misc_feature: GYAE6OF01C9IFS.49.62.F07.1.454.CMB.1.raw
  modified_base (173)..(173): a, c, t, g, unknown or other
  misc_feature (173)..(173): n is a, c, g, or t
  modified_base (189)..(189): a, c, t, g, unknown or other
  misc_feature (189)..(189): n is a, c, g, or t
  modified_base (392)..(392): a, c, t, g, unknown or other
  misc_feature (392)..(392): n is a, c, g, or t
  modified_base (420)..(420): a, c, t, g, unknown or other
  misc_feature (420)..(420): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctcgcacaggctctgacggtccctctatgagctagacacncgcccacccgtcggtntcagtccgtccaggacaggcgacagactcacctgctcgtggatatcgactagtacgaaccaaagactaattagtcgtacttacgtacggaacagacgaagaccgaccgacggaccgtaccggtcccgttagttactagtaacttacttaaatttaacgtaaacggttcttacggacggtaccggtcctacgggaccggtaccnggacgtctacttcgtcgtcgctacgacnctacgacgacgtaaaccacggtctacgtaccgtacaccgtagtaggtcgggtacggacgggtcgaacggacggtaacgggacgacgtccgtaatactttacgttacgtctaacgtagtactagaccgaagtaaccgtggtacgtcgttactccgtttagttacggtggttaccgggtaggaccgggtaacgaccgtacgtccgggttaccgaacgggttccgtaaaccggactaccggaacccggttcgcccggtaccccgg

SEQ ID NO: 287052 - DNA, 745 bp, Homo sapiens
  misc_feature: GYAE6OF01CG8BP.49.62.F07.1.454.CMB.1.raw
  modified_base (249)..(249): a, c, t, g, unknown or other
  misc_feature (249)..(249): n is a, c, g, or t
tcagagtcgagagacacgaccggtgctcgatttagtagtcgcataaagggaaagggggctgtgggtccaggaggcagaactctgggtgtctcaccatggcctggatccctctacttctcccctctcactctctgcacaggctctgaggcctcctatgagctgacacagcccacccgtcggtgtcagtcgtccccagggacaggacggcaggactccacctgctctggagatgctattcgacccaaacgntatcgtactttagttcgtacagacgaagaacggccgggaccgacggccccgttggtcggttgggtagtagttaggtaagtaaaacgactacgtaggaacggtacggaccccgtcggacgggtacctcccggtaggacgtcggttaacttccgttacggtcggtccgttaccggacgggtacggtaacgggaaccgtaacggtaccgtaacgtacggttacggaccgtaagtcgtaagggtcggaccggtacggaacgggacgtaacgggaacgggacggtacggtacgtacggttaacttaagtttaacgtttacggaactaacgtaccgaaacgtaacgaacccgttaacgttaacgtttaggttactttacggttacgtaccgttaacggtaacgtcggaaacccgtagaaccgggttcctaccggttaccggtacgggttaccgacccgtacccggtaacgacccctaaacccgcttacggtcccgtaacccg

SEQ ID NO: 287053 - DNA, 746 bp, Homo sapiens
  misc_feature: GYAE6OF01C9YDW.49.62.F07.1.454.CMB.1.raw
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
tcagagtcgagagacacgaccggtgctcgatttagtagtcgcataaaagggaaagggggctgtgggtccaggaggcagaactctgggtgtctcaccatggcctggatccctctacttctccccctcctcactcctctgcacaggctctgacgcctcctatgagctgacacagcccaccctcggtgtcagtcgtcccaggacagacggccaggactcactgctcgtaggagntgctagttcgaccaaacgntagtgtacttagttcgtaccagacaggaacgccgggccacggtcccctggtggtttggtagtagtagtaataaagacagtggacgacggtccctgacggtcctaccgtgacgtcgtacttccgtcgtcgtccgttaccgaggtaccggacggtaaccgacggttaccaacgtacgtttaccgggacctagtacgtacggtagggtaaccgttccggaagggaccggaaggacgggaaccggtaggtccgtaaggttaaccgtttaagtttaacgtttacggtaactaaacgttaaccgaaaacgttaaccgaaccgttaaccgttaaggttttaccggttaactttaggtttacgttaccggttaacggttaaccgtacggaacccgttaaccgaacgggtttcccacccgggtttaccggttcggtaacccggacccggtaccccgtaaacccggtacccccgtaacccgtaccgtccggttacccttaccccgg

SEQ ID NO: 287054 - DNA, 803 bp, Homo sapiens
  misc_feature: GYAE6OF01CT2ZF.49.62.F07.1.454.CMB.1.raw
  modified_base (255)..(255): a, c, t, g, unknown or other
  misc_feature (255)..(255): n is a, c, g, or t
tcagagtcgagagacacgaccggtgctcgatttagtagtcgcataaagggaaagggggctgtgggtccaggaggcagaactctgggtgtctcaccatggcctggatccctctacttcctccccctcctcactctctgcacaggctctgacggcctcctatgagctgacacacgcccaccctcggtgtcagtcgtccccaggacagaccggccaggactcacctgctcgtggagatgctattacgacccaaaacgntagtgtactttagttcgtaaccagacgaaggaacggcccgggaccgaccggtccctggttcggttggtacgtaagttagtaataaacgactacgtaggagaccggtcccgtacggaacgggtacctcccgagtacggtcgtactttccgtcgtcggtccgtaccggtacggtaccggaacgggtaaccgaacggtaccaacggttacgtttaccggacccttagacggtaagggttcgggaaccgttaccggaacgggacggaacggggtaaacggaacgggacggtacgtaacgtaacgtttatttaagtttacgtaacctaaacgttaccgaaacgtaaccgaacccttaacgttacgtttaggttaaccctttaagttacgttacccgtttaacggtaaccgttccgggtaaccggtaaaccccgtaacgggtttccccgaccggtttaccccggttccggggaaccccgtaaacccggaacccccggtaaaacccgggaacccccaacccccggttaacgtccccgttaacccttaacccccgg

SEQ ID NO: 287055 - DNA, 828 bp, Homo sapiens
  misc_feature: GYAE6OF01A9CE6.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagcctgacacgagcccacccgtcggtgtccaggttccgtacccccaaggaccacggaccggccacgggactccaccgtgcctcgtagggacgactcgaccgtagttcggaaccctaaaaccggtattaagtcggtactttaaggttacgggtaccgaagaccgaaggaaccggcccgggaccgtaccggccccgttggttcggttgggtaggtacgttaggtttaaagtaaaaccggacgtacgtaggacggtaccggtaccccgtacgggtaaccgggtaccttccgtacggaacggtacgttacgtttccggtcgttcggtccctacggtaacggtacggaacgggaaccgtaacggtacgaacgtacgttcggaccgtacgttacgaggttacggacgttaccgaaggggtacacgggtaacgggaaccgggtaggtaccgtaacgttaactttaagtttacgtttacggtaaacgtaacgttaaccaaacgaccggttaaaccctacggtttaaacgtttacgggtttaacctttagttacggtttacccgttaaccggaaacgttccgggaccttaaacccgggttacgttacccgtacccggtcggtacgtacccgaacccgttacccgacggtaaccccgtaccctacgtcgtccgtacccg

SEQ ID NO: 287056 - DNA, 626 bp, Homo sapiens
  misc_feature: GYAE6OF01BRGH1.49.62.F07.1.454.CMB.1.raw
  modified_base (246)..(246): a, c, t, g, unknown or other
  misc_feature (246)..(246): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaaccgntatgtcttattggtaccagcttttaagaacgccgggccgacggccccgtgtgttggtgatagtaataaagacactagagacggcccgtcgagggactcccgtgagcgtattctcgtcggcctaccgacggtcgaagggaaccgaacggtacgtaactagttcggaccacgtacgtaggtcggacgtccgaggacgaaggaaggacggaggcgtagactattattgtactaatacaacgaagaaccgacctagttagttactttagttcgttacgttaacggtaacgtacgtaccgaaccgtaacggtacgtacccggtacggtcgggtaccgtaaccgacccgtaaccggacccaaacccctaccgtacgtccgtacccg

SEQ ID NO: 287057 - DNA, 699 bp, Homo sapiens
  misc_feature: GYAE6OF01B0MW8.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacacgacggccaggactcacctgctcgtggagatgctattcgaccaaacgatatgtacttattcggtaaccagacgaagaacggccggggtaccacggtcccctggtcggttggtcgtaagttagtaaataaacggactaacgtggacgacggccctaggacgggactacccgtaggacggacgttacttccgtacgtcggtcctaccgacgggtacgaacgggtaacgaacggtcaactagtcgggacacgtacgaggtacggactacggagggcaaggaggaacggaggctaggtaaacttgttagttacgacttaagtaaccaacgaacgtaacctaacgttaacgtttacggtaacctttagttacgtccgttaacggaaccgttagggacccgttaaaccaacggggttacccacccggttaccggttcggaaccggtaacccgaccccgtaaacggaccccctaaaccccgtcgttaaccgtcccgttaaccccg

SEQ ID NO: 287058 - DNA, 670 bp, Homo sapiens
  misc_feature: GYAE6OF01BDX2O.49.62.F07.1.454.CMB.1.raw
  modified_base (228)..(228): a, c, t, g, unknown or other
  misc_feature (228)..(228): n is a, c, g, or t
  modified_base (310)..(310): a, c, t, g, unknown or other
  misc_feature (310)..(310): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagcccacccgtcggtgtcagtcgtccccaggacagacggccaggatcacctgctctgganatgcattcgaccaaaccgatatgtcttagttcggtaccagcaaggaacgccgggccacggccctggtgttggtgtatgtaanaagacacgtggaggcgcctagacggactccgtagacgcgtattccgtcgtcggtccctacggacggtacgaacgggaaccgtaacgggtacaacgtagttacggacctagtacgtagggtcggtacgtaccgagggacgaagggaacgggacggacggtctaggtaacttagtttacgttacgtaactaactacaaacgtaaccgaactaacctagtttacggttaactttacgttcgttaccgttaacggacgttacggaccgtaaccgtaccggtacccgttaccggttcccggtacggacccgaaccggaccccgaaaccggtacccccaaaccccgtcgtccgtaacccgttcccg

SEQ ID NO: 287059 - DNA, 892 bp, Homo sapiens
  misc_feature: GYAE6OF01AC7ME.49.62.F07.1.454.CMB.1.raw
tcagagtcgagagacacgaccggtgctcgatttagtagtcgcataaaggggaaagggggctgtgggtccaggaggcagaactctgggtgtctcaccatggcctggatccctctacttcctccccctcctcactctctgcacaggctctggacgcctcctatgagctacgacacagccctaccgtcggtagtcacggttccgtaccccgaagggaccacggtccggaccgaaggacttaccaccttcgccgttacgtagggaacgtagttcgaccgttaacgttaccggaaacccgtaaaaccggttacttaacgttcgttaaccgttttacggtttaccgggttaacccgtaaggaccggtaaaacggggacccggggaccccggggtaaccccgtaaccccggggttcccccgttggggttttacgggtttaccggggttagttaaaggtttaacggtaaacgtaaacgtaacccggtacggtaacggtaacggggtacccggtaccccgtacgggtaacggtaacgttcccggtacggaccggtacgttacctttccgtccggtccgtacccgtaccggtagggaccggtacgggtaaccgtaaccggtacgtaacggtcgtaccggacttaacgtcggtacggttacggacgttaccgaggtcgaaacgggaggaccgggtagtacgtaacgttactttacgttttagtcgttaacctaagtaccaagtaaccgaaccttacgtttacgttaagttaacttcgttaccggttactaccgggtaagtacccggtacgaaaccgttaccggtcggttacccgggtcgtcgggtaccccgacggtacccccgaacccgtacccaaccggtttccaccgttcccttacccggg

SEQ ID NO: 287060 - DNA, 916 bp, Homo sapiens
  misc_feature: GYAE6OF01CN9QK.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccacccgtcggtgtcagtcgtccccaggacagaccggccaggactcacctgctcgtggagatgctattcgacccaaaccgattagtgtctttaacgttacggtaacccaggtacgaaacgggaaacggcccggggacccgacgggtcccccgttgggttcgggttggggttaggtaagtttacggttaaagtaaaaacggtaccgtaacgtagggaacggtaaccgggtaccccccgttaggaaacggggtaccttaccccgtagggaacggttaccgttagttttacccgttcggttacgggtacccttaccggtaacgggttaccggaaacgggggtaaccgtaaaccgggttaccgaaaccgtttacggtttaccgggacctaacgttaaccgggtaacgggtttacgggaaccgttacccggaaggggtaaccggaacgggaaacggggaaccggtacgggggtcctaagggttaaacctttaagttttcgtttaacggaaccttaaacgtaaccgtaaaaccgtaaccggaacccttaaacccggttaaggtttttaccgggttaacctttaggttacggttttaccgttaaaccgggtaaaccgttcgggaaacccgtacccggtaaaacgggttacccctacccggggtttaccgtacccgggggttaaccaacccggtaaccccggtaaacccgggtaaccccccaaccccgtacgttaccggttacccttaccccgg

SEQ ID NO: 287061 - DNA, 574 bp, Homo sapiens
  misc_feature: GYAE6OF01EOG12.49.62.F07.1.454.CMB.1.raw
  modified_base (333)..(333): a, c, t, g, unknown or other
  misc_feature (333)..(333): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtaataaaggacacgtgagacggccctagagggactcccgngagcgattctcgtgcctccgaggtcgagggacaacggtcacgagtcggaccagtcgagtgggacgtccgagggcaggaggacgaggctagactattagttagacaatacaacacgaactaccagttaggttacttagttcgtacgttacggaactcggacgtaaccgaaggtccacggttaccgcgggtacctaccggacccgtaacgggaccccaaacccccgtactcgtcccttacccg

SEQ ID NO: 287062 - DNA, 617 bp, Homo sapiens
  misc_feature: GYAE6OF01A86QS.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcattcgaccaaaccgatatgtcttattcggtaccagcagaacgccggccgaggcccctggtgttgggtgagtgtaataaagactacgtgaggacggcccgtacgagggtactcccgtgacgcgtacttctcgtggcctacgaggtcgaaggacaacggtcacagttcggactagtcgagtggacgtccgaggacaggaggacgaggtctacgtaacttatttagttagtactaactacgaaacgtacgaacctaccgtatttacggttactttacgttcgttaccgttacggaaacgttcgaccgtaaccgtaacggtccttacccggtccggttacgggtaccacggaccccgaacgacccccaacccgtacgtcgtcctaccccg

SEQ ID NO: 287063 - DNA, 667 bp, Homo sapiens
  misc_feature: GYAE6OF01DPYY2.49.62.F07.1.454.CMB.1.raw
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
  modified_base (303)..(303): a, c, t, g, unknown or other
  misc_feature (303)..(303): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgagcctctatgagctgacacagccaccctcggtgtcagtcgtacccaggacacgacggccaggactcacctgctctgganatcgctagttcgaaccaaaacgntactgtactttagtacggtaccagacaagaacgccggcacgccctgtgttcggntatagtaataagcactgagcgtcctagacgggtctaccgtgacgacgtacttccgtacgtcggtaccctaccgtaggtaccgaacggaaccgtaacgggtacacgtaagttcggacctagtaccgtaggtcggaacgtccgaaggtacgaggaacggacgcggtctagtaactttagttacgttcgaactaataccaacgtaacgtaccgtaaccttagtttacggttaacttacgttacggttacgttaaccggaacgttacggaccgtaaaccgttacggtaccctaaccggttccgtaggggtaccccaacggaaccccgtaaccggaaccctaaccccgtacgttcgtcccgtaaacccg

SEQ ID NO: 287064 - DNA, 759 bp, Homo sapiens
  misc_feature: GYAE6OF01CYIJK.49.62.F07.1.454.CMB.1.raw
  modified_base (157)..(157): a, c, t, g, unknown or other
  misc_feature (157)..(157): n is a, c, g, or t
  modified_base (178)..(178): a, c, t, g, unknown or other
  misc_feature (178)..(178): n is a, c, g, or t
  modified_base (257)..(257): a, c, t, g, unknown or other
  misc_feature (257)..(257): n is a, c, g, or t
  modified_base (569)..(569): a, c, t, g, unknown or other
  misc_feature (569)..(569): n is a, c, g, or t
tcagagtcgagagacacgaccggtgctcgatttagtagtcgcataaagggaagggggctgtgggtccaggaggcagaactctgggtgtctcaccatggcctggatccctctacttctcccctctcactctctgcacaggctctgacgcctctatganctgacacagcccaccgtggtntcagtcgtcccaggacaggaccggcaggatccacctggcttcgtaggacgatcggacctaattcgaaccctaaacggtnttacgtacgtacgttagttacggtaccgagaccgaaggaaccggcccgggaccgtaccggtcccgttaggttcggtttaggtacgtaacgttaggtaactaaacggtaccacgttaggaacggtaccggtacccgtacggaacggtaccgtacccgtaggtacgtaccggttacttccggtaccggttaccggaccttaccgggtaggtaccggaacggtaccgtaaacgtacgtacgtacggttaccgacgtaacgtacggtacgggttacgaccggttaccgaggacggaacggtacgggacgtacggtntaccgtaagttaagttacttacggtaacactacgtaaccgagtaaccgtacgttaagttacgttaacttggttacccttacggtaacgaaccggtcgtaacccgtacggttaaccgtccgtaaccggttccggtacggacccgtaccgacccgtaaccggtacccacccggtacgttcctcccgtacccg

SEQ ID NO: 287065 - DNA, 906 bp, Homo sapiens
  misc_feature: GYAE6OF01DKT0W.49.62.F07.1.454.CMB.1.raw
  modified_base (141)..(141): a, c, t, g, unknown or other
  misc_feature (141)..(141): n is a, c, g, or t
  modified_base (262)..(262): a, c, t, g, unknown or other
  misc_feature (262)..(262): n is a, c, g, or t
tcagagtcgagagacacgaccggtgctcgatttagtagtcgcataaagggaaagggggctgtgggtccaggaggcagaactctgggtgtctcaccatggcctggatccctctacttcctccccctcctcactctctgcacnggctctgacgcctcctatgagctgacacacgccacccgtcggtgtacagtccgtcccgaggaccaggaccggccaaggactccacctgctacgtcggagatcgctagttcgacccaaacgnttatgtacttattacggtaccgagccgaaggacggcccggaccgaccggtccccgtggtaggttggtgtaagttagtaagtaaacggacacgtagacggaccggtacccgacggtacggtacctccgtacggacggttaccggttacttttaccgtacggttccggtacccgttaccggtaacggggttaccggaacggggttaaaccgaacccggggttaacctaacggttaaacggtttccgggaacccgtaggtttaccggaacggggtttacgggttaacccggttaccccggggaacgggtaacccggaagggggaaaaccggggtaaccggtaaccggggttaccgtaaccggtttaaaccgttttaaagttttaaccgggtttacgttaaaccctaaaccgttaaccttaaaacggaaccgttaacccgtaaacccgtttaggtttaacccgggttttaaactttaagttacccggtttacggttaaccggttaaccgttaccgggtaccggaaaaccccgtttaacggggtccccgttaacccgggttaccggttcccgggaaccgtaaccccgttaaacccgggaaccctaaccccccgtaaacccgttaccgttaccccgtcgttaaacccccg

SEQ ID NO: 287066 - DNA, 666 bp, Homo sapiens
  misc_feature: GYAE6OF01BQKXA.49.62.F07.1.454.CMB.1.raw
  modified_base (254)..(254): a, c, t, g, unknown or other
  misc_feature (254)..(254): n is a, c, g, or t
tcagagtcgagagacacgaccggtgctcgatttagtagtcgcataaaagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgcctctggagatgctagttcgacccaaaaccgtntatgctttagttcggtaaccagcaaggaacgcccgggaccgacggtccccctggttcggttgggtgtacgttaggtaataaaacggactaacgtacggaacggaccggcccccgttacggacggggtactccccgtggacgtcgtacttccgtcgtcggtcctaccgaggtcgacgggaaccgtaacgtcaacgtacgttcggacctagtcgtaaggtcggacgtccgaggtcgaggacggacgagcgtagtacttattacgtgtacaactacaacacgacactagtttacggtaactttagtcgttacttacggaactcgtaccgtaacgtacggtccgtaacccgttcggtcggtaccaaccggacccgaaacggtacccccaaaccccgtcgttccgtacccgtacccg

SEQ ID NO: 287067 - DNA, 711 bp, Homo sapiens
  misc_feature: GYAE6OF01AQYEH.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacacgcccaccctcggtgtcagtcgtccccaggacagacggccaggactcacctgctcgtggagtatcgactagttcgacccaaaccgtatagtcgactttagttcggtaccagacaagaacggcccggggcccacggccccgtaggtcgttggtgtattagtaataaacgacgtacgtggaagtacggccctacgaacgggtactcccgtaggacgcgtacttccgtcgtcgccgtacgacggtacgaacgggaactaacccggtacaaccgtacgttcggacctagtacggtaggtacggtacgtaccgagggtacgaacgggacgggtaacggacggtcgtaaggtaacttagtttaacgttcgtactaaataccaaacgacgtaaccgacttacgtttagttaaccttagttcggttacgtaccggttaacgccggtaaccggaaacccgtaacgggtcccgtaacccggttcggtaccgggtaccgtaacccggaccccgtaaccggaccccctaaacccgccgttacgtccttaccccg

SEQ ID NO: 287068 - DNA, 596 bp, Homo sapiens
  misc_feature: GYAE6OF01ARWSA.49.62.F07.1.454.CMB.1.raw
  modified_base (380)..(380): a, c, t, g, unknown or other
  misc_feature (380)..(380): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagaccggccaggactcacctgcctcgtggacatgctattcgaccaaaaccgatatgtcttagttcggtaccagtcaaggaacggccgggccgacggcccccttggttcgttgggtgagtagttaataaagactacgtagacggacgcccgtagacgggtactcccgtagacgctatctcgngcctcgaggtcgaggactaacggtcatcgtgcctagtcaggtggtacgtccgaggcaaggacggtacgtaggctagtaacttattacgtagactaataccaagacgacaccgtagttacgtacttagtcgttacgtacgactcgaccgacgtacgtccgaccgttcggtcgtaccgacgacccgacggacccctaacccgcgtccgtccgtacccg

SEQ ID NO: 287069 - DNA, 682 bp, Homo sapiens
  misc_feature: GYAE6OF01CSLA5.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttcctccccctcctcactctctgcacaggctctgaggcctcctatgagctgacacagcccaccctcggtgtcagtcgtcccccaggacacggaccggccaggactccacctgcctcgtggagatgctattcgaccaaacgatatgtcttagttacgtaccagcagaacgccggccacggccctggtgttggtgatagtaataaacgactacgtaggacggacggccctacgacgggtctcccgtaggacgtcgtacttcgtacgtcggcctcgacggtcggacggaacgacgtcacgtagtcggactagtacgtaggtaggtacgtcgacgggacgaacgggtaacggacgggtacggtacgttacgttaacgtttaagtttacgttacggtaacttaactaaccgaaacgtaacgaacccttaccgttacggtttagttaaccttttcgttaccggttccgttaacggtacctacggacccggtaaccgtacggtcccgttaccggtaccggtcgggtaccgaaccgtaccccgaaccgacccctaaccctcgtccgtccttacccg

SEQ ID NO: 287070 - DNA, 851 bp, Homo sapiens
  misc_feature: GYAE6OF01C3K8R.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttcctccccctcctcactctctgcacaggctctgacggcctcctatgacgctgacacacgcccacccgtcggtgtctaggtcgtcccccaggacaggaccggaccaggactccaccgttcgccttcgtagggacgtagtgacctacgttacgaaccccgaaaaccgtattacgtacgttaccttttaacggttaccggggttaacccaagggtaaccgaaaacggggtaaacccggggccccgggggtaacccgtaacccgggttcccccggtttggggtttcgggttttacgggggtagtaacggtttaacggttaaaacgttaaaaacggaccgtaacggttagggaaccggtacccgggtaccccttagggaaaccggggttccttccccggtagggacggtacccgttacgttttaccgtccggttacggtacccgttaccggtacgggtaccggaacgggtaaccgtaccggtactacgttagtccggacctagtacgtaggtcggtaacgtacgagggacgagggaacggacgtaggtcctagtaacgttagtttagtacgtaacaactacaacgtactaacctacgtttagttcgttaacttacgttcgttacgtaacggtacccgtcggaacccgtaaccggtacggtcccgaccggttacgggtaccggttacccacccgaaccccggaacccgtacccctacccgtacgttccgacccgttaccccg

SEQ ID NO: 287071 - DNA, 632 bp, Homo sapiens
  misc_feature: GYAE6OF01CD97R.49.62.F07.1.454.CMB.1.raw
  modified_base (243)..(243): a, c, t, g, unknown or other
  misc_feature (243)..(243): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgcctctggagatgcattgaccaaacgntatgcttattggtacagcagagccggcacggccctgtgtggtgtatgtataagacagtagagacgcctgaggactccgtagagcgtattctcgtcggtctccgacggtcgacggacgaacggtcacgtagttcggacctagtacgaggtacggacgtccgagggacgaagggacggacgaggtctacggtaacttattagttacgtactaagtaccaaacgaacgtaacctaaccgtaggtttacgttaactttacggttacgtttaccgttacgaaccgtcgtacccggtaaccgtaacgggttaccctacccggtaccggttcgggtacccaaccggtacccccgtaacgggtacccccaacccccgtattcccggtccttaacccg

SEQ ID NO: 287072 - DNA, 784 bp, Homo sapiens
  misc_feature: GYAE6OF01BYVVR.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctcccccctcctcactctctgcacaggctctgacggcctcctatgagctgacacagcccaccctggtctcagtcgtccccgaggacacggaccggccaaggtactccaccgtgccttcgtgggagattggacctaagtttccgaacccgaaaaaccgtttaacgtcgtacgtttaagttacggtaaccaacgacgaacggaaccggcccgggaccgaaccgggtcccccgttgggttcggtttgggtacggtaagttagttaaagtaaaacgtaccgtaacgtaggaacggaccgggtaccccgtacggaacgggtaccgttcccgtaggacgtaccgttacgttccgtcgtcggtcccgtacgtaacgggtacgaacggggtaaccgtaaccggtacgtaacgtacggtacggtaccagttaccgtagggtacggtacgtaccgagggacgtaagggaacggtacggaacggtctacggtaacgttacgtttagttacgtaactaacgtaaccaacgtaacgtaacctacgttacgtttacgttactttagttcgttacgttaacggtaccgtacggtaccgtaaccgtaaccggtcccgtaaccgtccggtacggtacctaccggaaccctaaccggacccctaaaccgtctacggtcctacccgg

SEQ ID NO: 287073 - DNA, 953 bp, Homo sapiens
  misc_feature: GYAE6OF01BBZVS.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagcccacccgtcggtcgtcagttcgtaccccaggaccagacggaccaggactccactgcctcgtggagatgctattcgaccaaaccgtatacgtgtacttagttcggtaaccagacaacggaacggccggaccgaccggtccccgtagttcggtttggtagtacgtagtaagtaaacgacctacgtagaacggccggtcccgtacggaagggtaccttcccggtagaccggtacgtaacgtttccgtcgttacgggtcccgttacccggtaacgggtaccggtaaaccggggtaaacccggtaaacccgggttacccgtaaaccgtacgggttttaccgggaaccccttaacggttaccgtaacggggttacggtaaacccgggttaccggaacggggtacgggaaacggggaaaccggggtaacccggggtagggttaaccccgttagggttaaaacccttttagttttaaacgtttttaaccgggaaccgtttaaactaaccccgtaaaacgttaaacccggtaaacccttaacccggtttaaggtttttaacccggggtttttaaaatttacccgggtttttacccggtttaaaccggttttaaaccccgggttaaaccgttacccgggtaaacccccggttaaccgggtaaaacccggggtttccccgttaaaccccgggttacccggggttaccgtttaacccgggaccccgtaacccccgggtaaaccccggacccccgttaaaccccgtactaaaccccggttttcccaaccccgggg

SEQ ID NO: 287074 - DNA, 700 bp, Homo sapiens
  misc_feature: GYAE6OF01BXGCF.49.62.F07.1.454.CMB.1.raw
  modified_base (182)..(182): a, c, t, g, unknown or other
  misc_feature (182)..(182): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtntcagtcgtcccaggacagacggccaggatcacctgctcgtggagatgctattcgaccaaaccgatatgacttagttcggtaccagctaaggaacggccggccacggtcccctggtgttcggtagtactagttaaataaaacgactacgtaggacggtacggtcccgtacggaacgggtacctccccgtaggaccgtacgttactttccgttcgtcgggtccctccggtaacggttccggaacggggaacctaaccgggtacacgtacgttcggacctagtacgtaggtcggacgtccgagggcgaacgggacggtaacggaggtacctagtaactttagtttactaccgttacaacttacgaaacgtacgaacctaaccgttagtttaccgggttaactttacgtcgtttacgtaccgtaacgtcggacgtaaccggtaacggtcccgtaccgggttccgaccgggtacgacccgtacccggaaacccgacccctaaccccgcttccggacctcccgg

SEQ ID NO: 287075 - DNA, 816 bp, Homo sapiens
  misc_feature: GYAE6OF01EUH7T.49.62.F07.1.454.CMB.1.raw
  modified_base (227)..(227): a, c, t, g, unknown or other
  misc_feature (227)..(227): n is a, c, g, or t
tcagagtcgagagacacgaccggtgctcgatttagtagtcgcataaagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatccacctgctcgtgganatgctattcggacccaaaccgattatcgtactttagttggtacccagacgaggaaacggcccggggaccacggtcccccgtggttcggtttggtcgtagttagttaagtaaaacgaccgtaacgtaggaacggacggtccccgtacggagggaacttcccgtaggacgtcggtacttccgtacgtcggtcctccggaggtcggaacgggaacgtaaccgggtcctaaacgtagttcggacccgtagtacggtagggttacggaccgtaccggagggtacgaagggtacgggaacgggtacggtacgtacgttaaccgtttagttttaagtttacgttaacccgtaaataaccgaaaaccgtacgtaaacccgaccgtttaacgtttacggttaaccttttaacgttacggtttaccgtttaacgggtaaccgttacggaaccccgtaaacggttaacccgggtacccgttaaccccgggtccgggttaccggggtaccctaaaccccggaccccggtaaaaccccggaccccccgtaaacccccgtacccgttacgtaccccgttaacccgttccgtttacccccccgg

SEQ ID NO: 287076 - DNA, 644 bp, Homo sapiens
  misc_feature: GYAE6OF01BR2Q4.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgctattcgacccaaaaccgtatatgtcttattcggtaccagcagaacgccggccacggcccctggtgttgggtgatagtaataaagacacgtggagacggccctgagggtactcccgtgacgcgtattctcgtggcctccgaggtcgaggacgtaacggtcactagttcgactagtacgtaggtacggacgtccgaggcgaagggtaacggacggacgggcgtacggtacttaagtttacgttactacgtaactacgaaacacgtaacctacctagtttacgttaactttattcggttaccgttaccggtaacgtcgaccgtaacccggtaacggtcccgtaccggttcccggtacgggtacccaccggtaccccgaacggaaccccctaccccgacgttccgtcccgttacccg

SEQ ID NO: 287077 - DNA, 636 bp, Homo sapiens
  misc_feature: GYAE6OF01DBXIY.49.62.F07.1.454.CMB.1.raw
  modified_base (111)..(111): a, c, t, g, unknown or other
  misc_feature (111)..(111): n is a, c, g, or t
  modified_base (182)..(182): a, c, t, g, unknown or other
  misc_feature (182)..(182): n is a, c, g, or t
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
  modified_base (318)..(318): a, c, t, g, unknown or other
  misc_feature (318)..(318): n is a, c, g, or t
  modified_base (568)..(568): a, c, t, g, unknown or other
  misc_feature (568)..(568): n is a, c, g, or t
tcagagtcgagagacacgaccggtgctcgatttagtagtcgcataaagggaaagggggctgtgggtccaggaggcagaactctgggtgtctcaccatggcctggatccctntacttctccccctcctcactctctgcacaggctctgaggccctcctatgagctgacacagcccacctggtntcagtcgtcccaggacagacgcaggactcacctgctcngganatgctatcgaccaaacgntagtctacttagttacggaccagcgaaggtacgcccggacgacggtccctggtcggtttggacgtattacgttaanaaacggactaacgtggaacggacgtcccgtagacgggtacctaccgtagacgtcggtactttccgtacgtaggccctcgtaacgggtaccgagggaaccctaggtccaaagttcgttcggactaacgtcgtaacgggtcggaaccgtcggaacggacggacggaacgggacggtacggacgtagtacgttattgtacgttcaacgtacagacaccgtactagttcgttattacttcgtacgttacgtacncgtacgaccgtacgtcgtaccgtcggtactacccggagacccgacgaccccacgtacctgtccctacg

SEQ ID NO: 287078 - DNA, 642 bp, Homo sapiens
  misc_feature: GYAE6OF01AONU8.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatcccctctacttctcccccctcctcactctctgcacaggctctgaggcctcctatgagctgacacagcccaccctcggtgtcagtcgtccccaggacagacggccaggactcacctgctctggagatgcattcgaccaaacgatatgtacttagtcggtaccagcaagacgccggcacggccctgtgtggagatagtataacgcagtgagcgccctagacgggtactccgtagacgcgtactttccgacgtcgtacctaccgaggtacgaacgggtaaccgtaaccggtcctaacgtacgttacgggacctagtacggaggtacgggacgtaccgaacgggtaccgaaggggtaacgggaccggtaaggtccgttaaggtaactttaatttacgtagtaccaagtaccaaacgtgaaaccttactagtttacgttacttagttcgtacgtacgtaactcggaccgtaacccgtaagtccctaaccggtcgacggtaccaccggacccgtaacggacccaacccgctccgtctaccgg

SEQ ID NO: 287079 - DNA, 776 bp, Homo sapiens
  misc_feature: GYAE6OF01AT0Z2.49.62.F07.1.454.CMB.1.raw
  modified_base (245)..(245): a, c, t, g, unknown or other
  misc_feature (245)..(245): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaccgntatgcttatggtaccagcagaagccggccaggcccctgtgttggtgatgtataaagacactgagacggccctcgagggtactccccgtgacgcgtacttccgtcgtggtcctacccgtagggttccgaacgggtaacgtaaacccgggttaccaacgtacgttacggaccctaattaccgtaaggtcgggaacggttccccgaaggggaccgtaacgggaacggggtaaccggaacgggtaccgttacgggtaaaccgtttaacgttttaacggtttacgtaaccgtaaaacgtttacccgaaaaccgtaacggtaaacccttaaccccgttaagttttaaccggggtttaaaccttttaacgtttaccgtttacccggtttaaccgggaaaccgtttaccggaacccggtaaacccgtaacgggtttacccgtaccccgggtttacccggtcgggggtttaacccaccgggtacccccgtaaaccggtacccccctaaaccccccgacgttcccgtacccttaaccccgg

SEQ ID NO: 287080 - DNA, 659 bp, Homo sapiens
  misc_feature: GYAE6OF01DCFT8.49.62.F07.1.454.CMB.1.raw
  modified_base (228)..(228): a, c, t, g, unknown or other
  misc_feature (228)..(228): n is a, c, g, or t
  modified_base (248)..(248): a, c, t, g, unknown or other
  misc_feature (248)..(248): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggactcacctgctctggganatgctattcgaccaaaacgntagtgtacttattggtaccagacagaaggccgggccaacggtccctggtgttggtgatagtaataaagcagtgagacgcctgaggactccgtgacgcgtattcgtcgtcgcctcgaggtcgacgggtactacggtcacgtagttcggacctagacgtaggtcggacgtccgagggtacgaagggtaacgggaaccggcggtacgtacggtaaccgtttaagttacgtttacgtaactaaactaccgaaacgtacgaacctaaccgttaagtttacggtaactttagttcgttaccggttacggtaactggacccgtaaccggtaacgtcccggtacccgttccggtcgggtacctaacccggaccccgtaaccgggaacccccaccccgtaacgtccggtaccctaccccg

SEQ ID NO: 287081 - DNA, 618 bp, Homo sapiens
  misc_feature: GYAE6OF01BLOFQ.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcacctgctctggagatgctattcgaccaaaaccgatatgcttattggtaccagcagaacgccggccacggcccctggtgttggtgatgtaataaagactacgtgaggacggcctcgagggactccgtgagcgtactctcgtggtctcgaggtcgaggactaacggtcagtagttcgcctatacgaggtcggacgtaccgaggacgaggacgggacgacgggtctacgtaactagttacgttgtactaactaccgaaacgaacgaacctaactaacgtttacggttaactttaagttcgttacttaccggtaacgtcgaccgtaaccgtaacgtcccgtacccgttccggtagggttaccaccggtacccgaaccggaccccaacccgtacccgttgtcccttacccg

SEQ ID NO: 287082 - DNA, 673 bp, Homo sapiens
  misc_feature: GYAE6OF01AX9QE.49.62.F07.1.454.CMB.1.raw
  modified_base (212)..(212): a, c, t, g, unknown or other
  misc_feature (212)..(212): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
tcagagtcgagagacacgaccggtgctcgatttagtagtcgcataaagggaaagggggcgtgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggntcacctgctctggagatgcattgaccaaaacgtntatgtnttagtcgtacagcaagaacgccggacacgcccctgtgtggtagtatgtaataaagacatgagacgccctgaggactcctagacgcgtaatcgtacgtcggtactacccggagtaccggaacgggtaacccgtaaacggtccgtaaacgtaacgttaccgggaccctaaacgtacccgtaagggtacgggtaaccggttaccgaaagggtacccgaaaggtaacgggaacggacggtagttaccggtaaacttattttaacgtacgtaactaactaccgaaaacgtaacgaacctaacgttagtttacgttaacttagttaccgtacgttacggtaacgtcgaaccggtactaaggtccctaccggtaccgtaggtaccgaccgaacccgtaacggaaccctaacccgctccggtcctaccg

SEQ ID NO: 287083 - DNA, 808 bp, Homo sapiens
  misc_feature: GYAE6OF01AR5XC.49.62.F07.1.454.CMB.1.raw
  modified_base (260)..(260): a, c, t, g, unknown or other
  misc_feature (260)..(260): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgacggccttcctatgagctagaacacacgcccacccgttcggtgtcagtcgtccccgaggacaggacggccaggactcacctgctcgtggagatgctattcgaccaaaaccgtntagtcgtcttagttcggtaaccagcgaacggaacggcccggggaccgaccgggtcccccgttgggttcggtttcgggtacggtaagtttaggttaaaacgtaaaaacggacgtaccgtagggaacgggtaccggacccgtacggaacggggtacctcccggtggacgtaccgtacttcgtcgtcggtcccgttaccggtaacgggtcggaaacgggaaccgtacgtaccgaacgtacgttccggactacgttacgagggttcggtaaccgtccggaagggaccggtaaggggtaaccgggaaccggtacgggtacctttaggtaaacgtttacgtttaacggtttacggaacttaacgtaccggaaaacgtaaccgaaccgtaaccggtttaacgtttaacggtttaacctttagtttcggttacccgtaaggtaacccgtacgaacccggtaaaccgtaacggttcccgaccgggttacccggtcgggacccaacggtacccccgtaaaccggaccccttaaccccgcgtttcggcccttaaccccg

SEQ ID NO: 287084 - DNA, 732 bp, Homo sapiens
  misc_feature: GYAE6OF01BZI5F.49.62.F07.1.454.CMB.1.raw
  modified_base (466)..(466): a, c, t, g, unknown or other
  misc_feature (466)..(466): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctcgcacaggctctgaggcctcctatgagctgacacacgccacccgtggtgtcagtcgtccccgaggacaggacggccaggatcactgctcgtggagatgctagttcgacctaaacgatatgtcttagtcggtaccagtcgaaggtaacgcccgggaccgacggtcccctggttcggttggtagtatacgttaagtaaacgacgtagtaggacggtaccggtcccgtacggacgggtactccccgtaggacgtcgtattccgtcgtcggccgtacgtagggtaccgaagggaaccgtaaccggtcaacgtagtcggcctagttacagggttanaccggtaccgacggtacggaagggacgggaacgtacggtacgtacgtaacgttatttacgtttacgaacttaactacgaaacctagtaaccctacgttaaggtttaccgttaactttaccggttgttaacccgttacgggtaaccgttacggaccccgtaaccgtaaccgggtccgtaccccgggttacggtaccggggtaacccaccggtaaccccgtaaccggtaccccctaaaccccgtccgttccgtacccgttaaccccgg

SEQ ID NO: 287085 - DNA, 790 bp, Homo sapiens
  misc_feature: GYAE6OF01BTBJ0.49.62.F07.1.454.CMB.1.raw
  modified_base (234)..(234): a, c, t, g, unknown or other
  misc_feature (234)..(234): n is a, c, g, or t
tcagagtcgagagacacgaccggtgctcgatttagtagtcgcataaagggaaagggggctgtgggtccaggaggcagaactctgggtgtctcaccatggcctggatccctctacttcctccccctcctcactctctgcacaggctctgaggcctcctatgagctgacacagcccacccgtggtgtcagtcgtccccgaggacaggaccggaccaggtactcaccctgacttcgngggagatcgactacgttacgaacccgaaaccggtatagttacggtactttagtttaccggtaaccgtacggaccgaacggaaaccgggcccggggacccgtaaccggggtcccccgtttgggttggttcggttaggtacgttaaggttaaataaacgacgtacgtaggacgggaccggtcccgtacggaaggtacccgttcccggtaggacgtcgttacgttcgtaccggtcgtaccgtcgtaacgggtaccggaacgggaccgtaaaccggtcgtaacgtacgttacgaccgtacgttacgaggttccggaacgtcccgaacgggacggtaacggtaacggggaacgggtaccggtacgtaacgttaacgtttacgttttacgttacgtaacctaaacgtaaccaaccgtaactaccgtaaccgttaggtttacgtttaacgttacgttcggttaccgttacggacgttacggaccgtaccggtacgtccgtacccggtcggtacggtccgaacccgtccgaacccgacccctaccgtacctcgtcccttacccg

SEQ ID NO: 287086 - DNA, 830 bp, Homo sapiens
  misc_feature: GYAE6OF01B1IN9.49.62.F07.1.454.CMB.1.raw
  modified_base (237)..(237): a, c, t, g, unknown or other
  misc_feature (237)..(237): n is a, c, g, or t
  modified_base (241)..(241): a, c, t, g, unknown or other
  misc_feature (241)..(241): n is a, c, g, or t
  modified_base (685)..(685): a, c, t, g, unknown or other
  misc_feature (685)..(685): n is a, c, g, or t
tcagagtcgagagacacgaccggtgctcgatttagtagtcgcataaagggaaagggggctgtgggtccaggaggcagaactctgggtgtctcaccatggcctggatccctctacttcctccccctcctcactctctgcacgaggctctgacggtcctctatgagtcctagacacacgcccacccgtggtgtcaggtcgtcccgaggacaggaccggccaggtctccacgtgcttcgnggantgctagttcgaccaaacgttagtgttcttagttcggtaccagcgacgaacggcccgggtccacggtccctggttcggttggtagtacgttagtaacgtaaagaccgtaacgtcggaacgtacggggacccctacggtaacggggtaccttacccggtcggtaacggtccgttaagtttcccgtcggttaccgggtccgttcccgggtaaggttaccggaacggggtaaccgtaaacccggtcgtaaaaccgtgggtttaccgaaccgtacgtacgggtaggtaccgggtaaccgggtaccggacggggtacccgagggtaacggggaacgggtacggttaccgtaaggtttaaccgtttaagttttacgtttacgtaacgttaaacaacccgttaaagaacgtaaccctaacgtttaacgggtttacgttaacgtttacggttnttaccggttaaacggtaccgtacgggttaaacccgacgggttaaccgtacccgggtaccgtttcccgggtacgttaccgggaaccccgtaaccggaacccggtaacccccctaacctacccgttccgtaccgttttaacccccgg

SEQ ID NO: 287087 - DNA, 759 bp, Homo sapiens
  misc_feature: GYAE6OF01C3PZN.49.62.F07.1.454.CMB.1.raw
  modified_base (181)..(181): a, c, t, g, unknown or other
  misc_feature (181)..(181): n is a, c, g, or t
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
  modified_base (253)..(253): a, c, t, g, unknown or other
  misc_feature (253)..(253): n is a, c, g, or t
tcagagtcgagagacacgaccggtgctcgatttagtagtcgcataaagggaaagggggctgtgggtccaggaggcagaactctgggtgtctcaccatggcctggatccctctacttctcccctctcactctctgcacaggctcgtgacgcctctatgagctagacacagcccaccgtggtntcagtctacccgaggacagccgacagactcacgtnctcgtagganatgactacgttacggaaccaaacggtnttacgtcgttactttagtacggtaaccaggacgaacggacggccggaccgacggtcccgtggttcggttgtaggtattaagtaagtaaacgacgtacgtacggacgaccgtcccgtagacggtaccttaccgagtcgtaacgttcttcgtaccgttcggaccttacggaacggtaccgaacgggtaaccgaaccggtactaccgtagttaccggacgtactacggtacggtacggtacgtaccggaggtaacggaacggtaacgggaacggtcgacgttagttaacgttattacgtacgtacaaactaccgaaacgtaacaacgttaacgttacgtttaacgttaactttagttacccggttacgttaaccgtcggttaaccgaaaccgttaccgtaaccggttaccggtaacccgggttcggtaaaccgggtacccgaaacccggtaccccggtaaacccggtaacccccgtaaacccgtccctttaacggttccctaaaccccg

SEQ ID NO: 287088 - DNA, 714 bp, Homo sapiens
  misc_feature: GYAE6OF01DN3XJ.49.62.F07.1.454.CMB.1.raw
  modified_base (143)..(143): a, c, t, g, unknown or other
  misc_feature (143)..(143): n is a, c, g, or t
  modified_base (182)..(182): a, c, t, g, unknown or other
  misc_feature (182)..(182): n is a, c, g, or t
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (529)..(529): a, c, t, g, unknown or other
  misc_feature (529)..(529): n is a, c, g, or t
tcagagtcgagagacacgaccggtgctcgatttagtagtcgcataaagggaaaggggctgtgggtccaggaggcagaactctgggtgtctcaccatggcctggatccctctacttctccccctctcactctctgcacaggctntgacggcctcctatgagctgacacagcccacccgtggtntcagtctacccaggacagacggccaggatcactgcttctaggganatcgctagttcgaccctaaacgtnttagtgtactttagttacggtaccagcgtaaggacggccggaccaccggtcccttaggttggttacggtagtaagttaggtaaacgtaaacggtacctaacgttggaaccggtacggtacccccttaggaacgggtaccttccccgtaggacgtaccgttacgtttccgtcggtacgtcccgttaacggtaggtaccggaacggtaaccgtacggtaccaacgttacggttcgaccttagtacgagtcgggtaccgtcgaaggacgtaggaacggcgngtactaggtacttgttagtgtacgaactacgaacgaagtacctaacggtttagtttcggtacctttaagtcgtttaccggttaacggaaccgttcgaacccggtaccgtaaggtcccgttacccggtgttacgggcccaaccggacccaaccgggttacccccaactcgttcgtaccgttacccg

SEQ ID NO: 287089 - DNA, 895 bp, Homo sapiens
  misc_feature: GYAE6OF01BRPXF.49.62.F07.1.454.CMB.1.raw
  modified_base (262)..(262): a, c, t, g, unknown or other
  misc_feature (262)..(262): n is a, c, g, or t
tcagagtcgagagacacgaccggtgctcgatttagtagtcgcataaagggaaagggggctgtgggtccaggaggcagaactctgggtgtctcaccatggcctggatccctctacttctcccccctcctcactctctgcacaggctctggacggcctctatgagctgacacacgcccaccctcggtgtcagtcgtccccaggacaggaccggcaggactcaccgtgcctacgtggagatgcgtattacgacccgaaaaccgtntacgttgtactttagttacggtaccgacgacgaacggaacggcccggggaccacggtcccccgttggttggttagggtgtagttagttaagtaaacgaccgtaacgtaggacggtaccggtaccctacggacgggtactcccgtagtacggacgtattccgtcgtcggtccgtaccggtacgggtacggaacggtaaccgtaaccggtactacgttacgttacggaccttacgttaccggtaggtacgggtaccgtaccggacgggtaacggtaacgggaacggggtaacgggtacggggtaaccttaacggttaacgtttaagttttaacggttacgttaaaccgtaaacctaacccgtaaccgtaaacgaacccgttaaccggttaaggttttaaaccgggtttaacttttaacggttaccggtttacccggttaacgggtaaacccggttaggtaaccccgggttaaaacccggttaaccccggtttaacccggggttaacccccggttacccgggttaccccgggggttaaacccaaaccccccggggttaacccgaaaccccccggttaaaccccccggtaaacccccgttcccggtttaacccggtacccctttaaacccccccggg

SEQ ID NO: 287090 - DNA, 939 bp, Homo sapiens
  misc_feature: GYAE6OF01DIV0B.49.62.F07.1.454.CMB.1.raw
  modified_base (310)..(310): a, c, t, g, unknown or other
  misc_feature (310)..(310): n is a, c, g, or t
tcagagtcgagagacacgaccggtgctcgatttagtagtcgcataaaggggaaagggggctgtgggtccaggaggcagaactctgggtgtctcaccatggcctggatccctctacttcctccccctctcactctctgcacaggcttctagacggcctctatgagctgacacacgccctacccgtgggtcgtactacggttccgccccgaaaggaccgacgggaccggacgaacgggtactacccgaaccttcggtccttacggtagggaacgtagttcgactaacgttaccgaaacccgaaaaaccgttnttaaacgttcggttaacttttaacggtttacggtaacccgtaaggtaacgaaacgggaaaccgggtcccgggtaacccgaaccggtaccccgttggttcgggttagggtacggtaataacggttaaaagtaaaacggactaacggtaggaaccggtacggtaccccgtaggaacgggtaccttccggacggtaggtacctagtttccgtaggtcacggttaccgacgggtacgaacgggtaacgttaaaccgacgtacgtacgttacgaccgttaagaccggtaagttacgggaaccggttaacggaccgggaaggtaaccgggaaggaacccgggtagttaaccggtaagtttaaccgtttaaagttttacggtaagtaacccttaaaaggacccaaacggttacgaaacccgttaaccgtttaagggtttaaccggttttaaacctcggtttaacgggtaacctttaccgggaaaccctttaccggggaaaccttaaaccggggttaaccctaccgggttaacccccgggttaggggttaacccgggtaacccaaacccggggtaacccccgttaaacccgggaaccccttaaacccgtaacggttaccgtaccccggttaaccccg

SEQ ID NO: 287091 - DNA, 704 bp, Homo sapiens
  misc_feature: GYAE6OF01D4YRT.49.62.F07.1.454.CMB.1.raw
  modified_base (180)..(180): a, c, t, g, unknown or other
  misc_feature (180)..(180): n is a, c, g, or t
  modified_base (229)..(229): a, c, t, g, unknown or other
  misc_feature (229)..(229): n is a, c, g, or t
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctctcactctctgcacaggctctgagcctctatgagctgacacagcctacccctggtntcctagttcgtcccccgaggacagacggccaggatcacctgctctgganatgctattcgaccgaaactntacngtacttatcggtaccagcagacgccggcacgccctgtgttggtgatgtataagcacgtgacgacggcctagacggtctccccgtagcgtcgtattccgtcgtacggtccgtccggtaacggtaccgaagggtaacccgaacggtacctaacgtacgtttcggaccctagttaccgtaagggtcggaacgttacccgaagggtacccgaagggtaacgggacgtacggtacttaggtactttagtttagttcggtacaacgttaccgaaacgtaccgtaaccgtaccttaggtttacggtttaaccgttagttcggttaccgttaccggtaaccgttaggcccgtaaacgttaacgggtacccgttaacccgttccgggttacggtacccgacccgaacccccggtaaaccggtaccccctaaaccccgttcgttccgtcccgttaaccccg

SEQ ID NO: 287092 - DNA, 871 bp, Homo sapiens
  misc_feature: GYAE6OF01BSLMP.49.62.F07.1.454.CMB.1.raw
tcagagtcgagagacacgaccggtgctcgatttagtagtcgcataaaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcactgctcgtggagatgctattcgaccaaaaccgatatgtctttagttcggtaaccagacaaggaacggcccgggaccgaccggtccccgttggttggttgggtagtaagttacgtaaagtaaaacgacctaagtaggacggtacggtcccgttaggacgggtactcccgtaggacgtcgtactttccgtaccgtgggtcctcggtacggtcgaacggggaactaacgggtactaacgtacgttacgggaccctagtaccggtagggtacggaccggtaccgtaacggggacgaacggggaacgggaaccgggtacgggtccgttaaacgggtttaaccgtttaaacgttttaacgtttacggttaaacctaaacggttaaacccaaaccggtaaacgtaacccgttaaacccgtttaggttttaaacccggtttaacgttttaaacggttcggtttaacccggtttaaccgggtaaaccgtttaccgggaaaccccggtaaaacccgggttaaaccgggtttacccccgttaaaccccggggttcccgggtttaaccggggtaacccgtaaacccggaaaccccccgggtaaaaccccgggttaacccccccaaaaccccccggtttcgttaacccggtacccgtttaacccccgg

SEQ ID NO: 287093 - DNA, 646 bp, Homo sapiens
  misc_feature: GYAE6OF01A1DPA.49.62.F07.1.454.CMB.1.raw
  modified_base (247)..(247): a, c, t, g, unknown or other
  misc_feature (247)..(247): n is a, c, g, or t
tcagagtcgagagacacgaccggtgctcgatttagtagtcgcataaagggaaaggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcattcgaccaaaaccgtntatgtcttattcggtaccagccagaagccgggccacggccccgtgtgttggtcgagtgtaagtaaacgacacgtgaggtacgccctcgagggtactccgtgagcgattcgctggctcgagtcgacggactacgtcacgtagttcggcctacgtctaggtggacgtaccgaggcgaacggtagggaaccggaggtcgtagtaaccgtagtttaacgttcgtactaagttaaccaaacgtaaggaaccctaacgtaacttttacgggttaactttacgttacgtttacgttacccggaaacgtcggacctaaacccggtaacgttacccgacccggttaccggtccgggtacgaccgaccccggaacggacccccaaaccctccgtacgttcccgtacccg

SEQ ID NO: 287094 - DNA, 889 bp, Homo sapiens
  misc_feature: GYAE6OF01D56DD.49.62.F07.1.454.CMB.1.raw
  modified_base (695)..(695): a, c, t, g, unknown or other
  misc_feature (695)..(695): n is a, c, g, or t
tcagagtcgagagacacgaccggtgctcgatttagtagtcgcataaagggaaagggggctgtgggtccagggaggcagaactctggggtgtctcaccatggcctggatccctctacttcctccccctcctcactctctgcacaggctctggacgtccctcctatgagcctagaccacgacgccctacccgtcgggtcgtcgtacggtccgtacccccgaggaccacggaccggccgaaggacctcctacctcggtcctcggtaggacgtatcggtcctaagttaccggaacctaaaccgttagttaacgttcggttaacgttttagtttacccgggtaaccgaacggtaccgaaacgggaacccggggtcccgggggtaacccgtaccccgggttcccccggtttagggtttcggggtttacgggtaggtaacggttagttaaaaacggtaacgtaccgtacgtacgggacgggtacccggtacccgtacggaacgggtccttacccggtaggaccggtaccggttactttccgtacccggtggtcccgtaccgggaacggtaccggaacggtaacccgtaacggtacctaagttcgggtaccggtactacggtacgagggtacggtacgtaccgaggacggacggtaacggacggtacgtacgttacgtaacgtttagtttacgtacggttaanaacgttacccaaacgtcgaaaccttacggtttactttaggttaccgttacgttcgggtttactcggtaacgtcccgggtaaagtaacccggttacccggtaccggtacccgttcggttacgggaccccgtaacccgggtaccccgtaaaccccggacccctaaccccggttaccgttccgtaccccgttacccg

SEQ ID NO: 287095 - DNA, 904 bp, Homo sapiens
  misc_feature: GYAE6OF01ERSQD.49.62.F07.1.454.CMB.1.raw
  modified_base (110)..(110): a, c, t, g, unknown or other
  misc_feature (110)..(110): n is a, c, g, or t
tcagagtcgagagacacgaccggtgctcgatttagtagtcgcataaagggaaaggggctgtgggtccaggaggcagaactctgggtgtctcaccatggcctggatccctntacttctcccccctcctcactctctgcacaggctcgtgagcctacctatgagctgacacagcccacccttggtgtccaggttcgtacccccgaggaccaggaccgggccaagggacttaccgaccgttcggacccgttcgtagggaacgtagttcggacctacgttaccggaaccccaaaaccgtattacgtcgttactttaagttacggtaaccagaccgaacggaacggcccggggaccgtaccgggtcccccgttggttcggtttagggtacggttagtacggttaaacgtaaaacggaaccgtacggttaggaaccgggtacgtaccccgtacgggaggtacccgttacccgtaggtaaccgtcgttaacttccgttacgtccggtccgtaccggtaggtaaccggtaacgggaccgtaaaaccgggtcttaaccggtaggtttccgggtaccgtacggttcggtaacgggttcggtaacggtacccgggtaggaccggtaagggtaacggacgtacggttacgtaacggtaaacttttaacgttacgttagttaaccgtaacgttaccgaaacgttactaaccgttaaccgtttagtttaaccgttacgttttaacgttccgggttaaaccttacggggtaacctaaccgggtaaacccgtaaaccggttaacccggttacccggtaaccgtttacccgggtacgggtacccgttaaacccggaaaccccccgggttaacccgaacccccgttaaaaccccgtccggtttcccttcccggttaaccccg

SEQ ID NO: 287096 - DNA, 1008 bp, Homo sapiens
  misc_feature: GYAE6OF01DXOCG.49.62.F07.1.454.CMB.1.raw
  modified_base (135)..(135): a, c, t, g, unknown or other
  misc_feature (135)..(135): n is a, c, g, or t
  modified_base (142)..(142): a, c, t, g, unknown or other
  misc_feature (142)..(142): n is a, c, g, or t
  modified_base (752)..(752): a, c, t, g, unknown or other
  misc_feature (752)..(752): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactcctncgcacgngtctcgtaggaccgtcctactagtagacgtctacgaaccacgaccgacccctacccggttcgggttcgtacgtacggttcccgtacccggaaggaccgaacgggacccggacggaacggtcctaccctacgtcgtccgttcggtagggaagtcgtaccgacgtttacgttacccggaaaacccgtaaaacgttattacggtccgttttaacgttttaagggttaacccggaaccgaacgaacgggtaaaaccggggaccccggggccccgggtaacccggtacccccgggttcccgtttggggtttacgggtttcggggtaacttaagggtttaaacggttaaaaacggtaaaaccggtacccggttaacgggtacggggtaaacccggggtacccccggtttaccgtaaaccgggggtaacgggttcccctttacccgggaagggtacccggtaaccgttttccttccggtcgggtcccgtaacccgttacgggtaacgggtaaccgggtaaacggtaaccgtaccggacctaaagtttccgggtaccgaacttaggtacgggtagggtaccggtaccgtacgggacggtacggaacgggtaaccgggngtaccggtattacgttaaacgtttgttttacgtacgtaacctaaacaaccgtaacgaactaccttaacgtttagggtttaacctttactttacgttaccgggttacccggtaaacgggtacctaccggggtaaccgtaaaaccgggttaccggtccccgttacccggttcggggttaaccgaaaccccgtaccccgggaaaacccgtaccccggtaaaccccctaacggtttcccttacccggtctttacccccgg

SEQ ID NO: 287097 - DNA, 845 bp, Homo sapiens
  misc_feature: GYAE6OF01DU1RN.49.62.F07.1.454.CMB.1.raw
  modified_base (183)..(183): a, c, t, g, unknown or other
  misc_feature (183)..(183): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcgggtntcagtcgtccccaggacaggacggccaggatccaccgtgcctcgtggatatgctattcggacccaaaaccgtattatcgtacctttagttcggtaaccagcgaacggaacggccgggaccacggtccccgtggttggtttagggtagtacgttagtaacgtaaaacgacgtaccgtaggacggacggtacccgtacggtaacgggtaccgtaccccgtaggacggtaccgttacgtttcgttcggttacggtacctaccggtacggtacgtaaccggggtaacgtaaaccgggtaccgtaacgtagtttaccgggacctacgttacggtaacggttacggggtaaccgttacccggaacggggtaacgaacggggaacgggaaccgggacggtacgttaacggttaacgtttacgttttaaggttaccgtttaacgtaaacttaccgtaacggaaacgttaaccgtaaccgttaacgggttttacgtttaaaccgtttacgtttaccggttttaccggttaaaccggggtaaccttcgggtaccccgggttaaacgtaaccggggttacccgtaaccccggggttccgtaccgggtaccctaaccgggaccccgtaaaccgggaccccctaaccccgtacggttccgtccgtttaaccccgg

SEQ ID NO: 287098 - DNA, 897 bp, Homo sapiens
  misc_feature: GYAE6OF01BKZ4Q.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctctcactctctgcacaggctctgacggcctcctatgacgctgacacacgcccacccgtggtctactaggtccgtaccccgaggacacggaccggccgaggactccgacgttcgcctcgtaggatacgtggactacgttcgaacctaaacgtatagtcgtactttagtacggtaaccagacgaaggaccggtccggaccgacggtccctggttcggttagtacgtagtagttaaagaacgacgtacgtaggacggaccgtccgtacgggacgtccgtaccgtagacgacgttacgttcgtcggttacggtaccgaccggtttaacgggaccggttaaacggggaacccgttaacggtacccgtaacgttaaccggtacggtaacctacggttacggttacgggtacgggtaacccgtaccgggaaaggtaccggtaaagggaacccgggggaacgggtaacgttaacggttacccgtttaaaggttttacgtttaaccgggttaactaaaccgttaaacggaaacccgtaacggtaaacccctaaccgttaaccggtttaaagggtttttaacccggtttaactttaacggttacccggtttaacccggtacggttaaaccggtacccggtaaccggttaaacccgggttaaccgttaaccccgggttacccggttaaccgggtacccgggttaaccccgaaacccgggttaaccccccgaacggttaaccccccccgaaaccgttttcgtaaccccgttacccgttaaccccgg

SEQ ID NO: 287099 - DNA, 684 bp, Homo sapiens
  misc_feature: GYAE6OF01A7XM7.49.62.F07.1.454.CMB.1.raw
  modified_base (249)..(249): a, c, t, g, unknown or other
  misc_feature (249)..(249): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgacggcctcctatgagctgacacagccacccgtcggtgtcagtcgtccccaggacagacggccaggactcacctgctctggagatcgcattcgaccaaaccgntacgtcgtcctttagttacggtaccctagaccgaaggaacgcccggggaccgacgggtcccccgttaggttggtttacgggtacgtaacgttaggttaaactaaaacggaccctaagtaggaacggaccggtcccctaggacgggtacctccgtaggacgtcgtattcctacgtggcctcgaggtcgacggactacggtcacgtattacggccagttcgaggtcggtagtccgaggtacagggacgacgacggtctagtacttagtttactgtactaatcaacgagtacctacctaagttacggttacttgtagttaccgttaggaccttggacccgttaaaccgacggttcccgtaacccgtccggttaccgggtaccaacccgggtcccgtaaaccgggcccccaaacccgtcccgttacggttccctacccg

SEQ ID NO: 287100 - DNA, 779 bp, Homo sapiens
  misc_feature: GYAE6OF01C5E4U.49.62.F07.1.454.CMB.1.raw
  modified_base (231)..(231): a, c, t, g, unknown or other
  misc_feature (231)..(231): n is a, c, g, or t
  modified_base (251)..(251): a, c, t, g, unknown or other
  misc_feature (251)..(251): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtcccccaggacagacggccaggactcacctgcctcgtgganatgctattcgaccaaaccgnttatgtacttagtggtaccagacaggaacggccggcacggcccctggtggttggtgtattagtaagtaaagactacgtaggacggacggtacccctacggaacgggtacctcccgtaggtacggtaccgttaactttccgttaccgttcgggtacccttaccggtaacgggttaccggaaacggggtaacccgtaaacgggtaccctaacggttacgtttacgggacccttacgttaccggtacgggtaccgggtaaccgttcccgggaacgggtaccggaagggaacggggtaaccggacggtacgttacggtaaccgttttaatttacgtttacgttaaccgaacttaccgaaacgtaaccgaaccttaaccgttaagttttaccggttaactttacgttacgtttaccgttaacggtaaacgttcggaccgtaaccgtaacggtaccctaccggttacgtcgggtaccgaacccggtacccgaaccccggtaacccaaccccggttactccgttaaccctacccg

SEQ ID NO: 287101 - DNA, 690 bp, Homo sapiens
  misc_feature: GYAE6OF01A9MN8.49.62.F07.1.454.CMB.1.raw
  modified_base (230)..(230): a, c, t, g, unknown or other
  misc_feature (230)..(230): n is a, c, g, or t
tcagagtcgagagacacgaccggtgctcgatttagtagtcgcataaagggaaagggggctgtgggtccaggaggcagaactctgggtgtctcaccatggcctggatccctctactctcccctcctcactctctgcacaggctctgaggcctctatgagctagacacacgccacccgttcggtgtaccagttcgtccccgagggacaggacggccaggactcactgctcgnggagatgacctattcgaccaaaccgatatgtcttaagttcggtaccagcgaaggaacggccgggaccgacgtccccttggtacgttggtagtagttacgtaataaacggcaacgtggaacgacggaccccgtaggagggtaccttccccgtaggacgtccgtagttccgtactcgggcctaccgacgggtcgaacggtacgtaccggttacaacgttaagtcggactacgtccgacggttggacgttaccgaagggacgaggagggtacgaggtcctagtaacttagtttagtcgtaacaactacgaaactagaaccgtactagtttaacggttacctttagtacgggtacttaccggagttaccgacgtaaaccgtttacggaccgtacccggttccgtacgggttaccgacccggtaccgaaccgacccctaacccggtcctaggttcccgtaacccg

SEQ ID NO: 287102 - DNA, 838 bp, Homo sapiens
  misc_feature: GYAE6OF01CMOY9.49.62.F07.1.454.CMB.1.raw
  modified_base (140)..(140): a, c, t, g, unknown or other
  misc_feature (140)..(140): n is a, c, g, or t
  modified_base (276)..(276): a, c, t, g, unknown or other
  misc_feature (276)..(276): n is a, c, g, or t
tcagagtcgagagacacgaccggtgctcgatttagtagtcgcataaagggaaagggggctgtgggtccaggaggcagaactctgggtgtctcaccatggcctggatccctctacttcctcccctcctcactctctgcacnggctctgacggcctctatgagctgacacacgcccacccgtcggtgtcacgttccggtccccgaggaccacggaccggccgaaggactccgtaccgtcgcttcgtgggatactgactacgttacgaaccgaaacgtnttagtgttactttaagtcgtaaccagtacgaacggtaccggacccgggccgtaccggtcccgttggtttcgggtgggttacgtaagttaacgttaaacgtaaaaccggtacgtaacggtacggaacggtacccggtaccgtacgggaacggttacctcccggtagacgttaccgttcgtttcgttacggtcggtaccgtaccgggtaggtaccggaacggggtaaccaccgttacgtaacgtaggtccgtactacgtacggtacgggtcggaaccggtacggagggaccggaagggaaccgggtagtacggtactttaaggtaacgtttaacgtttacgtaccgtaataaccttaaacgaaccgtaaccgtaacttaccggtttaacgttacggttttaaccttcggtttaaccgttcggttaaccggtacggtaccgtaacccgggtaacggttacccggttaccgtacccgggttacggttcccggaacccgtaccccggtaaccccggaacccgtaacccccgttacccgtaaccgttcccgttaaaccgtttcccccg

SEQ ID NO: 287103 - DNA, 625 bp, Homo sapiens
  misc_feature: GYAE6OF01ACYXW.49.62.F07.1.454.CMB.1.raw
  modified_base (229)..(229): a, c, t, g, unknown or other
  misc_feature (229)..(229): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacacgcccaccctcggtgtcagtcgtccccaggacagacggccaggatcacctgctcgtgganatgctattcgaccaaacgatatgtacttagtcggtaccagcgagacgccgggccacggcccctgtgttggtgtatgtaataacgacacgtagacgacgccctacgacggtactcccgtgacgtcgtattcgtcgtcgctcgaggtcggaggacaacggtcactgttcggcctagtcgaggtggacgtccgaggtacgaggacggacgtacggctagttaacttagttatacgtaactactaacgaacgactaacctaacgttacgttacgttacgttagtcgttacgtacggactcggtaccgtaaccgtacgggtccctacccgggttcgtaccggtaccgaacccgtacccggtaaacccgacccgtaacccgtcgttaccgtcgttaccccgg

SEQ ID NO: 287104 - DNA, 835 bp, Homo sapiens
  misc_feature: GYAE6OF01CMA4V.49.62.F07.1.454.CMB.1.raw
tcagagtcgagagacacgaccggtgctcgatttagtagtcgcataaagggaaagggggctgtgggtccaggaggcagaactctgggtgtctcaccatggcctggactccctctaccttcctcccctcctcactctctgcacaggctctggacggcctctatgacgctacgacacacgccctaccgtcggtgtcacggtccgtacccgaggacgacggaccggacgaggactccaccgtgcctgaggagacgtgactagtaccgaaccgtaaactagtatacgttacgttacgtacggtaccagacgaacggaccggaccggaccgtacggtcccgttggtcggttacggtagtagttaagtaaacgaaacgtactacggtacggaacggaccggtccgtacggaccggtaccgtaccgtacggtacgtacgttacttccgtacggtcggtaccgtaccggtacggtacggaaccggaaccgtaacggtacctaagtacggtaccggactacggtacgtacggtacggtacggtacgacgggacggtaacgggaacgggacggtacggtactaacggttaatttaacgtttagtaaccggtaactaacgtaaccgaaccgtaacgtaaccgttaacgtttaaggttaaccggttaacgtttacgttaccggtaccggttaacgtaaccgttacggaaaccccggttaaacggtacccgggttcccggtacccgggtttaaccgggtaccggtaaacccggtaacccggaacccccggtaaccccggtaaaccccgtaaccccgtttacgggttaacccgttccccgtttaccccgg

SEQ ID NO: 287105 - DNA, 518 bp, Homo sapiens
  misc_feature: GYAE6OF01ASJAD.49.62.F07.1.454.CMB.1.raw
  modified_base (393)..(393): a, c, t, g, unknown or other
  misc_feature (393)..(393): n is a, c, g, or t
  modified_base (464)..(464): a, c, t, g, unknown or other
  misc_feature (464)..(464): n is a, c, g, or t
  modified_base (486)..(486): a, c, t, g, unknown or other
  misc_feature (486)..(486): n is a, c, g, or t
  modified_base (507)..(507): a, c, t, g, unknown or other
  misc_feature (507)..(507): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctccctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccccctgtgttggtgatgtataaagacactgagacgccctcagggatccccgtgagcgatttcctcgtggcctccgaggtccagggacaacggtcactagttggccatcagtcggngtccaggcagaggacggaggctgactatattgtcaatcaacagacacattggtacttatgtctcggactgngaccaggtcaccgtctggtccncgacccgaacggccaaccccnctcgtctaccc

SEQ ID NO: 287106 - DNA, 792 bp, Homo sapiens
  misc_feature: GYAE6OF01CSQ3V.49.62.F07.1.454.CMB.1.raw
  modified_base (112)..(112): a, c, t, g, unknown or other
  misc_feature (112)..(112): n is a, c, g, or t
  modified_base (292)..(292): a, c, t, g, unknown or other
  misc_feature (292)..(292): n is a, c, g, or t
tcagagtcgagagacacgaccggtgctcgatttagtagtcgcataaagggaaagggggctgtgggtccaggaggcagaactctgggtgtctcaccatggcctaggatccctntacttctccccctctcactctctgcactaggctctagaggcctctatgagtcctgacacacgtacccacccgttggtgtaccagttccgtacccccgaggaccgaaggaccggaccgaggacttaccaaccgtggtcctacgtaggaatcgtaggacctagttacgaaccctaaaacgtnttactgtacttacgtacgtaccgagacgaaggaccgccgtacgaccggtccgttagttaggtaggtagtagtaacgtaagtaacgacgtacgtacggacggtaccgtaccgtacggaacggtaccgtaccgtaggtacgtacgtacgttaccgtcgtacgtacccgtacggtaacggtaacggaacggtaaccgtacggtactacgtacgttacggactaacgtacggtacggtacggtaaccgtacggtaacggtaacggtaacggtaacggtacgtaccgttaagtaacggttaactttagttaccggtttaacaaaccgtaacgtaacgtaaacgtaaccgtaacttaaccgttaagttacgttaacgttacgttaccgttaccggtaaccgtaaacgtaccggtaaaccgtaaccggtaacgtacccgtaccggtttacgcgtaaacgtacccggaccgtaacccgaccttaaccgtaacgtccgtacccgtaccg

SEQ ID NO: 287107 - DNA, 716 bp, Homo sapiens
  misc_feature: GYAE6OF01C39I0.49.62.F07.1.454.CMB.1.raw
  modified_base (213)..(213): a, c, t, g, unknown or other
  misc_feature (213)..(213): n is a, c, g, or t
  modified_base (246)..(246): a, c, t, g, unknown or other
  misc_feature (246)..(246): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccacccgtcggtgtcagtcgtccccaggacagacggccaaggntcacctgctctggagatgcattcgaccaaacgntatcgctttagttcggtaccagcaaggaacgccgggaccacggtcccctggttggttggtagacttagtaactaaagaccaacgtggaagacggccccgtacgaagggtactccccgtaggacgtaccggtacttttccgtaccgttcgggtccttaccccgtaaagggttcccgaacgggggtaaactaaacccggggttacaaaccgtagtttcgggaccctaagtaccgtacgggttagggaaccggttacccgaacgggacgaacgggtaacgggaaacggacgggtctaggttacttaagttaatttacggtaactaatacgtaacaacgaacaccttagttacggttacttagttacgttcgttacggtaaccgtaggacccgtaacgtaacggtactacccggttctacggggtacctaacggaacccgaaccgaccccaaccccgtactcgttccgtaaccc

SEQ ID NO: 287108 - DNA, 714 bp, Homo sapiens
  misc_feature: GYAE6OF01BESI0.49.62.F07.1.454.CMB.1.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgacgcctctatgagctgacacacgcccaccctcggtgtcagtcgtcccaggacagacggccaggatcactgctcgtgganatgctattcgaccaaacgntagtcgtacttagttacggaccacgacaggaacggccggccgacggtcctggttcggttaggtataagtagtaacgaaacgactacgtacgaggacgtccctaggaacgggtaccttcccgtaggacggtaccgtaattccgtacgtcggaccgttacccgaacgggtacggaaacgggaacccgtaacggtaccgtaacgtacggtttaccgacctagtaccgtaacgggtacggaacgtaccggaagggacgaacgggtaacgggacgtagggtacctaggtaactttagttaacgtacgtaactaacgtaaccgaaacaacggaaccttacgtaacgtttaacggttaactttacgtcggtacgtttaacggactacgggacctaaccggtaacgtccgttacccggtacggtgggacccaacggccccgtaaaccggaccccaaccgtactacggtactaccccg

SEQ ID NO: 287109 - DNA, 706 bp, Homo sapiens
  misc_feature: GYAE6OF01DELXR.49.62.F07.1.454.CMB.1.raw
  modified_base (182)..(182): a, c, t, g, unknown or other
  misc_feature (182)..(182): n is a, c, g, or t
  modified_base (267)..(267): a, c, t, g, unknown or other
  misc_feature (267)..(267): n is a, c, g, or t
  modified_base (509)..(509): a, c, t, g, unknown or other
  misc_feature (509)..(509): n is a, c, g, or t
tcagagtcgagagacacgaccggtgctcgatttagtagtcgcataaagggaaaggggctgtgggtccaggaggcagaactctgggtgtctcaccatggcctggatccctctacttctcccccctctcactctctgcacaggctctgagcctctatgagctgacacacgcccacccttgggtntcgagtcgtacccccgaggaccacggaccggtccaggactccgacctgccttcgtggaagtctgactattcgaacccaaaacgtnttactgtactttagttacgtaccagacaacggaccggccggtcgaccggtccctggttggttcggtagtaacgttagtaacttaaacggactacgtaggacggtaccggcctaggaacggtcctaccggtaggacgtacttcgtttaccgtccggtcgtacgtaccgtaggacggtaacggacggaaccgtcaacgttatcggactagtccgaggtagaccgcggagacgaggacgaacggngtactagttacttagttattctaaacacttaacgaactaacgtacctaaccttaggtttacccgttaagtttcttacggttaccttaagggtaccctcggtaacccgtaacggtacccgttccgtacccggttacggtccgtacccggtaccgaacccgtaacccgacccctaaccgtcgtaccgtacccgttcccg

SEQ ID NO: 287110 - DNA, 772 bp, Homo sapiens
  misc_feature: GYAE6OF01BO4H4.49.62.F07.1.454.CMB.1.raw
  modified_base (234)..(234): a, c, t, g, unknown or other
  misc_feature (234)..(234): n is a, c, g, or t
  modified_base (238)..(238): a, c, t, g, unknown or other
  misc_feature (238)..(238): n is a, c, g, or t
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctctcactctctgcacgaggctctgacggtcctccgtatggagctgacacacgcccacccgtggtcgtcgagtccgtcccaggactaggaccggctaggctcaccgtgctgnggantcgctagtcgaccaaacgntgtntgttatacgtacagcagacgccggcgacggtcccgtgtgttggtacgtagtagtaacgtaacgacacgtagacggaccggtacccgacggacggtacctaccggtaggtacgtcgtacgttcgtaccggtcggaccgtacggtaacggtacggaacgggtaacccgtaacggtacctaacgtacggtacctaccggtagtacgtaacgggtcgtaaccggccgtaaggggacaagggtacgggaacgtcggtactaacgttacgttaacgttactaacggtaacgacgtaaccaaacgtacggaacctacgttaacggttacgtttaacttacggttacgttaaccgggttacgttaacggaaccgggttacgtaaaccccggtcgggttaaccccgtaccgggttacccggttaccggggaacccccgttaacggtaacccccccgggtaaaacccgtaccccccttaaaaccccggggtacctttaacccgggttccccttaacccggg

SEQ ID NO: 287111 - DNA, 651 bp, Homo sapiens
  misc_feature: GYAE6OF01COUZV.49.62.F07.1.454.CMB.1.raw
  modified_base (179)..(179): a, c, t, g, unknown or other
  misc_feature (179)..(179): n is a, c, g, or t
  modified_base (246)..(246): a, c, t, g, unknown or other
  misc_feature (246)..(246): n is a, c, g, or t
tcagagtcgagagacacgaccggtgctcgatttagtagtcgcataaagggaaagggggctgtgggtccaggaggcagaactctgggtgtctcaccatggcctggatccctctacttctcccctcctcactctctgcacaggctctgagcctctatgagctgacacagcccacctcggtntccagtcgtcccaggacaggacgccaggtatcacctgctcgtggatatgactattcgaccaaaacgnttatgtacttattcggtacagcaacgaacggccggccacggtcccgtgtgttggtgattagtaagtaaagtacacgtagaggaccgacctacgacggactccgtagagtcggtacttcgtccgaggaccttcgacggcgaaggacgaaacgttcgaactgtcgaccgtataccgtaggtaggtacgaaccgagggacctaaggaacggtacggagtacgtaggtaactttagtttaccttaggttaacctaataccgtaaagaacgtaaccgtaaccgtaagttaccgttaagtttaccgttacgttacgtttacggacgttcaacggtaacgaacgggtacctaccggtacctggtaacccacgttacccgaacgaccccgtaacccacttccggtaacctccg

SEQ ID NO: 287112 - DNA, 859 bp, Homo sapiens
  misc_feature: GYAE6OF01EWH7T.49.62.F07.1.454.CMB.1.raw
  modified_base (114)..(114): a, c, t, g, unknown or other
  misc_feature (114)..(114): n is a, c, g, or t
  modified_base (391)..(391): a, c, t, g, unknown or other
  misc_feature (391)..(391): n is a, c, g, or t
tcagagtcgagagacacgaccggtgctcgatttagtagtcgcataaaagggaaagggggctgtgggtccaggaggcagaactctgggtgtctcaccagtggcctggactccctntacttcctcccctcctcactctctgcacagctcgtgacgccttctatgacgctcgaacacgacgccctacccgtggtgtctagtccgtacccgaggacgacggaccggtacgaggtactcacgttcgccgttcggaggaagtacgtgacctaacgttaccggaaacctaaaaccgtattctgttactttacggtacggtaacacggtacaacggaccggtcccggaaccgccggttacccgtggttcggttaggagtacggtaagttaaacgtaaanaccgttaagacggacggtaccggtcccaagggtcggtaacccttccgtaagggacgtacggtttacttccgtagggtacccggtccgttaccgggaacgggttaacgacccggggaaccgttaaaccgtcgtaaacgttccgggtacgtacccgtacgtacggtacgggtaggtccgttacggaacggtaacggaacgggtacggaacgggttacgaccgttaggttaaacttagtttaacttaacgtaaccgttaacgtaacgaaccgtaacgtaacccgttacgtttaacggttacgtttaacgtttacggtttaccgtttacggtaacccttaagggtaacccgttaccggttaaaccgtacccgttacccgggttacccggtacgggttaccggttaccggaaccccgtaacccggtaaccgtaacccccgtacccgttaaacgtcccgtaacccgttaccccg

SEQ ID NO: 287113 - DNA, 693 bp, Homo sapiens
  misc_feature: GYAE6OF01CBZM1.49.62.F07.1.454.CMB.1.raw
  modified_base (256)..(256): a, c, t, g, unknown or other
  misc_feature (256)..(256): n is a, c, g, or t
tcagagtcgagagacacgaccggtgctcgatttagtagtcgcataaagggaaagggggctgtgggtccaggaggcagaactctgggtgtctcaccatggcctggatccctctacttcctccccctcctcactctctcgcacaggctctgacggcctctatgagctgacacacgccaccctcggtgtcagtcgtcccaggacaggacggccaggactcactgctcgtaggagatcgactattacgaccaaaaccgtntacgtagtactttagttacggtaacagacaacggaacggccggaccgaccggtcccgtggttggttaggtagtagttacgttaaacgtaaacgacgtaactggaacggacggtcccgtaggaacgggtacctccgtaggacgtccgtaagttcgtacgtcggtacctacggtacggtaacggaacggtaaccgaacggttaccgaagtttacggtaccgacttacgtacgtacggtaaccggtacggtacgaaggtacgaaacgggtacggaacggtcgggtactacggttaacttagtttaagtacgtaactacgtaacgaatacggtaactagttaacgtttcgttaactaacgttgtaccgttacgactcggacgaacgtacgtacgcgttacgtagaccgaccgacgaaccgtacccaaccgtctcgtccgtc

SEQ ID NO: 287114 - DNA, 760 bp, Homo sapiens
  misc_feature: GYAE6OF01BRERL.49.62.F07.1.454.CMB.1.raw
  modified_base (169)..(169): a, c, t, g, unknown or other
  misc_feature (169)..(169): n is a, c, g, or t
  modified_base (175)..(175): a, c, t, g, unknown or other
  misc_feature (175)..(175): n is a, c, g, or t
  modified_base (183)..(183): a, c, t, g, unknown or other
  misc_feature (183)..(183): n is a, c, g, or t
  modified_base (261)..(261): a, c, t, g, unknown or other
  misc_feature (261)..(261): n is a, c, g, or t
tcagagtcgagagacacgaccggtgctcgatttagtagtcgcataaagggaaagggggctgtgggtccaggaggcagaactctgggtgtctcaccatggcctggatccctctacttctcccctctcactctctgcacacggccctgacggcctcctatgagctgacacncgaccnccgtggtntcagtcgtcccaggacgacggaccggcgaggactccaccgtgacctgtggagtatgctaagtccgaacctaaacggtnttatcgttacttaacggtacgtaaccgagcgaacggaaccggccggaccgtaccggtcccggtggttggttgggacttaagtaaggtaataaacggtctaacggtaggacgtaccggtccgtaggacggtctaccgtggacgtccggttactcgacgttcggccgtagacgggtacgaacggtactacgtcaagtcggtcgaacagtcggtagtcggtactccggagtacgaggtacgggacgtacgggtactaagttacgttaagtttacgtacgtaactaacgtaaccgtaaacgacttaaccgtaactttacggtttaaccgtttaactttcggttacggtttaacccgtacgggtaaccgtaccggtaccgttaaaacccggtcggttaaaccccggtccgggtacgggttacccggtaaccccaaaccgggtaccccgaaaccccgggtacccctaaacccgtggtttaaccctcccgttaaccccttacccgg

SEQ ID NO: 287115 - DNA, 899 bp, Homo sapiens
  misc_feature: GYAE6OF01CKCQ7.49.62.F07.1.454.CMB.1.raw
  modified_base (114)..(114): a, c, t, g, unknown or other
  misc_feature (114)..(114): n is a, c, g, or t
  modified_base (824)..(824): a, c, t, g, unknown or other
  misc_feature (824)..(824): n is a, c, g, or t
tcagagtcgagagacacgaccggtgctcgattttagtagtcgcataaagggaaagggggctggtgggtccaggaggcagaactctgggtgtctcaccatggcctggatcccctntacttcctccccctcctcactctctgcacaggctctggacggtccctctagtgacgcgtcgaaccacgacgcccctacccgttcgggtcgtacgtaggtcccgtacccccggaagggaaccgaggaccccgggaccgtaagggaccttacccgaacccgtttggtcccttaggttacggggaaggtaacttcggtaacttaacgttccggaaacccgtaaaaaccggttgttaacttacggtttacttttaacggttaccggttaaccgaaggtaccgtaacgggacccggtcccgggaccggtacccggtccccgttggttaacggttgggtacgttaacgttaacggttaaacgtaaaacgacccgtaaggttacgggaaccggtacccggtcccgtacgggttaaccggtactcccggtaggtaccggtccgttacttccgtacggtacgggtaccctaccgggtacggtaaccgacggggtaaccgtaacgtcacggttaaccgtcggaacctacgtccggtacgtaccggacgtaccggaggacggtaggacgggaacgtacggttactacggtaacgttaattttccggtaataaaccgtactaacgtaacgtacggttaaccttacgttacgggtttaacttacggttagtaccgggttaccgttaacggaccttacgggtaccgtacgtaccgggttacccncggggttacccgtggaaaccccgtcggaaccccggttaaccctaccccgtaagtcccctccgttacccttccccg

SEQ ID NO: 287116 - DNA, 744 bp, Homo sapiens
  misc_feature: GYAE6OF01BWGTL.49.62.F07.1.454.CMB.1.raw
  modified_base (185)..(185): a, c, t, g, unknown or other
  misc_feature (185)..(185): n is a, c, g, or t
tcagagtcgagagacacgaccggtgctcgatttagtagtcgcataaagggaaagggggctggtgggtccaggaggcagaactctgggtgtctcaccatggcctggatccctctacttctccccctctcactctctgcacaggctctgaggcctctatgacgctgacactcgccctaccctcggtntcgagtcgtccccgagtaccacggaccggccagggtactccaccgtgccttcgtaggagtaactcggacttagttcgaaccccgaaaaccgtattaacgtgttacgtttagttaccggtaccaacggtaccaacggaaccggcccgggaccgaccggtccccgttaggttcgttggggtacagttaagtaacgtaaaacgaccgtacgtaggacggaccgtcccgtacggacggtactcccgtagacgtgtacttcgtcgtacggtcctacgaggtccgtaaggaccgtaaccgtcaacgtagttaccggctaacgtcgaacgggtacgtacggaccgtaggacccgaagggtacggacgtacggacgttacgattacgtagttactactaactacctaaacgagtaccgtaaccgttagtttaccggttaagtttccggtagttacccgggttaacgtaccgttaacggacccggttaccgaaacggtcctacccggtcggtcggtacccgaccgtaccccgaacggttaccccaaaccgtctccggttctaaccccg

SEQ ID NO: 287117 - DNA, 791 bp, Homo sapiens
  misc_feature: GYAE6OF01AWAUT.49.62.F07.1.454.CMB.1.raw
  modified_base (144)..(144): a, c, t, g, unknown or other
  misc_feature (144)..(144): n is a, c, g, or t
  modified_base (536)..(536): a, c, t, g, unknown or other
  misc_feature (536)..(536): n is a, c, g, or t
tcagagtcgagagacacgaccggtgctcgatttagtagtcgcataaagggaaagggggctgtgggtccaggaggcagaactctggggtgtctcaccatggcctggatcccctctacttcctcccccctcctcactctctgcacnggctctggagcctctatgacgcctgaccacaccgccctaccccgtgggttcgtcgaggttccgtaccccccgaagggacaccgggaccgggtccgaacggtactcccaccggttgccgttcggaggtacgtactgtcgtaccgtaccgaaccccgaaacgttatacttgttactttacgtaccgtaaccgaggaaccaacgggaaccggcccgggccccgtaacggtccccgttgggttacgttggggtagtacgttacggtaaacgtaaacgtacgcggtaggaaccgggtcccgtaccggtaccggccggtaccgtaccggtgaccggttacgtacttcggaccgtcggtccaccgtacggtacgggaaccggtaccgtaaccggtaacncgttaacgtcggacttacgacgttggacgcgtacggtacgacgaacggacgggacgtggacgttacgtaattacttcgttaaatccgtaacgtacaacggttacacttaaacttcggttagtactttgttaccgtccggttaacgtaccgtacggtaccgaacccgtcggtaacccgtggggttacccgacggtacccgtaacccgtaacccgggaacccctacccgtaacccggttcgtaccgtccgttacccg

SEQ ID NO: 287118 - DNA, 1016 bp, Homo sapiens
  misc_feature: GYAE6OF01DU3RP.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttcctccccctctcactctctcgcacgaggcctctggacggtcccttcctagtgagctacgaccacgacgaccctacccgttcggtacgtccgacggttccgaccccgaaggtaccgaacgggtaccggccgaaggtacctaccgtacccgttggtaccttcggtacggtagtagttacgaccgttaacgttaccggaaacccgtaaacgtagtttaacgtttaccggtttaacgttttaaggttcccggtaaaccgacggaaccggaaaccggtacccggggtcccgggtaacccggtcccgggtcccggtttagggtttacggggtttacggttaaggtttaagtaacgtttaaaacgtaaaccggtacggtaaccggtaggaaccgggtacccggttaaccccggtagggtaccggttaccgttacccggtaggtaacgtcgtttacgtttccgttcggtaccggtcccgttacgggtaacggtaaccgggtaaccggaacccgtttaacggtcctacggttaccgttcgtaacgtacggtacgtcgggttaaggtacccgtacgggacggtaacgggtaacgggacgggaaccggtacggttaacgttacggttaactttaacgtttacgttaacgaaacccgtaataacccgtaaacgtaacccgttaacgttacgtttaacggttttaccgtttaacgtttaccgtttaaccgggttaccccgttaacgggtaccggtaacccgggttaaccccgttaaaccgggtttacccgggtaccccggtttaccggggtcccggttaacccggggtacccccaaacccggttaaacccccgggaaccccttaaccccggtaaaccccgtttcgtaaacccgttcccccgtttaacccccgg

SEQ ID NO: 287119 - DNA, 854 bp, Homo sapiens
  misc_feature: GYAE6OF01AYZGU.49.62.F07.1.454.CMB.1.raw
  modified_base (111)..(111): a, c, t, g, unknown or other
  misc_feature (111)..(111): n is a, c, g, or t
  modified_base (261)..(261): a, c, t, g, unknown or other
  misc_feature (261)..(261): n is a, c, g, or t
  modified_base (300)..(300): a, c, t, g, unknown or other
  misc_feature (300)..(300): n is a, c, g, or t
tcagagtcgagagacacgaccggtgctcgatttagtagtcgcataaagggaaagggggctgtgggtccaggaggcagaactctgggtgtctcaccatggcctggatccctntacttctccccctctcactctctgcacaggctctggacgtcctacctatgacgctacgacacgtacgccctacccgtggtcgtacgacggttccgtaccccgaaggaccgaggacccggaccgaagggtactcctaccgtcgccttacgngggaatacgtgaacgttacgttacggaaccctaaacgtntaagttcgtactttaggtaccgtaacgacgtacgtaaacggaccgggcccggtaccgaccggttcccggttgggttcggtttacggacggttaacgttaacggttaaacgaaaccgacgtacggtaaggacgggtaacccgtccggtaacgacgggttacctcggtaacggacgttaccttaggttccgtacgtcggtaccgtacgggtacggtaacggtaaccgggtaacgtacggtactacggcgttaacggacctaacgggtacgtcgggtacgtaccgtacggtaacggccggtaaacggacgggtacggtaccgttagtaaccggtttgtttaacttaacgggttacctaacgtaaaccgaaccgttaaccgcgttaacccttacgtaggtttaccggtttaacgttggtttaacccgtacgttacggaaacccgtttacggaaaccggttacggttcccggtaacccgtggggttaaccgccgggtaaccctaacggacccccgtaaaacccgtcccgaaaccgttcgtttaccgtccccgtttaacg

SEQ ID NO: 287120 - DNA, 683 bp, Homo sapiens
  misc_feature: GYAE6OF01CZC8S.49.62.F07.1.454.CMB.1.raw
  modified_base (272)..(272): a, c, t, g, unknown or other
  misc_feature (272)..(272): n is a, c, g, or t
  modified_base (329)..(329): a, c, t, g, unknown or other
  misc_feature (329)..(329): n is a, c, g, or t
  modified_base (636)..(636): a, c, t, g, unknown or other
  misc_feature (636)..(636): n is a, c, g, or t
  modified_base (669)..(669): a, c, t, g, unknown or other
  misc_feature (669)..(669): n is a, c, g, or t
tcagagtcgagagacacgaccggtgctcgatttagtagtcgcataaagggaaagggggctgtgggtccaggaggcagaactctgggtgtctcaccatggcctggatccctctacttcctccccctcctcactctctgcacaggctctgacggcctcctatgagctgaacacagcccacccgttcggtgtcgagtccgtacccccaagggacacggaccggcgaggactccaccgtgctcgtggagtagtcacctagttcgaccgtaaacgtntacgtcgtacttagtacgacagacgagaacggccggtaccacggtccgtgtgttggntacgtagtaataacgtcagtcgacggcgacctgacggcctcgtagacgtgtacttcgcgtgcgtcgacggtcggacggtacgacggtactacgtaggtccgactacgtgacgggtacgtcgtacggacggtcgtaagggaaacgggccggtaacggtcgtaacgtaacgtttaagtttacgttaacgttactaaccgtactaacggaactaccctacggtttagttaaggttacccttgttaccggttacgtacgacggttcgaccaccgttaacggccgtacccggtaggtaccgaccggaacccncccggtaaacccgaccccttaacaccccggttntcccgttaacccgg

SEQ ID NO: 287121 - DNA, 773 bp, Homo sapiens
  misc_feature: GYAE6OF01A2CW0.49.62.F07.1.454.CMB.1.raw
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtaccccaggacaggacggccaggactcaccgtgctctgganatgctagttcgaccctaaaaccgntagttcgtctttagttacggtaacctaggacgaaggaaccggcccgggacccgaccggtcccccgttggttacggttcgggtagtacgttaggttaacgtaaaagtaccgtacgtacggacggaccggtcccctagggtacgggtactccccggtaggaccgtccgtaacttccgtcgttcggcctaccggaggtaccggacgggtaaccgtaacggtacaacgtagttaccgacctagttaccgagggtaccgggtacgtaccggacgggtaacgaacgggaacgggtaacggcggtactacgtactttaagtttacgttacgtactaacgtaaccgaactaacgaaccgtaccttaagttacgttaacttaacgttcgttaaccgttaccgtaagtaccggtaccggtaaaccctaaccgggttcccgtaccccggttaccggttccggtaccgttaaccccgaccggtaacccgggacccccttaaaccccggtcgttaacgttcccggtaacccg

SEQ ID NO: 287122 - DNA, 970 bp, Homo sapiens
  misc_feature: GYAE6OF01EP3S3.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgacgctgaccacacgccctaccccgtgggttcgtcgaggttccggtaccccccgaagggaccgacgggaccgggaccgaaggggtaccttccgaccgttggccttccggtgggaagtagtcgacctagttccgaacccaaacgtattagtcgtacgtttagttcggacctacggacgaacggaaccggcccgggtaccgaccggtcccccgttgggttcgggtttagggtaggtaggttacggttaaaagtaaaaccggtacctaaccgggttagggaaccggtaaccgggttcccccgtaacgggaccgggtacccgtttaccccggagggtaaccggtaccgtttaaccgtttccggttccggttacccgggttaccgtaacccgggtacgggtaaccgggtaaccggggtaaccgtaaaccggggtacctaacggttacggttaccggactaacggtacgtacgggtacggtaccggtacgacgggacgtaacgggaacgggtacggacgtacggtacgttacgtttaagtttcgttaacggtactaacgtaaccgtaaacgtaaccgtaaaccggttaaccgttaacgggttttacgtttaaccggttttaacgttaccggtttaccggttaaaccggtaaccggttacccgggtaacccggtaaaccggggtaacccgtttaccccgggtacccgggtttacccgggtacgggttaaccccggaaccccggtttaaccccgggaaacccccgttaccccccgttaaacccccggttaccgtttcccggtaaccccgtttacccccgg

SEQ ID NO: 287123 - DNA, 769 bp, Homo sapiens
  misc_feature: GYAE6OF01DPE3B.49.62.F07.1.454.CMB.1.raw
  modified_base (141)..(141): a, c, t, g, unknown or other
  misc_feature (141)..(141): n is a, c, g, or t
  modified_base (192)..(192): a, c, t, g, unknown or other
  misc_feature (192)..(192): n is a, c, g, or t
  modified_base (276)..(276): a, c, t, g, unknown or other
  misc_feature (276)..(276): n is a, c, g, or t
tcagagtcgagagacacgaccggtgctcgatttagtagtcgcataaagggaaagggggctgtgggtccaggaggcagaactctgggtgtctcaccatggcctggatccctctacttcctccccctcctcactctctgcacnggctctgacggccttcctagtgagctagacacgtacgcccaccctcgggtntcagttccgtcccaggaccacggaccgccgaggtactccaccgtgacctcgtggatactgaccttgtaccgaaccgtaaaccgnttaacgtgtacctttaggttaccggtaccgacgtaccgaacggaccggcccggacccgacccgggttcccgttaggttcggttcgggtaggtaatttgggtaaaactaaacggaccgttaacggcgggtaaggcccgggtaccctacgggaacggggttaccgttaccccgtagggaccgttaccggttcgtttcggttccgtaggggttcccctagggttaaacgggccggaacgggttaacaccgggttacaacgttcggttacgactacgacgtaggtacgtcggtacgaggacggacggacggacgtccggtgttaacgttacgtttagttacgtttccgtacgtaccggtacgacggtacgaacgacgtccgggtagtcgtagtacgttcgttaggttacgttcggtccgggtagggacgtacgttcgtacggttccgaccggtcgttaaccggtcgaaccgccggtaacgcccggtcccgtccccgg

SEQ ID NO: 287124 - DNA, 944 bp, Homo sapiens
  misc_feature: GYAE6OF01BHEO0.49.62.F07.1.454.CMB.1.raw
  modified_base (188)..(188): a, c, t, g, unknown or other
  misc_feature (188)..(188): n is a, c, g, or t
tcagagtcgagagacacgaccggtgctcgatttagtagtcgcataaagggaaagggggctgtgggtcaggaggcagaactctgggtgtctcaccatggcctggatccctctacttctccccctcctcactctctgcacgaggctctgacggcctcctatgagcgtgacacacgcccacccgttcggtntcgagtcgtacccccagggaccacggaccggtccgaaggtactccaaccgttgccgttccgttagggaagtagtcgtactaagttacgaaacccgtaaaaccgtattaacgtcgttaccgttttaggttaaccggttaccgaacggacgtaagggtaaaaccgggcccggggtaacccgtaaccggggtcccccgtttaggggtttggtttacgggtacggttaagttaacggtaaacgttaaaacggaaccgtaccggtagaacgggtaacccggtcccggttaacggaacggggttacccgtaccggtcgggtaccggtaccgttaaccgttcggttacgtacggggttcccctacgggtaacggggtaaacccggttaggggaaacccggtaaccgttacgtaacggtacgggttacccaaccgtaagttaccggtaaggggttccggaacggtaccgggtaaacgggaacccggtaaggggaaccgggtaaccggtacgggtaaccgttaaaccggtaagttttaaccggttatttaccgggtaaacctaacgtaaaccggaaacctacggttaacccgtaaacgttagtttaaccggggtttaactttaccgggtagtttacccgtaggtaaacccgtacggttacggaaaccggttacgtacccggttaaacccggtcggttaaccgggaccgacccgaaaacccggtaccgtaccccctaacccggtactcccgttaaccttaccccgg

SEQ ID NO: 287125 - DNA, 151 bp, Homo sapiens
  misc_feature: GYAE6OF02GMN2Y.49.62.F07.1.454.CMB.1.raw
  modified_base (151)..(151): a, c, t, g, unknown or other
  misc_feature (151)..(151): n is a, c, g, or t
tcagagtcgagagacacgaccggtgctcgatttagtagtcgcataaagggaaagggtttagtagtccataaagggaaggggctggccctgacgtgtttctgttcccgccctcctctctctcgactctgagcgggctggcaaggcgcatagn

SEQ ID NO: 287126 - DNA, 503 bp, Homo sapiens
  misc_feature: GYAE6OF02I9LDP.49.62.F07.1.454.CMB.1.raw
  modified_base (492)..(492): a, c, t, g, unknown or other
  misc_feature (492)..(492): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatcccctgagcgattctctggctccaggtcagggacaacggtcacattggccatcagtggagtccaggcagaggacgaggctgactattattgtcaatcaacagacacattggtacttatgtcttacgaactgcgacaggtcaccgtctgggtcagcccaaggcccaacccnctcgtctaccg

SEQ ID NO: 287127 - DNA, 504 bp, Homo sapiens
  misc_feature: GYAE6OF02FZHV8.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggccccctgtgttggtgatgtataaagacactgagaggccctcagggatccctgagcgattctctggctccaggtcagggacaacggtcacattggccatcagtggagtccaggcagaggacgaggctggactattatgtcaatcaacagacaccattggtacttatgtcttcgaactgcgaccaaggtcaccgtcctggtcagcccaggcccaaccccactcgctacc

SEQ ID NO: 287128 - DNA, 503 bp, Homo sapiens
  misc_feature: GYAE6OF02GS2RR.49.62.F07.1.454.CMB.1.raw
  modified_base (418)..(418): a, c, t, g, unknown or other
  misc_feature (418)..(418): n is a, c, g, or t
  modified_base (494)..(494): a, c, t, g, unknown or other
  misc_feature (494)..(494): n is a, c, g, or t
tcagagtcgagagacacgaccggtgctcgatttagtagtcgcataaagggaaaggggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcgagggatccctgagcgattctctggctccaggtcagggacaacggtcacattggccatcagtggagtcaggcagaggacgaggctgactattatgtcaatcaanagacaccattggtactttatgtcttacggaactgacgaccaaggtcaccgtctggtcagcccaacggcccaacccnctcgctacc

SEQ ID NO: 287129 - DNA, 515 bp, Homo sapiens
  misc_feature: GYAE6OF02H7H1S.49.62.F07.1.454.CMB.1.raw
  modified_base (421)..(421): a, c, t, g, unknown or other
  misc_feature (421)..(421): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaaccgatatgcttattggtaccagcagaagccgggccaggcccctgtgttggtgatgtataaagacactgagaggccctcagggatccctgagcgattctctggctcaggtcagggacaacggtcacattggccatcagtggagtcaggcagaggacgaggctgactattattgtcaatcaanagacaccattggtacttatgtcttacgaactgacgaccgaaggtccaccgtccgtgggtacacgacccaacggcccaaccccactcgtctaccg

SEQ ID NO: 287130 - DNA, 510 bp, Homo sapiens
  misc_feature: GYAE6OF02HVJ0K.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctggactattattgtacaatcaacagacaccattggtacttatgtcttacggactgacgacaaggtcaaccgtcctgggtcagcccaaggcccaaccccgactcgctaccg

SEQ ID NO: 287131 - DNA, 527 bp, Homo sapiens
  misc_feature: GYAE6OF02H3EZW.49.62.F07.1.454.CMB.1.raw
  modified_base (449)..(449): a, c, t, g, unknown or other
  misc_feature (449)..(449): n is a, c, g, or t
tcagagtcgagagacacgaccggtgctcgatttagtagtcgcataaagggaaagggggctgtgggtccaggaggcagaactctgggtgtctcaccatggcctggatcccctctacttctccccctcctcactctctgcacaggctctgaggcctcctatgagctgacacagccaccctcggtgtcagtgtccccaggacagacggccaggatcacctgctctggagatgcattgccaaacgatatgcttattggtaccagcagaagccgggccaggcccctgtgttggtgatgtataaagacactgagaggccctcgagggatccctgagcgattctctggctccgaggtcagggacaacgggtcactagttggccatcgagtggagtccaggcaggaggacgaggctggaacttattattgtacaatcaacagacacattggtacttntcgtcttacggatgacgaccgtaaggtccaccgttctgggttacacggacccaacggcccaaccccgatcgtctaccg

SEQ ID NO: 287132 - DNA, 523 bp, Homo sapiens
  misc_feature: GYAE6OF02GBXU6.49.62.F07.1.454.CMB.1.raw
  modified_base (317)..(317): a, c, t, g, unknown or other
  misc_feature (317)..(317): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctnagggatccctgagcgattctctggctccaggtcagggacaacggtcacattcggccatcagtggagtccaggcagaggacgaggctagactattattgcaatcaacagacacctattggtacttatgtcttacgaacttgacaccgtaaggtccaaccggtcgtacgggtccaggcccgaaggccccaaccccgactcgtctaccg

SEQ ID NO: 287133 - DNA, 558 bp, Homo sapiens
  misc_feature: GYAE6OF02GJGQN.49.62.F07.1.454.CMB.1.raw
  modified_base (355)..(355): a, c, t, g, unknown or other
  misc_feature (355)..(355): n is a, c, g, or t
tcagagtcgagagacacgaccggtgctcgatttagtagtcgcataaaggaaagggggctcgtaggggtcccaggagggctaccgaacgtctcgggtcgtcctacaccatcggccctggggatccctcgtacgttcctcccccgtccttcaccttcgtcctaggcacctacggctctcgaggccttcctaatggagcgtgaacgaccagccaaccctcggtgtcagtgtccccaggacagacggccaggatcacctgctctggagatgcattgccaaaccgatatgcttattggtaccagcagaagccgggccaggccccctgtgttggtgatgtataaagacactgagagccctnagggatccctgagcgattctctggctccgaggtcaggacaacggtcacattggccatcagtggagtccaggcagaggacgaggctgactattattgtcaatcaacagacaccatttaggtactttagtgtcttacggaacttcgacgacaaggtccaaccgtcctgggttccagacccaacggccccaacccactcgtctacc

SEQ ID NO: 287134 - DNA, 506 bp, Homo sapiens
  misc_feature: GYAE6OF02GOFUH.49.62.F07.1.454.CMB.1.raw
  modified_base (316)..(316): a, c, t, g, unknown or other
  misc_feature (316)..(316): n is a, c, g, or t
  modified_base (421)..(421): a, c, t, g, unknown or other
  misc_feature (421)..(421): n is a, c, g, or t
tcagagtcgagagacacgaccggtgctcgatttagtagtcgcataaagggaaaggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctnagggatccctgagcgattctctggctccaggtcagggacaacggtcacattggccatcagtggagtccaggcagaggacgaggctgactattattgtcaatcaanagacaccattggtacttatgtcttacggactgacgacaaggtcaccgtcctgggtcagcccaaggcccaaccccactcgtctacc

SEQ ID NO: 287135 - DNA, 502 bp, Homo sapiens
  misc_feature: GYAE6OF02IWQW1.49.62.F07.1.454.CMB.1.raw
  modified_base (316)..(316): a, c, t, g, unknown or other
  misc_feature (316)..(316): n is a, c, g, or t
  modified_base (492)..(492): a, c, t, g, unknown or other
  misc_feature (492)..(492): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctnagggatccctgagcgattctctggctccaggtcagggacaacggtcacattggccatcagtggagtccaggcagaggacgaggctgactattatgtcaatcaacagacaccattggtacttatgtcttcgaatgacgacaaggtcaccgtcgtggtcagcccaaggcccaaccccnctcgctaccg

SEQ ID NO: 287136 - DNA, 522 bp, Homo sapiens
  misc_feature: GYAE6OF02HMS72.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgtacaggctctgaggcctcctatgagctgacacagccaccctcggtgtcagtgtccccaggacagacggccaggatcacctgctctggagatgcattgccaaaccgatatgcttattggtaccagcagaagccggcaggcccctgtgttggtgatgtataaagacactgagaggccctgagggatcccgtgagcgattctctggctcaggtcaggacaacggtcacattggcatcagtggagtccgaggcagaggacgaggctgacttattagttgtacaatcaacagaccacctattgtacttatgttacttacggaacttgcgacgaggtccaaccggtcctgggtccacgtacccgaacgcccaacccacgtcgtccacttccg

SEQ ID NO: 287137 - DNA, 619 bp, Homo sapiens
  misc_feature: GYAE6OF02FWA2Q.49.62.F07.1.454.CMB.1.raw
tcagagtcgagagacacgaccggtgctcgatttagtagtcgcataaagggaaagggggctgtgggtccaggaggcagaactcgtgggtgtctcaccatggcctggactccctctacttcctccccctcctcactctctgcacaggctctgaggcctcctatgagctgacacacgcccaccctcggtgtcagtcgtccccaggacaggaccggccaggatccacctgcctcgtggagatgctattcgacccaaaaccgatatgtctttagttcggtaccagcaagaacggccgggccacggcccctgttggttggtgatgtaataaagacactgagacggccctgagggactcccgtgacgcgtacttctcgtcggcctccgtaggtcgagggaaccaacggtcacgtagttcggactatcgaggtggacgtccgaggcaggacgggacgaggctagaacttatttagttgtactaatacaaacacgaaccactagtttacggtaactttagtcgttacgttacggaacttcgaccgaaccgtaacggtcccaacccgttccggtacgggtaccaccggacccgaacggacccccaacccctcgttaccgtcctaacccg

SEQ ID NO: 287138 - DNA, 507 bp, Homo sapiens
  misc_feature: GYAE6OF02GLHFA.49.62.F07.1.454.CMB.1.raw
  modified_base (242)..(242): a, c, t, g, unknown or other
  misc_feature (242)..(242): n is a, c, g, or t
  modified_base (498)..(498): a, c, t, g, unknown or other
  misc_feature (498)..(498): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcagggatccccgtgagcgattctctggctccaggtcagggacaacggtcacattggccatcagtggagtccaggcagaggacgaggctgactattattgtcaatcaacagacaccattggtacttatgtcttcggaactgacgaccaaggtcaccgtccgtggtcagcccaaggcccaacccnctcgctacc

SEQ ID NO: 287139 - DNA, 494 bp, Homo sapiens
  misc_feature: GYAE6OF02FZE0A.49.62.F07.1.454.CMB.1.raw
  modified_base (239)..(239): a, c, t, g, unknown or other
  misc_feature (239)..(239): n is a, c, g, or t
tcagagtcgagagacacgaccggtgctcgatttagtagtcgcataaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattatgtcaatcaacagacaccattggtacttatgtcttcggaactgcgacagtcacgtctggtcagcccaagccacccactgcactctccg

SEQ ID NO: 287140 - DNA, 525 bp, Homo sapiens
  misc_feature: GYAE6OF02F557Z.49.62.F07.1.454.CMB.1.raw
  modified_base (242)..(242): a, c, t, g, unknown or other
  misc_feature (242)..(242): n is a, c, g, or t
  modified_base (317)..(317): a, c, t, g, unknown or other
  misc_feature (317)..(317): n is a, c, g, or t
  modified_base (409)..(409): a, c, t, g, unknown or other
  misc_feature (409)..(409): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggccccctgtgttggtgatgtataaagacactgagaggccctnagggatccctgagcgattctctggctccaggtcagggacaacggtcacattggccatcagtggagtccaggcagagacgaggctgactattnttgtcaatcaacagacaccattggtacttagtgtcttacggaacttcgacgtaccaaggtccaccggttccgtgggtccacggcccaaggcccaaccccgacgtcgtacctaaccg

SEQ ID NO: 287141 - DNA, 521 bp, Homo sapiens
  misc_feature: GYAE6OF02IDNOV.49.62.F07.1.454.CMB.1.raw
  modified_base (244)..(244): a, c, t, g, unknown or other
  misc_feature (244)..(244): n is a, c, g, or t
  modified_base (447)..(447): a, c, t, g, unknown or other
  misc_feature (447)..(447): n is a, c, g, or t
  modified_base (461)..(461): a, c, t, g, unknown or other
  misc_feature (461)..(461): n is a, c, g, or t
  modified_base (472)..(472): a, c, t, g, unknown or other
  misc_feature (472)..(472): n is a, c, g, or t
  modified_base (492)..(492): a, c, t, g, unknown or other
  misc_feature (492)..(492): n is a, c, g, or t
  modified_base (513)..(513): a, c, t, g, unknown or other
  misc_feature (513)..(513): n is a, c, g, or t
  modified_base (519)..(519): a, c, t, g, unknown or other
  misc_feature (519)..(519): n is a, c, g, or t
tcagagtcgagagacacgaccggtgctcgatttagtagtcgcataaagggaaagggggctgtgggtccaggaggcagaactctgggtgtctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaatntgcttgtgtaccagaagaagtcaggccaggccccggtgttgctcatctatgacgacagaaaacgccctcgggatccctgagagattctctggcctccacctcacgggaccagtcggcctacgttcgacttatcgaggcggggcccagggtggaggatggaaaggtgactactattgttactcaccagacacagtagaaatcanagagaatagtcggngaggacaagcngaccgtcagtcagccgagcncgcccctgcactctcgtcccncctccntc

SEQ ID NO: 287142 - DNA, 556 bp, Homo sapiens
  misc_feature: GYAE6OF02GQ7OF.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctacgagggactccctagacgcgatttctcgtcggctccgaggtcgagggacaacggtcacagttcggccatcagtggacgtccaggcaggaggacgaggctgactattagtgtacatacaacagaacacgtattaggtacttagtgtacttacggaactggaccgaaccgtaacggtccaacccggttccgtagggtaccgacgacccgaacggaccccaaccccgacgtcgacctaaccg

SEQ ID NO: 287143 - DNA, 749 bp, Homo sapiens
  misc_feature: GYAE6OF02G5U2V.49.62.F07.1.454.CMB.1.raw
tcagagtcgagagacacgaccggtgctcgatttagtagtcgcataaagggaaaggggacgtgtgggtccgaggaggcgagaactctgggtgtctcaccatggcctggatccctctacttctcccctcctctactctcgtcacacgcgctctggcggtccctacctagtgacgtctacgacacgcgacccctacccgtcggtcgtctacggttcccgtccccgaaggaccgaacggaccggaccgaaggtactcccaccgtggccttcggtagggaatctcgactagttccggaaacccaaacgtattacgtcgtacttagtacgtaccgagtacgaacgaacggccggacgacccggcccgttggttcggttcggtagtagttagtaaacgaaacgtacgacgtaggacgtaccgggtccctacggaacggtccgtacccgtaggacgtacgttacttccgtacggtcgtccgtaccggtaggtacggaacgggtaaccgtaacgggttaccaacgtacggttaccgacctacgtacgtacggtacgggtacctaccggacggtacgaagggaacgggaccggaagtccgtaagtaaccgtttagttattcgaacgtaactacgaacgtaacgacctacgtaagtttagttacttagtccgttacgtaacgactcgtacgaactacggtcgtaccgtacggtcggtacaccggtaccgaccggtaacccctaccgtcgtccgtacgtcc

SEQ ID NO: 287144 - DNA, 651 bp, Homo sapiens
  misc_feature: GYAE6OF02GBUOP.49.62.F07.1.454.CMB.1.raw
  modified_base (249)..(249): a, c, t, g, unknown or other
  misc_feature (249)..(249): n is a, c, g, or t
  modified_base (297)..(297): a, c, t, g, unknown or other
  misc_feature (297)..(297): n is a, c, g, or t
tcagagtcgagagacacgaccggtgctcgatttagtagtcgcataaagggaaaggggctgtgggtccgaggaggcagaactctgggtgtcctcaccatggccctggattccctctacttctcccctcctcactctctgcacaggctctgaggcctcctatgagctgacgtacagcctaccttcggtgtcagtgtcccaggacagacggctaggatcaccgtgctcgtggagatgcattgaccaaaccgntatgcttattggtaccagctagaacgccgggcaggccctgtgttggtnagtgtagtaaacgcacgtgagacggaccgtcgagggactcccgtgacgcgattcgtactggctccgaggtcaagggacaacggtcaacgtacgtttcgggacctatcgaaggtacggacgtaccgaggccgtaacggaggtaaccggaacggcgttagaacgtttaatttacgttagtacctaaatacaaactacgtaccaccgtagtttacggtaactttagtacgttacgttaaacgggacttacggaccgtaaccgtaacgggttcctaacccggtttccgttaggggttaccctacggttaccccgtaaacgggtaccccaaaccccgtccgttacgtaccctaacccgg

SEQ ID NO: 287145 - DNA, 524 bp, Homo sapiens
  misc_feature: GYAE6OF02GXZYV.49.62.F07.1.454.CMB.1.raw
  modified_base (242)..(242): a, c, t, g, unknown or other
  misc_feature (242)..(242): n is a, c, g, or t
tcagagtcgagagacacgaccggtgctcgatttagtagtcgcataaagggaaaggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgntatgcttattggtaccagcagaagccgggccaggcccctgtgttggtgatgtataaagacactgagaggccctcagggatccctgagcgattctctggctcaggtcagggacaacagtcacgttgaccatcagtggagtccgggcaggaggacgaggctgacttattactgtcagtcatcagacagtagtggactacttcgtgttcgtagttcgggcggagggaccaaggcgtacggaccgttcgtaggtcaacgtcccgaaggcctacggcccccttacgg

SEQ ID NO: 287146 - DNA, 520 bp, Homo sapiens
  misc_feature: GYAE6OF02ISPDE.49.62.F07.1.454.CMB.1.raw
  modified_base (484)..(484): a, c, t, g, unknown or other
  misc_feature (484)..(484): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatggtataaagacactgagacggccctcgagggactcccgtgacgcgtattctctggctccgaggtcagggacaacggtcacattcggccagtcagtcggagtccgaggcaggaggacgaggctgacttattattgtacatcaacagaccactattgtacttattgtactgactgacgaccaggtcaccgtccnggtcacgaccacggcccaacccgtactcgtctaccc

SEQ ID NO: 287147 - DNA, 524 bp, Homo sapiens
  misc_feature: GYAE6OF02F60PC.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcaggaggacgaggctgactattattgtcaatcaacagacacctattaggtacttatgttcttacggaactgacgaaccgaaggtccaccgttccgtgggtacaggcccaacggcccaaccccactcgtacctaccg

SEQ ID NO: 287148 - DNA, 793 bp, Homo sapiens
  misc_feature: GYAE6OF02JW8BI.49.62.F07.1.454.CMB.1.raw
  modified_base (212)..(212): a, c, t, g, unknown or other
  misc_feature (212)..(212): n is a, c, g, or t
  modified_base (277)..(277): a, c, t, g, unknown or other
  misc_feature (277)..(277): n is a, c, g, or t
  modified_base (709)..(709): a, c, t, g, unknown or other
  misc_feature (709)..(709): n is a, c, g, or t
tcagagtcgagagacacgaccggtgctcgatttagtagtcgcataaggaaaggggacgtgtgggtccgaggaggcagaactctgggtgtctcaccatggcctggataccctctacttctcccctcctcactctctgcacaggctctgaggcctcctatgagccgtacactagccaccctcggtgtccagtgtccccaggacgacgacggccnggaacttcaccgtgacccgtatgggacgtaacttggaccactttacggacccaaaaaccgggttnttacttacggtcttacgtacggtaccaacgtacggacgtacggttaccgaccggtcccgtcgttcggtacggtagttagtagtaccgaactaactttactttaacggcggtttaccccggtaaccggggttacgtaccgtcggacgtcgtacgttacgaccgttacccggaaccgtacgggtctccgaacgggtaccggtacggaacgtaacggtaccgtacgtaccgtaacggttacgacggtacgtacgggtaccggtaacggcccgggtaaccggtaaacgggtaacggtaaccggtaacggtaacgttaacggttacgaaaccgtaaacgttaacgttaacgtaacgtaacgtaacctactaacgttaacgttaacgtacgtacgttacggtaacgttacgacgtaccgtaacgtacgaccgtaccgngttaccgtaaccgtggtaccgtaaccgtaccgtaccgtaccgtacccgtacccgtacccgtaccccgtacccgttcccgtaccc

SEQ ID NO: 287149 - DNA, 568 bp, Homo sapiens
  misc_feature: GYAE6OF02G1OA9.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcgagggatccctgacgcgattctctggctccgaggtcagggacaacggtcacagttcggaccatcgagtggacgtccgaggcagaggacgaggctagacttattattgtactaatcaaacagaaccaccgtattcggtaacttagttgttacttacggaacttcggaccgtaaccgaagggttcctaacccggttccgtcgggtaccaacggaccccgaacgggccccaaaccccacgttcgtacctaaccg

SEQ ID NO: 287150 - DNA, 536 bp, Homo sapiens
  misc_feature: GYAE6OF02GHXC8.49.62.F07.1.454.CMB.1.raw
  modified_base (316)..(316): a, c, t, g, unknown or other
  misc_feature (316)..(316): n is a, c, g, or t
  modified_base (348)..(348): a, c, t, g, unknown or other
  misc_feature (348)..(348): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctnagggactcccgtgagcgattctctggctccgnggtcgagggacaacggtcacagttcgggccatcaggtggacgtccgaggcaggaggacggaggctgactattagttgtacaatacaacagaacactattggtaactttagtcgggttgtcgggcggagggaccaggcgtgaccgtcgtaggtccaggtcccaaggcctcgtccccgtcggtcctaccg

SEQ ID NO: 287151 - DNA, 618 bp, Homo sapiens
  misc_feature: GYAE6OF02HILID.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattcgaccaaaccgatatgcttattggtaccagcagagccggcacggccctgtgttggtgtatgtataaagacacgtagagacggcctacgacggtactcccgtgacgcgtacttcgtctggtctccgaggtcgaacgggacgaacggtcactacgtacggcctagtcgagtggacgtcgaggacaggacggacgaggcgtgaacttagtttagttacgtactaatacaaacgacgtaacctaacctagtttacggttaactttagttacggttaccgttacggtaacgttcggaccgtaccgtaacggtccgtaacccgttccggtgggtacctaaccggacccggtaaccggtaccccgtaaaccccgtacgttccgtacctaacccg

SEQ ID NO: 287152 - DNA, 524 bp, Homo sapiens
  misc_feature: GYAE6OF02FQEAF.49.62.F07.1.454.CMB.1.raw
  modified_base (244)..(244): a, c, t, g, unknown or other
  misc_feature (244)..(244): n is a, c, g, or t
  modified_base (425)..(425): a, c, t, g, unknown or other
  misc_feature (425)..(425): n is a, c, g, or t
  modified_base (514)..(514): a, c, t, g, unknown or other
  misc_feature (514)..(514): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgcccaaaaccgntatgcttattggtaccagcagaagccggccaggcccctgtgttggtgatgtataaagacactgagacggccctgagggactccctgagcgatttcctctggcctccgaggtcaagggacaacggtcacgtattcggccatcgagtggagtccaggcagaggacgaggctggactagttatntacatcaacgagacactagttgtacttatgtcttacgactgacgacaggtccaccgtcgtcggtacacgccctaacggcccaaccccgntcgtctaccg

SEQ ID NO: 287153 - DNA, 504 bp, Homo sapiens
  misc_feature: GYAE6OF02ITILW.49.62.F07.1.454.CMB.1.raw
  modified_base (243)..(243): a, c, t, g, unknown or other
  misc_feature (243)..(243): n is a, c, g, or t
  modified_base (451)..(451): a, c, t, g, unknown or other
  misc_feature (451)..(451): n is a, c, g, or t
  modified_base (497)..(497): a, c, t, g, unknown or other
  misc_feature (497)..(497): n is a, c, g, or t
  modified_base (500)..(500): a, c, t, g, unknown or other
  misc_feature (500)..(500): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgntatgcttattggtaccagcagaagccgggccaggcccctgtgttggtgatgtataaagacactgagacggccctcgagggactccctgacgcgattctcgtggctccgaggtcaagggacaacggtcacgattggccatcgagtggagtccaggcagaggacgagctgactattatgtcaatcaacagacactattgtacttagtgtnttcgactgacacaggtcaccgtctggtcagcccgaagcccaacccnctnctac

SEQ ID NO: 287154 - DNA, 535 bp, Homo sapiens
  misc_feature: GYAE6OF02GYCBS.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacagactctgaggcctcctatgagctgacacagcccaccctcggtgtctgtgtcctcaggacagacggccagtatcacctgctctggagatgctattgaccaaaagcaatatgcttactggtaccagcagaagccaggccaggcccctgtcttgatcatttaataaagtactttgagacgggcctcgacgggacccctgagcgattctctggctccagctcagcgacaacgagtcacgttgacctatcagtggagtccgggacaggaggacgaggtctagactagttactgtactagtcatcagactagtagtgactacttcgtgtacgtacgttacgggcgggaacggaccaaggtccgtacggaccgttccgtaggtcgacggaccaagggtcccg

SEQ ID NO: 287155 - DNA, 965 bp, Homo sapiens
  misc_feature: GYAE6OF02HEX3B.49.62.F07.1.454.CMB.1.raw
tcagagtcgagagacacgaccggtgctcgatttagtagtcgcataaagggaaagggggctgtgggtccaggaggcagaactctgggtgtctcaccatggccctggactccctctacttccctccccctcctcactctctgcacgaggctcgtggacggtcccttacctagtggacgtctacgaaccaacgaccgaccccctaccccggttcgggttcgtaccgtaacggttcccgtacccccgaagggaaccgaacgggacccgggaccgaagggtactacccgaccgtcgtccttcggtagggaagtacgtcggactagttccgaaaccccgaaaaccgtattacgtcgtacttttaagttaccggtaaccagacgaaaggaaccgggccccggaccgaccggtccccttggttggtttgggtagtacgttagtaaagtaaaacgacctacgtaggacggaccggtaccctacggaggtacccttccggtaggacgtcgttacttccgtcgtcggtcctaccggtaggtaccggaacgggtaaaccgtaaccggtcaacgtagttccgggacctacgtacgtagggtacggtacgtaccggaagggacgaagggtaacgggacggaacgggtcgtaacggttaactttaacgtttacggtttacggtaacctaaacgttaacccgaaaacgtaaaccggtaaccccgtaacgtttaagggttttaaccgggttttaaactttacggttttacccgtttaacccgggtttaaaccgggtaaccgttaccgggtaaccccggtaaacccggttaaccgggttaacccccggttaaccccggtttaccccgggttacggggttaaccccgaaccccgggtaaaccccccggtaaaccccggggtaaaccccccctaaacccccccgggtttaacgtttaccccggtaaccccgtttaaccccccggg

SEQ ID NO: 287156 - DNA, 617 bp, Homo sapiens
  misc_feature: GYAE6OF02J0SKP.49.62.F07.1.454.CMB.1.raw
  modified_base (244)..(244): a, c, t, g, unknown or other
  misc_feature (244)..(244): n is a, c, g, or t
  modified_base (284)..(284): a, c, t, g, unknown or other
  misc_feature (284)..(284): n is a, c, g, or t
  modified_base (454)..(454): a, c, t, g, unknown or other
  misc_feature (454)..(454): n is a, c, g, or t
tcagagtcgagagacacgaccggtgctcgatttagtagtcgcataaaggaaaggggacgtgtgggtccgaggaggcgagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaaccgntatgcttattggacagcagaagccggaccaggcccctgtntggtgatgtataaagcacgtgaggacggcctagagggacttccctggaacgcgactttcgacgtggcctaccgaggtcgaagggacctaacgggtcaacgtagttcgggaccagtacaggtacggaggtcccgggcaacggaggacggaggcgtagacgttaagttacgngttaccgaagttcaacgttacgaacgtactaagtagtcggactacgttctgtacgtacgttcggcgggtaagggtaccgaaggtccgtacggtacccgttacccgttaagggtaccgtaaccggacccctaagggcccgttacccggcccccgtttacccggg

SEQ ID NO: 287157 - DNA, 491 bp, Homo sapiens
  misc_feature: GYAE6OF02F415S.49.62.F07.1.454.CMB.1.raw
  modified_base (483)..(483): a, c, t, g, unknown or other
  misc_feature (483)..(483): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgagctgactattatgtcaatcaacagacacattggtacttatgtctcgatgacgacaaggtcaccgtcaggtcagcccagccaacccnctcgctac

SEQ ID NO: 287158 - DNA, 555 bp, Homo sapiens
  misc_feature: GYAE6OF02IUG6P.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctctatgagctgacacagccaccctcggtgtcagtgtccccaggacagacggccaggatcacctgctctggagatgcattgaccaaaaccgatatgcttattggtaccagcagaagccggccaggcccctgtgttggtgatgtataaagacactgagacggccctacgagggactccccgtagagcgattctcgtggctccgaggtcgaagggacaacggtcactagttcggcatcgagtggatccaggcaggaggacgagctgacttagttattgtacaatcaacagacacctattggtacttatgtcttacggaacttgacgaaccgtaagggtccaacccggttcgtcgggtacaacggacccgtaacgggacccctaaaccccgacgttcgaccctaccg

SEQ ID NO: 287159 - DNA, 550 bp, Homo sapiens
  misc_feature: GYAE6OF02IADAG.49.62.F07.1.454.CMB.1.raw
  modified_base (359)..(359): a, c, t, g, unknown or other
  misc_feature (359)..(359): n is a, c, g, or t
  modified_base (392)..(392): a, c, t, g, unknown or other
  misc_feature (392)..(392): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccacggccctgtcttgatcatttataaagactttgagaggcctcgagggacccctgagcgattctctggctccagctcagcgacaacncgtcacgttgacctatcgagtggacgtccgggnaggagggacgaggctagacttattactgtcagtcatcaagacgtagtagtggactacgtttcgtgtcgttacggtttcgggcgggtaacgggaacctaacggtccgtcggacccgttaccggttaggttaccgacggtacccccggaaggttccccgg

SEQ ID NO: 287160 - DNA, 600 bp, Homo sapiens
  misc_feature: GYAE6OF02JAS3F.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtggagatgcattcgaccaaaccgatatgcttattggtaccagcagaagccgggccaggcccctggtgttggtgatgtaataaagacactggagacggcccttcgagggactccccgtggacgcgtattcgtctgggcctccgaggtcacgggacaacggtcactagttcgggaccatcgaggtcggacgtccgaggacaggtagggacgacggcgtagaacttattagttgtacaactacaacagaccacctagttacgtactttactgttacgttacggtaactggtaccgtaccgtaacggtccgtaacccgttccggttacgggtaccaccggaccccgaacggccccgaaacccctacgttcgtaccgtaacccg

SEQ ID NO: 287161 - DNA, 503 bp, Homo sapiens
  misc_feature: GYAE6OF02IF6HH.49.62.F07.1.454.CMB.1.raw
  modified_base (245)..(245): a, c, t, g, unknown or other
  misc_feature (245)..(245): n is a, c, g, or t
  modified_base (495)..(495): a, c, t, g, unknown or other
  misc_feature (495)..(495): n is a, c, g, or t
tcagagtcgagagacacgaccggtgctcgatttagtagtcgcataaaagggaaagggggctgtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctctggagatgcattgccaaaaccgntatgcttattggtaccagcagaagccgggccaggcccctgtgttggtgatgtataaagacactgagaggccctcagggatccctgagcgattctctggctccaggtcagggacaacggtcacattggccatcagtggagtcgaggcagaggacgaggctgactattattgtacaatacaacagacaccattggtacttatgtcttcgactgcgacaaggtcaccgtctggtcagcccaaggcccaacccntcgctacc

SEQ ID NO: 287162 - DNA, 554 bp, Homo sapiens
  misc_feature: GYAE6OF02GYS6E.49.62.F07.1.454.CMB.1.raw
  modified_base (225)..(225): a, c, t, g, unknown or other
  misc_feature (225)..(225): n is a, c, g, or t
  modified_base (241)..(241): a, c, t, g, unknown or other
  misc_feature (241)..(241): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggactcacctgctctgganatgcattgccaaacgntatgcttatgtaccagcagagccggccaggcccctgtgttggtgatgtataaagacacgtgagacggcctcgagggactcccgtgacgcgacttctcgtggctccgaggtcacgggacaacggtcacgtagtcgcatcagtgagtccaggcagacggacgaggctgactattagtcgtacatcaacgagtaccactagttacggtaactttagtcgttacgttacggacttcggaccgtacgtaacggtcacccggttcgtacgggtcaacggtcccgaacggtcccaaaccccgtcttacggtacctacccg

SEQ ID NO: 287163 - DNA, 624 bp, Homo sapiens
  misc_feature: GYAE6OF02GT1K6.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagacggccctcgagggactccgtgacgcgattctctggctccgaggtcgagggacaacggtcacgtagttcggaccagtcgaggtggacgtccgaggcaggacgggacggaggctacggacttagtttagttgtacgaactacgaaacgtacggaaccaccgtaagtttacgggttaactttacgttacggttacgtttaaccgggtaacttacggaccgtaaccgtaacgggttccctaacccggttccggtaccggggtactaacccggtacccgaaccggtaccccgaacccccgtacgttccgtacctacccgg

SEQ ID NO: 287164 - DNA, 679 bp, Homo sapiens
  misc_feature: GYAE6OF02I9DA5.49.62.F07.1.454.CMB.1.raw
  modified_base (241)..(241): a, c, t, g, unknown or other
  misc_feature (241)..(241): n is a, c, g, or t
tcagagtcgagagacacgaccggtgctcgatttagtagtcgcataaagggaaaggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccggccaggcccctgtcgttggtagactgtaagtaaagacacgtgagacggccctcgaagggtactcccctaggacgtcgaagtttcctacgttggaccttacccgaggtaccaggggtaaccaacgggttcaacgtagttcgggacctagtcgaacggtggaacgtcccagggtacaggacgggtacgaggtaccgtagtaaccttaagtttagttcggtactaaacgtcaaaacgagtaaccaaccgtagtttacgggtactttaacgtcgttaccgttaacggtaacttacggacccgtaaaccggtaacggtaccctaacccggttcccgtaaggggtacccgtaaaccgtaccccgggtaaaccgtaccccctaaaacccccggtacgttacccggtacccttaacccgg

SEQ ID NO: 287165 - DNA, 508 bp, Homo sapiens
  misc_feature: GYAE6OF02FHT8M.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccacccttggtgtcagtgtccccaggacagacggccagggatcacctgctctggagatgcattgccaaaaccgatatgcttattggtaccagcagaaagccgggcccagggcccccctgtgttggtgatgtataaagacactgagaggccctcatggatccctgagcgattctctggctccaggtcagggacaacggtcacattggccatcagtggagtccaggcagaggacgaggctgactattattgtcaatcaacagacaccattggtacttatgtcttcgactgcaccgaaggtcaccgtcctgggtcagtcccaaggcccaaccccatgtacc

SEQ ID NO: 287166 - DNA, 824 bp, Homo sapiens
  misc_feature: GYAE6OF02IBFYZ.49.62.F07.1.454.CMB.1.raw
tcagagtcgagagacacgaccggtgctcgatttagtagtcgcataaagggaaagggggctgtgggtccaggaggcagaactctgggtgtctcaccatggcctggactccctctacttcctcccctcctcactctctgcacgaggctctggacggcctcctatgagctgacacacgcccacccgtcggtgtcgtagtccgtccccgaggacacggaccggccgaggactcctaccgtgtcctcggtagggagagtcgactagttcgaacccgaaaaccgattagtcgtactttagttacggtaccagacgaaggaacggcccgggaccgaccggtccccgttggttcggtttgggtagtagttaggttaaaagtaaaacgtaccacgttaggaacgggaccggtccctacggaacgggtaccttcccggtaggacggtacgtactttccgttcgtcggtcctaccggtaacggttacggaacggggtaaccgtaaccggtaccaaccgttaggttccggacctagtacgtagggttacgggacgtaccggaggacgaagggtaacgggaacggacgggtacgttacgtaaactttagtttaacgttcggtaactaaacgtaccgaaagaccgtaaaccgaaccttacggtttaacggtttaacctttacgttacgttacccggttaaccggtaacgtccggtaacccgtaaacccggtaacggtccccggtaaccggttcccgggtaaccgggtacccgaacccggtaccccggaaacccggaccccctaaacccccgtcggttacccggtacccttaaccccgg

SEQ ID NO: 287167 - DNA, 543 bp, Homo sapiens
  misc_feature: GYAE6OF02JJS9A.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggccaggcccctgtcgttggtgatgtaataaagacactgagaggccctcgagggactcccgtgagcgattctacgtggctccgaggtcagggacaacggtcacgtagttcggacctagtcaggtaggacgtaccgaggcaggaggacgaggctagacttagttattgactaatacaacgagaacaccgtattaggtacttatcgttacttacggaactgacgacctaaggtccaccgtcgtggcacgacccgacggcccaacccgctcgctaccg

SEQ ID NO: 287168 - DNA, 588 bp, Homo sapiens
  misc_feature: GYAE6OF02FIEAR.49.62.F07.1.454.CMB.1.raw
  modified_base (284)..(284): a, c, t, g, unknown or other
  misc_feature (284)..(284): n is a, c, g, or t
tcagagtcgagagacacgaccggtgctcgatttagtagtcgcataaagggaaagggggcgtgtgggtccaggaggcagaactctgggtgtctcaccatggcctggatccctctacttctccccctctcactctctgcacaggctctgaggcctcctatgagctgacacagccaccctcggtgtcagtggtccccaggaccagacggccaggatccacctgctctggagatgcatttgccaaaccgatatgcttatggtaccagcagagccggcaggcccctgtntggtgatgtataaagacactgagaggccctcagggctcccctgacgcgattcgtcgtggcctccgaggtcagggacaacggtcactattggccatccgagtggacgtccggcccaggacggtacggaggctaggacttaagttacctagtaccagttacccgactaaggaccaggacccaaggttcggaccgttaagttagttacggtcgttaagttccgggcggaagggtaccgtacgcgtacggacccgttcctacgggttccacggaccccgtaaggccgttaccgtaccccccgttccgg

SEQ ID NO: 287169 - DNA, 547 bp, Homo sapiens
  misc_feature: GYAE6OF02H2DZ6.49.62.F07.1.454.CMB.1.raw
  modified_base (440)..(440): a, c, t, g, unknown or other
  misc_feature (440)..(440): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggcaggcccctgtgttggtgatgtataaagacactgagaggccctcagggatccctgagcgtattctctggctccgaggtcgagggacaacggtcacgagttcggccagtcaggtggacgttcccagggcaggacgggacgaggctagaactattattgtcaaataccaaanagacaccagtttggtaacttatgtacttcgaacgttcgacgtaccgaaggtccaccgtccgtagggtacacggtacccacgggaccccaaccctactgtacctaccg

SEQ ID NO: 287170 - DNA, 693 bp, Homo sapiens
  misc_feature: GYAE6OF02JF93M.49.62.F07.1.454.CMB.1.raw
  modified_base (227)..(227): a, c, t, g, unknown or other
  misc_feature (227)..(227): n is a, c, g, or t
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
tcagagtcgagagacacgaccggtgctcgatttagtagtcgcataaagggaaagggggcgtgtgggtccgaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaaccgntangcttattggtaccagcagaagccgggccaggccccctgtcgttggtgatgtataaagacactagagaggccctcagggactccccgtagagcgattctctgcctcgaggtcagggacaacggtcacgtacgttggcctagtcaggtaggacgtaccgagggacagggtagggaaccggaggtacctacggaactttaacgtttaacgtttcggtacctaagtacccgaaacgtaacgtaacccaacccttaagtttacgggtttaaacctttaacgtttcgttaacccgttttacgggaaaccgttacggtacccggaaaccggttaaccgggttaacccgttaacccggttaccccgggttacggggttaccctaaccgggtaacccccgtaaacgggtaccccccgaaaaccccccgtaccgtaggttaccccgttaaccccgg

SEQ ID NO: 287171 - DNA, 618 bp, Homo sapiens
  misc_feature: GYAE6OF02G5TRU.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtaataaagacactgagacggccctacgagggactcccgtagagcgtattctcgtggctccgaggtcgagggacaacggtcactagttcggcctagtcgagtggacgtccgaggcaaggaggacggaggtcgtagtacttaagttagttagtactaatacaaacgacgtaaccaccgtagtttacggtaactttatcggttacgttacgggaaccttggaccgtaaccggtaacggttcccgtaacccggttccggtacgggtaccgaccgtaacccccggaacggacccccgtaaaccccgtacgttaccggttaccctacccg

SEQ ID NO: 287172 - DNA, 564 bp, Homo sapiens
  misc_feature: GYAE6OF02G3L5Y.49.62.F07.1.454.CMB.1.raw
  modified_base (243)..(243): a, c, t, g, unknown or other
  misc_feature (243)..(243): n is a, c, g, or t
  modified_base (553)..(553): a, c, t, g, unknown or other
  misc_feature (553)..(553): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgntatgcttattggtaccagcagaagccgggccaggcccctgtgttggtgatgtataaagacactgagacggccctacgagggactccccgtgacgcggtattccgtactggctccgaggtctaaggggactaacgggtcaacgtagtttcgggaccctatcaggtggacggttccgagggctaggaggacgaggctgacttattattgtacaagttcaactacgaacaccgtattacggtactttagtcgttcgttacgactgaccgactaacggtcaccgtcgtgggtccaggacccaaggcccaacccncttgactaccg

SEQ ID NO: 287173 - DNA, 728 bp, Homo sapiens
  misc_feature: GYAE6OF02HISC0.49.62.F07.1.454.CMB.1.raw
  modified_base (231)..(231): a, c, t, g, unknown or other
  misc_feature (231)..(231): n is a, c, g, or t
  modified_base (252)..(252): a, c, t, g, unknown or other
  misc_feature (252)..(252): n is a, c, g, or t
tcagagtcgagagacacgaccggtgctcgatttagtagtcgcataaagggaaagggggctgtgggtccaggaggcagaactctgggtgtctcaccatggcctggatccctctacttcctccccctcctcactctctgcacaggctctgacggcctcctatgagctgacacagcccaccctcggtgtcagtcgtccccaggacagaccggccaggatcacctgctcgtgganatgctattcgaccaaaaccgntatgcttattggtaccagcagaagccggccacggcccctgtggttggtgatgtaataaagacactgagacggccctgagggactccctggacgcgtactttctcgtggcctaccgtagggtccgaaggggaccgaacggtaccaactagttcggaccaatccgaaggttcgggaacgttccgagggtcgaagggtaacgggacggaacgggcgtacggtaactttaagtttagtttcgttaacaaagttaccaaaacgtaggaaacccaacccgtaagttttacgggttaaacctttttagttacggttttacccgttttaaccgggtaaaccgttcgggacccgtaacccggttaaacggggttcccgtaaccccggtttacccgggttaccggggttaccgaaccgggtacccccggaaaccgggtaccccccgaaaaccccccggtaccgttaccgttaccccttaaaccccg

SEQ ID NO: 287174 - DNA, 713 bp, Homo sapiens
  misc_feature: GYAE6OF02JSH01.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgacttagttacggtaccagcaagaacggccgggaccacggcccctgttggttcggtagtagtagtaataaagacactagaggacgcctcgaggtactacccgtagacggcgtacttacgtcgtcggtcctcgtaggtacgagggaaccgtaacgggtcacgtacgttcggacctaagtcgaaggttcggacgtaccgaggtaccgaaggtaacgggaacggacggtacgtacggtaacgtttaagttagttacgtaacgtaaacgtaaccaaaccgtaagaaccgtaaacccttagtttaacggttaacttttacgttaacggtttaccgttaaccgggtaaacgttacggtacccggtaacctaaaccgggttacccgttaacccgttaccggtacgggttacccgaaccggtaccccgtaaacggtacccccgaacccgtacccgttaccggtaccttaaccccg

SEQ ID NO: 287175 - DNA, 532 bp, Homo sapiens
  misc_feature: GYAE6OF02GHY1F.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctcccccctcctcactctctgcacaggctctgaggcctcctatgagctgacacagccaccctcggtgtcagtgtcccccaggacagacggccaggatcacctgctctggagatcgcattgccaaaaccgatatgcttattggtaccagcagaagccgggccaggcccctgtgttggtgatgtataaagacactgagaggcctcagggatccctgagcgattctctggctccaggtcgagggacaacggtcactattcggctatcagtggagtccgaggcagaggacgaggctgactattattgtacaatcaacagacactagttgtaacttatgtacttcggaactgacgaccaacggtccaccgttccgtcgggtcacggccccgaacggacccaaccccactcgtacctacccg

SEQ ID NO: 287176 - DNA, 599 bp, Homo sapiens
  misc_feature: GYAE6OF02GSOIN.49.62.F07.1.454.CMB.1.raw
  modified_base (242)..(242): a, c, t, g, unknown or other
  misc_feature (242)..(242): n is a, c, g, or t
  modified_base (444)..(444): a, c, t, g, unknown or other
  misc_feature (444)..(444): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggccaggcccctgtgttggtgatgtataaagacactgagacggccctacgagggactcccgtgagcgtattctcgtggcctccgaggtcgagggacaacggtcacagttggccatcgaggtggacgtccgaaggcaggaggacgaggctgaacttattattgtacaatcaaacganactacctagttacggttacttagttcgttaccgttacggaacttcggaccgtaaccgaacggttacccgtaacccggttccgtacggggtacctaaccggacccccgaaccgggtacccccaaacccccgtacgttacccgtacccgttaacccg

SEQ ID NO: 287177 - DNA, 829 bp, Homo sapiens
  misc_feature: GYAE6OF02I7UUO.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaaccgatatcgtctttagttcggtaccagcaaggaacggccgggacccacggtccccgtagtggttgggtgagttgtaagtaaaacgacactagaggacggcccctacgagggacttccccgtagacgcgtatttccgccggtacctccgacgggtacgaacgggaacgaaccggtccaacgtacgttcggacctaacgtcgtacggtgggtaccggtccgaagggtccgagggtaacggggaacgggacgggttaccgtacggttaaccgtttaaagtttttacggtttacggttaaccgtaaaacgtttacccgaaaagtacccgtaaaccgtaaacccggttaaagtttttaccggggtttaaaccgtttttacgtttaccgggttttacccggtttttaacccgggtaaaaccgttccgggtaacccggtaaccccggttaaaccggggttacccgttaacccccggggtttaaccccgtttcggggggtaaaccccgttaccccggtaacccccggtaaacccgggacccccgtaaaaccccccgtaaccgttccgggttaaccctacccggttttacccccgg

SEQ ID NO: 287178 - DNA, 505 bp, Homo sapiens
  misc_feature: GYAE6OF02IWUZJ.49.62.F07.1.454.CMB.1.raw
  modified_base (325)..(325): a, c, t, g, unknown or other
  misc_feature (325)..(325): n is a, c, g, or t
  modified_base (386)..(386): a, c, t, g, unknown or other
  misc_feature (386)..(386): n is a, c, g, or t
  modified_base (399)..(399): a, c, t, g, unknown or other
  misc_feature (399)..(399): n is a, c, g, or t
tcagagtcgagagacacgaccggtgctcgatttagtagtcgcataaagggaaagggggctgtgggtccaggaggcagaactctgggtgtctcaccatggcctggatccctctacttctcccccctcctcactctctgcacaggctctgaggcctctatgagctgacacagccaccctcggtgtcagtgtcctcaggacagacggccagtatcacctgctctggagatgcattgaccaaagcaatatgcttactggtaccagcagaagccaggccacggccctgtctgatcattataaagactttgagaggcctcgaggaccctgngcgatctctggctcagctcagcgacaacagtacacgttagaccatcaagtggagtccgggnaggaggacgaggntagacttatactgtcagtcatcaagacagtagtcgctacttcgtgtacgtattcgggcggtacggaccaagcgtcgtaaccgtcgtaggtcacgaccgaggtaccc

SEQ ID NO: 287179 - DNA, 643 bp, Homo sapiens
  misc_feature: GYAE6OF02IKP1R.49.62.F07.1.454.CMB.1.raw
  modified_base (244)..(244): a, c, t, g, unknown or other
  misc_feature (244)..(244): n is a, c, g, or t
  modified_base (290)..(290): a, c, t, g, unknown or other
  misc_feature (290)..(290): n is a, c, g, or t
tcagagtcgagagacacgaccggtgctcgatttagtagtcgcataaaagggaaagggggctgtgggtccaggaggcagaactctgggtgtctcaccatggcctggatccctctacttctcccccctcctcactctctgcacaggctctgaggcctcctatgagctgacacagccaccctggtgtcagtgtccccaggacagacggccaggatcacctgctctggagatgcattgaccaaaacgntatgcttattggtaccagcagaagccgggcacggccctgtgttggngatgtaataaagacactagagacggccctcgagggactcccgtgacgcgtattcgtcgtggcctccgaggtcgaacgggacaacggtcaatacgttggacctatcgaggtggacgtcgaagggcaagggaacggaacggaggtcttaaggaacctttattaagtttcgtaactaataccaaacgacgaacctaaccgtaagtttacggttaactttaagttcgttaccgtttaccgggaaacgttcgacccggtaaccggtaaacgggtccgtaaccccggttacggtcgggttacccgaacggtaccccgaaacggtcccccaaaacccccttacgtccgtaccttaacccg

SEQ ID NO: 287180 - DNA, 651 bp, Homo sapiens
  misc_feature: GYAE6OF02IKZWT.49.62.F07.1.454.CMB.1.raw
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
  modified_base (294)..(294): a, c, t, g, unknown or other
  misc_feature (294)..(294): n is a, c, g, or t
tcagagtcgagagacacgaccggtgctcgatttagtagtcgcataaagggaaagggggctgtgggtccaggaggcagaactctgggtgtctcaccatggcctggatccctctacttctcccccctcctcactctctgcacaggctctgaggcctcctatgagctgacacagccaccctcggtgtccagtcgtccccaggacagacggccaggatcacctgctctggganatgcattcgaccaaaacgnttangcttattggtaccagcagaagccgggcacggccctgtgttgngatgtaataagacacgtgagacggccctacgagggactcccgtggacgcgtatttcctcgtcggcctccgaggtcgaagggaactaacggtcaactcgttcggacctagtaccgaggttacggacgttcccgaagggcgtaagggaacgggaccggagggctaagacgtttaattagttcgtactaaactaccgaaacgacgtaacctaaccgtagtttacggtaactttagttcggttaccgttaccgggtaactcggacccggtaacgtaacggtacctaacccggttccggtcgggttaccgaaccggtaccccgaacggtacccccaaaccccgtagtaccgtacctaacccg

SEQ ID NO: 287181 - DNA, 516 bp, Homo sapiens
  misc_feature: GYAE6OF02IFGL3.49.62.F07.1.454.CMB.1.raw
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
  modified_base (347)..(347): a, c, t, g, unknown or other
  misc_feature (347)..(347): n is a, c, g, or t
  modified_base (359)..(359): a, c, t, g, unknown or other
  misc_feature (359)..(359): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
tcagagtcgagagacacgaccggtgctcgatttagtagtcgcataaaagggaaagggggctgtgggtccaggaggcagaactctgggtgtctcaccatggcctggatccctctacttctcccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagagccaggccaggcccctgtcttggtgatttanaaagtctttgagaggccctnacgggaccctgagcgattctctggctcanctcaggacaacngtcaccttgaccatcagtggacgtccggcagaggacgaggctgacttattacngtacngtccgnagacagcagtcggctagttatgtgtagtcggcggaggtactacgctacggacccgttcgtagggtccacggcccaaggtcctccgcccctcgg

SEQ ID NO: 287182 - DNA, 635 bp, Homo sapiens
  misc_feature: GYAE6OF02HSZNO.49.62.F07.1.454.CMB.1.raw
  modified_base (486)..(486): a, c, t, g, unknown or other
  misc_feature (486)..(486): n is a, c, g, or t
tcagagtcgagagacacgaccggtgctcgatttagtagtcgcataaagggaaagggggctgtgggtccaggaggcagaactctgggtgtctcaccatggcctggatccctctacttctcccctcctcactctctgcacaggctctgaggcctcctatgagctgacacagccaccctggtgtcagtcgtccccaggacagacggccaggatcacctgctctggagatgcattgaccaaaccgatatgtctttagttcggtaccagcgaaggaacgccgggccaacggtccccgtggttggttcgggtagagttaggttaagtaaaacggactaacgtggaacggacggtacccctcggaacgggtacttccccgtggacggcgtacgttccgtcgtggcctcgtacggtcgaacggggaacctaacgggtcaacgtagttcgggacctaagtcgtaggtagggacgtaccagggacaggacggacgnggctagaactttagtgttagtacaatacaaacacgtaccacgtagttagtacttatcgttacgtacgacgtagccgaacgtaagggtcctacccggttcgtacggtaccgacggtaccgaaccggcccaacccgtactcgtacctaccg

SEQ ID NO: 287183 - DNA, 635 bp, Homo sapiens
  misc_feature: GYAE6OF02G87Z6.49.62.F07.1.454.CMB.1.raw
  modified_base (236)..(236): a, c, t, g, unknown or other
  misc_feature (236)..(236): n is a, c, g, or t
  modified_base (239)..(239): a, c, t, g, unknown or other
  misc_feature (239)..(239): n is a, c, g, or t
tcagagtcgagagacacgaccggtgctcgatttagtagtcgcataaagggaaaggggctgtgggtccaggaggcagaactctgggtgtctcaccatggcctggatccctctacttctccccctctcactctctgcacaggctctgagcctctatgagctgacacagccacctggtgtcagtcgtcccaggacagacggccaggatcacgtgctctgggagatgcattgccaaacgntancgcttatggtacagctagaagaccggcaggaccctgtcgttggtgagtgtaagtaaagcacgtgagacggccgtgaggactccgtgagcgtattcgcgtggtctacgagtacgaaggacaacggtcactacgttcgacgtacgtacgagtacggacgtaccgacggacgaaggaaggaccggacgcgtacgtaacgttagttaacgttacgtactaaataccgaaacgtaacgaaacctacccgtaagttaccggttaacgtttacgttcggttacgttaaccgggtaaacttcggaccggtaaccgtaacgggttcctaaccggttccggtacgggttaccgaacggttaacccgaaacgggtcccaaacccgacgtttaccggaccgttaaccg

SEQ ID NO: 287184 - DNA, 631 bp, Homo sapiens
  misc_feature: GYAE6OF02G8EAW.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtggagatgcattgaccaaaccgatatgcttattggtaccagcagaacgccgggccaggcccctggtgttggtgatgtataaagacactagagacggccctcgagggactcccgtggacgcgatttctctggcctcgaggtcagggacaacgggtcactagttcgggaccagtccgaaggtcggacgtaccgagggcaaggacggacggaggctaggactttagttatttaggtactaaagtacaaacgacgaaccgtacctaagttttacggttaactttagttcggtttccgttaacggtaacctttaggaccgtaaccgtaacggttccgacccggttccgtacgggttacccgaacggtacccccgaacgggccccctaaacccccggtactcggtacccttacccg

SEQ ID NO: 287185 - DNA, 655 bp, Homo sapiens
  misc_feature: GYAE6OF02IO30E.49.62.F07.1.454.CMB.1.raw
tcagagtcgagagacacgaccggtgctcgatttagtagtcgcataaaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcattcgaccaaaaccgatatgcttagttggtaccagcagaagccgggccaggcccctgtgttggtgatgtaataaagacacgtagagacggccctacgagggtactcccgtaggagcgtatttcgtcgtcggcctccgaggtcgaacgggaacgaacggtccaagtacgtttcgggacctaagttacgaggttacgggacgtacccgagggacgaagggaacgggacggaagggtccgtaggtaactttaagtttagttacgtaactaaactaccaaacgacgtaacctaaccgtaagtttcggttaactttagtcgttacgtttacggaacgtcggacccgtaaccgtacggtccgtaccccgtcggtcgggtaccaccgacccgaacggacccctaaaccccgtacgtaccgtacctacccg

SEQ ID NO: 287186 - DNA, 881 bp, Homo sapiens
  misc_feature: GYAE6OF02JBKXQ.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagcggccaggatcacctgctctggagatgctattcgaccaaacgatatgtcttagttacggtaccagacaaggaacggccccgggccaacggttccccctggtggtttcgggtagaacgttggttaactaaaacgactaacctggaagacggtccccttacggacggggtacttccccgtaggacgtcgtaactttccgtcgtacgggtcccttaccgggtaagggttaccggaaacgggggtaaccctaaaacccgggggttaccctaaacccgttaacggttttccgggaaccctacgttacccggtagggtttaacgggggaccgtttaacccccggaaggggtacccggaaaacggggaaacgggggtaaccgggaacggggtacccgtttaggggtaaaaccttttagttttaaacgtttacgggtacctaaaaacgtttaccgaaaaccgtaacgaaaccctaacccgttaaggttttaacggggtttaaccttttaacgtttaccgttaccggtttaccgggtaacccggttacgtacccggtaaacccgttaaccggggttcccgttaaccccgggttcccgggtttaacgggtaacccgtacccggaacccccggtaaacccggtaccccccggttaaaccccctacggtttaccccggtaccttaacccccgg

SEQ ID NO: 287187 - DNA, 657 bp, Homo sapiens
  misc_feature: GYAE6OF02GPSP7.49.62.F07.1.454.CMB.1.raw
  modified_base (244)..(244): a, c, t, g, unknown or other
  misc_feature (244)..(244): n is a, c, g, or t
  modified_base (290)..(290): a, c, t, g, unknown or other
  misc_feature (290)..(290): n is a, c, g, or t
tcagagtcgagagacacgaccggtgctcgatttagtagtcgcataaagggaaagggggctgtgggtccaggaggcagaactccgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgntatgacttatggtacagcagaagccggccaggcccctgtgttggtnatgtaataaagacactgacgacggcctcgacgggtactcccgtgacgcgattctactggctccgaggtcgacgggaactaacggtcaacgtcgttcggacctatcgaggtacgggtaacgtccgaagggtcgaagggtacggaacgggacggcgtacggtaaccttagtttaagttcgtacaaagttaccaaacgacgaacctaactacgttttacgttacgtttaacgttcgttaccgtttacggaaacgttcgaccggtaacctaacgggttacccgtacccggttccgttacggggttacccaccggtaacccgaaccggggtacccctaacccccgtaagttcggtacccgtaacttccccgg

SEQ ID NO: 287188 - DNA, 588 bp, Homo sapiens
  misc_feature: GYAE6OF02HLMRT.49.62.F07.1.454.CMB.1.raw
  modified_base (230)..(230): a, c, t, g, unknown or other
  misc_feature (230)..(230): n is a, c, g, or t
tcagagtcgagagacacgaccggtgctcgatttagtagtcgcataaaagggaaagggggctgtgggtccaggaggcagaactctgggtgtctcaccatggcctggatccctctacttctcccccctcctcactctctgcacaggctctgaggcctcctatgagctgacacagcccaccctcggtgtcagtcgtccccaggacagacggccaggatcacctgctcgtgganatgcattcgaccaaaaccgatatgctttagttcggtaccagcagaacgccgggccgacggcccctgtgttggtgagttgtaagtaaagacacgtgacgacggccctacgacgggtactccccgtgacgtcgtacttcctcgtacggcctccgtaggtcgaagggtaccgaacggtacaacgtacgttcggacctagtcgaggtaggacgtcccgaggcaaggaggacgaggcgtagacttattagttcgtcacgtcatcaagctagtgtcgtctacttcgtagttcgtacggtcggacggtacgggacacgtcgtcgaccgtcgtacggacaccggaccgtaggcctccgtacccccg

SEQ ID NO: 287189 - DNA, 784 bp, Homo sapiens
  misc_feature: GYAE6OF02G09K0.49.62.F07.1.454.CMB.1.raw
tcagagtcgagagacacgaccggtgctcgatttagtagtcgcataaaaggggaaagggggctggtgggtccaggaggcagaactctgggtgtctcaccatggcctggatccctctacttcctccccctcctcactctctgcacaggctctggaggcctcctatgagctgacacacgcccacccgtcggtgtcaggtcgtccccgaggacaggacggccaggactcacctgcctcgtgggagatcggctagttcgacccaaaaccggtatatcgtactttagttacggtaccagacgaagaacggcccgggaccgaccgggtccccttggtcggtttgggtagtacgttaggttaaagtaaacgactacgtaggacggaccggtccctacggacgggtacctccgtaggacgtaccgttactttccgtcggtacggtcccgtaccggtacgggttacggaaacggggtaccgtaaacgggtcctaacggtacgttccgggacctacgtcgtaacgggtgggtaaccggtccgagggacgtaagggacgggaacgggtacggtaccgttacggaactttagtttacgttagtaacctaaacgtaccgaaacgaacgtaaccctaacgttacgtttaagggttacctttagttacgttaccggttaacggtaaccgtcgacccgttaacggtaaccggttcccgtaacccgggttcggtccgggtaaccaccgggtaccccgaaccgggacccccttaaacccccggcttaccggtacccttacccg

SEQ ID NO: 287190 - DNA, 575 bp, Homo sapiens
  misc_feature: GYAE6OF02JGW7M.49.62.F07.1.454.CMB.1.raw
  modified_base (233)..(233): a, c, t, g, unknown or other
  misc_feature (233)..(233): n is a, c, g, or t
  modified_base (248)..(248): a, c, t, g, unknown or other
  misc_feature (248)..(248): n is a, c, g, or t
  modified_base (446)..(446): a, c, t, g, unknown or other
  misc_feature (446)..(446): n is a, c, g, or t
  modified_base (473)..(473): a, c, t, g, unknown or other
  misc_feature (473)..(473): n is a, c, g, or t
tcagagtcgagagacacgaccggtgctcgatttagtagtcgcataaagggaaagggggctgtgggtccaggaggcagaactctgggtgtctcgaccatggcctggatccctctacttctccccctcctcactctctcgcacaggctctgaggcctcctatgagctgacacagccaccctcggtgtcagtcgtccccaggacagacggcctaggactcacctgcctcgtggatntgcattgccaaacgntatgcttattggtaccagcagacgccggcacggccctgtcgttggtgatagtataaagcactagagacgtcctagaggactccgtgacgcgattcgctggctcgagtcgacggtacaacgtcagacgttcgactatacgaggtggaacgtccgaggcgagacggacgaggctagacttagttattacgacagtcgtanacgtatacgagtacgtgacttacgttntacggttcgtagtccgggacggtaccgggtaacaacggtcgttacggacccgttacggtacggtccaaccgttacccggacggtccgttcccggtaccccgg

SEQ ID NO: 287191 - DNA, 938 bp, Homo sapiens
  misc_feature: GYAE6OF02I3N9K.49.62.F07.1.454.CMB.1.raw
  modified_base (225)..(225): a, c, t, g, unknown or other
  misc_feature (225)..(225): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattcgaccaaaccgatatgtacttattacggtaccagcaaggaacggcccgggaccgacggtcccccgtggttcggttggtaggagttaggtaaacgttaaaaacggacctaaccgtagaacgggaaccgggtacccccgttacggaaggggtaaccttccccggttagggaacggtaccggtaacttttccgttccgttcgggtcccttacccggtaacgggttacccggaaagggggtaacccgtaaaccggggttaccctaaaccggttaacggttttccgggacccgtaatttacccgggaagggttaccggggaacggttaccccgggaacggggacccggtaaagggtaaccgggggtaaccgggaggtacccgttaagggttaaccgttttaagtttaacgtttacggttaaacccgtaaacgttaacccgtaaaacgtaaaccgtaacccgtaaaccgttacggttttaaacgggtttaaccttttaaacgttcggttttaacccggtttaaccgggttaaaccgttaccgggtacccgggttaaacccggttaaacccggggttaaccccgttaaccccgggttacccggggttacggggttaaccccgaacccggggttaaacccccgttaaacccggggaacccccccttaaaaccccccgtaccggtttacccgggttaccccctttaacccccggg

SEQ ID NO: 287192 - DNA, 666 bp, Homo sapiens
  misc_feature: GYAE6OF02HT16V.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctcccctcctcactctctgcacaggctctgaggcctcctatgagctgacacagccacctcggtgtcagtgtcccaggacagacggccaggatcaacctgcctctggagactgcattcgacccaaaacgattatcgctttagttggtaaccagctagaagccgggccaggcccctgtcgttggtgatgtaataaagacactgagacggcctacgacgggatcccgtagacgcgtattcgtctcggctccgaggtcgaacgggactaacggtacaacgtacgttacggacctatcgaaggttcgggacgttaccgagggcaaggaacggacgacggctagtaacgttattacgttagactaataccaactaacggaacctaccgtaacgtttacggttaacttttaacgttcgtttaccgttaacggtaacgttccggtaccgtaaccgttaaacgggtcccgttaacccggttccggttaaccgggttacgaaccggaccccgtaaacggtaccccctaaaccccggtacgttacggtacccttaaccccg

SEQ ID NO: 287193 - DNA, 703 bp, Homo sapiens
  misc_feature: GYAE6OF02FG1B2.49.62.F07.1.454.CMB.1.raw
  modified_base (241)..(241): a, c, t, g, unknown or other
  misc_feature (241)..(241): n is a, c, g, or t
tcagagtcgagagacacgaccggtgctcgatttagtagtcgcataaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgntatgcttattggtaccagcagaagccgggccaggcccctgtgttggtgatgtataaagcactgagacggccctcgagggactcccgtgacgcgtagttctcgtggcctccgaggtcgagggacaacgggtcaactagtttcgggcctagtccgaggtcggacgtccgaaggcgaaggacgggacggaggtccgtaggaacctttaagtttacgttacggttaacaaacgttaccgaaacgtaacggaaccctaacccgtaagttttaccgggttaaaccttttagtttacggtttaccgtttaaccgggtaaaccgttcggtacccggtaacccgttaacgggttaccccgtaacccgggtttcccggttacgggggttaccctaaccgggtaccccgaaacccgggacccctaaacccccgtacggttaccgtacccgtacccgttcccgtttacccccgg

SEQ ID NO: 287194 - DNA, 800 bp, Homo sapiens
  misc_feature: GYAE6OF02JCH7E.49.62.F07.1.454.CMB.1.raw
  modified_base (246)..(246): a, c, t, g, unknown or other
  misc_feature (246)..(246): n is a, c, g, or t
tcagagtcgagagacacgaccggtgctcgatttagtagtcgcataaagggaaagggggctgtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgcctctggagatgcattcgaccaaaaccgntatgacttagttggtaccagcagaagccgggcacggcccctgtgttcggtgatgtataaagactactgaggacgtccctacgagggtactcccgtggacgaccgtatttccgtctacgggcctaccgaggtaccgaaggggacctaaacggttccaacgtacgtttcgggccctaagttccgtaacgggttacgggtacggtttaccccgaagggtacccggtaagggaacggggtaaccggtaacggggtcccgttaacgggtaaaccttttaagttttaaccggtttacggttaccgtaaacgtttaacccgaaaaccggtaacggaaacccgttaaccccgttaaagggttttaccgggtttaaaccttttaacggttaccgggtttacccgtttaaccgggggttaaaccttccggggttaccgaacccggtaaaggggttaccccgttaaccccggtttcggtaaccggggttaccaacccgggttacccccgaaacggggtacccccttaaaccccccggtaacgttaccggttacccgttaaccccg

SEQ ID NO: 287195 - DNA, 519 bp, Homo sapiens
  misc_feature: GYAE6OF02FKY4K.49.62.F07.1.454.CMB.1.raw
  modified_base (438)..(438): a, c, t, g, unknown or other
  misc_feature (438)..(438): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccagtatcacctgctctggagatgcattgccaaaagcaatatgcttacttgtaccagcagaagccaggccaggcccctgtctgatcatttataaagtctttgagagggcctcgacgggacccctgagcgtattctctggctccagctcagcgaacaacagtcacgttgacatcagtggagtccgggacaggaggacgaggctgactagttactgtcagtcatcagacgagtagngctacgttctgttcgtacgtcgggtcggacgggtaaccacggctggtacccgtacgtacggtacacgtacccgaggtcccg

SEQ ID NO: 287196 - DNA, 604 bp, Homo sapiens
  misc_feature: GYAE6OF02ILNVQ.49.62.F07.1.454.CMB.1.raw
  modified_base (245)..(245): a, c, t, g, unknown or other
  misc_feature (245)..(245): n is a, c, g, or t
tcagagtcgagagacacgaccggtgctcgatttagtagtcgcataaagggaaagggggctgtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggactccacctgctctggagatgcattcgaccaaacgntatgtcttattggtaccagcagaacgccggcacggccctgtgttggtgatgtaataagacactgagacggccctcgagggtactcccgtggaacggcgacgtttctcgtcgggctccgaggtacgagggactaacgtcaacgtcgttacggcctatcgaggtggacgtccgaggcgaggacgggacgaggactaggaacttagttacgttgtaactaatcaaactacgactaccgtagtttcggttaacttagttcggttactacgggtactcgtaccgtaaccgtacggttacccgaccgttacccggtggtacgacgaccgtaacgaccggacccctaacccgtacgttccgtaacc

SEQ ID NO: 287197 - DNA, 692 bp, Homo sapiens
  misc_feature: GYAE6OF02G6CX3.49.62.F07.1.454.CMB.1.raw
  modified_base (227)..(227): a, c, t, g, unknown or other
  misc_feature (227)..(227): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctctgganatgcattcgacccaaaccgatatgctttagttggtaccagcagaaggccggccacggcccctgtgttggtgagtgtataaagactacgtggacgacggccctacgagggtctcccgtgagcgtacttcctcgtggcctcgagtcgacgggtacaacggtcacgtacgttcggacctagtcgaggtacggacgttacccggaggtccgaaggaacggggtaacggacggtaccgtaggttaaccgtttaactttaagtttacgtaactaaacgtcgaaaacctacggtaacctaacccgtaagttttacggtttaacctttaagttcgtttacccgtttacggtaaccgttggacccggttaaccgaacggtttccccgtaacccggttacccggttacgggtacctaccggaaccccggtaaccgggacccccaaacccccgtacgttaccgtaccttaaccccg

SEQ ID NO: 287198 - DNA, 512 bp, Homo sapiens
  misc_feature: GYAE6OF02FP3R8.49.62.F07.1.454.CMB.1.raw
  modified_base (225)..(225): a, c, t, g, unknown or other
  misc_feature (225)..(225): n is a, c, g, or t
  modified_base (243)..(243): a, c, t, g, unknown or other
  misc_feature (243)..(243): n is a, c, g, or t
  modified_base (316)..(316): a, c, t, g, unknown or other
  misc_feature (316)..(316): n is a, c, g, or t
  modified_base (414)..(414): a, c, t, g, unknown or other
  misc_feature (414)..(414): n is a, c, g, or t
  modified_base (424)..(424): a, c, t, g, unknown or other
  misc_feature (424)..(424): n is a, c, g, or t
  modified_base (445)..(445): a, c, t, g, unknown or other
  misc_feature (445)..(445): n is a, c, g, or t
  modified_base (484)..(484): a, c, t, g, unknown or other
  misc_feature (484)..(484): n is a, c, g, or t
  modified_base (503)..(503): a, c, t, g, unknown or other
  misc_feature (503)..(503): n is a, c, g, or t
  modified_base (508)..(508): a, c, t, g, unknown or other
  misc_feature (508)..(508): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaaaccgntatgcttattggtaccagcagaagccgggccaggcccctgtgtggtgatgtataaagacactgagaggccctnagggatccccgtgagcgattctctggctccaggtcgagggacaacggtcacagttgccatcagtggagtccaggcagaggacgaggctgactattatntacaatcaanagacacctattgtacttagtnttacgtcgaactgacgaccaaggtcaccgtcgtggtacncgacccaggcccaaccccntacgntacg

SEQ ID NO: 287199 - DNA, 635 bp, Homo sapiens
  misc_feature: GYAE6OF02I37JS.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgatatgcttattggtaccagcagaacgccggaccacggcccctagtggttggtgattagtaataaagacacgtgagacggccctagagggactcccgtaggacgcgtaatttctaccgtggccgttccgaggtcgaagggaccgaacggtccactaagttcggccaagtccgaggtacggagtcccgaggtccagggaaggaccgaggctagtaacttagttagttgtacctaataccaaactacgaaccaccgtagttacggttaactttacgttgttaccttacgggtaaaccttggaccgtaaccggtaaggttcccgtaccgttaccggtggacccgtaccggaccccgaacgggtaccccctaaccccgacgttcgtacccgtacccg

SEQ ID NO: 287200 - DNA, 589 bp, Homo sapiens
  misc_feature: GYAE6OF02FIL0H.49.62.F07.1.454.CMB.1.raw
  modified_base (427)..(427): a, c, t, g, unknown or other
  misc_feature (427)..(427): n is a, c, g, or t
tcagagtcgagagacacgaccggtgctcgatttagtagtcgcataaagggaaagggggctgtgggtccaggaggcagaaatctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccaaaccgatatgcttattggtaccagcagaagccgggccaggcccctgtgttggtgatgtaataaagacactgagaggccctcgagggactccccgtgaggcgtattcgtctggctccgaggtcaagggacaacggtcacattgccatcagtggagtccgaggcaggaggacgaggctgacttattattgtnaacttcaaagagaccaccgtaagtttacggtactttacgtcgtttacgttacggaacttacggccgtaaaccgtacgggtaccacccggtacccgttacggggtcccaaacgggtccccaacgggtacccccaaacccccgtcgttacggtccttaaccccg

SEQ ID NO: 287201 - DNA, 614 bp, Homo sapiens
  misc_feature: GYAE6OF02JCC30.49.62.F07.1.454.CMB.1.raw
  modified_base (244)..(244): a, c, t, g, unknown or other
  misc_feature (244)..(244): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgccaaaaccgntatcgtcttattcggtaccagacgtaagaacgcccggggcccacgggtccccctggtcggtttggtagattggtaataaagaccacgtgaaggcgccctgagggactcccgtgactcgttacttctcgtggtcctcgaggtcgaggacgaacgtcactagtgacatcaagtcggactcgaggcgtagacgggacgaggctagtacttattacttggtacaactcaacgacgactacccgtatttcggttaacttgttacgttccgttaaggaccgtagacgtaccgtaaacggtcctaacccggttcgtcgggtaccaaccggtccccgaaacggtaccccctaacccgtccgttacgtaccctaccccg

SEQ ID NO: 287202 - DNA, 873 bp, Homo sapiens
  misc_feature: GYAE6OF02JN36P.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctcccctcctcactctctgcacaggctctgaggcctcctatgagctgacacagcccaccctggtgtcagtcgtccccaggacaggacggccaggatcacctgctcgtggagatgcattcgaccaaacgtatagtcgtacttagttacggtaccgagacgaacgaacggtcccgggaccaacgggtcccccgttggttacggttcggtacgtagtacgtaacgtaaacggactacgtaggacgacggtccgtacgaacgggtactcccgtagacgcgtactcgtacgtgcctacgtacggtacgacggacgaacgtactacgtacgttcggactacgtacgaacggtacggtacggtaccgaacggggtacggtaaacgggaacgggggaaccgggtaacgggttaacgtacggttaaacccgtttaagttttaacggtttacgggtaaacccttaaacggttaaacccggaaaaccgttaaaccgggttaacccaaaccgtttaacggtttttaacggttaaacccgttttaagtttacggtttacccggtttaaaccggtaacccggtttaacgggtacccggttaaacccggtaaacggggtttcccccggtttaaacccgggtttcccgggttaaaccggggttaaccccggttaaaccccgggtaaacccccggggtttaaaccccgggtaacccccggttaaaaaaccccccggtcccggtttttaaccgtaacccccgttttaaccccggg

SEQ ID NO: 287203 - DNA, 650 bp, Homo sapiens
  misc_feature: GYAE6OF02G7ZDH.49.62.F07.1.454.CMB.1.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
  modified_base (244)..(244): a, c, t, g, unknown or other
  misc_feature (244)..(244): n is a, c, g, or t
  modified_base (293)..(293): a, c, t, g, unknown or other
  misc_feature (293)..(293): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctctatgagctgacacagccaccctggtgtcagtcgtcccaggacagacgccaggactcacctgctctgganatgcattgaccaaaacgntangacttatggtaccagacaagaaggccggccacggcccctgtaggttggnatgtaataaagcacgtgagaacggccctagaaggactcccgtagacgtcatttctcgtggtcctaccgaggtcagggaacaacggtcaacagttcgaccagtccgaggtaggacgtaccgaggaccgaaggaacggtacggacggacgtagtaaccttaagtttacttgtaacctaaagtaccgaaactacgaaccctaacgtaagtttacggttaaccttaagtacggttaccttaaccgggaaccttcggtaccgtaacccgtaagggtacccaccggtttacggtcccgggtaactaccggtaaccccgaccggtaacccccgaaccccgtacgttacccggtacttaaccccg

SEQ ID NO: 287204 - DNA, 698 bp, Homo sapiens
  misc_feature: GYAE6OF02IMC4G.49.62.F07.1.454.CMB.1.raw
  modified_base (228)..(228): a, c, t, g, unknown or other
  misc_feature (228)..(228): n is a, c, g, or t
  modified_base (246)..(246): a, c, t, g, unknown or other
  misc_feature (246)..(246): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctgtggantgctattcgaccaaacgntatcgtcttagtcggaccagcagaacggccggcacggtcccgtgtcgttgggtcatgttaactaaaagacctacgtagacgtacggtcccctagaagggtacctcccgtaggacgtacggtactttcctacggttcggacctttacccggaaggtccggaacggggtaacccgtaacgttaccgaacgtttacgtaccggaccttaacgtaccgaagggtaccggaacgtcccgagggaaccgagggtaaacgggaccgaagggtccgtaaacggttacttaggtttactcggtaaacaactacgaaccgaacgttaacccacgttaacgtttaaggttaccttagtttacgtccgttaaacgaacgcgtaaccgtaaccgtaaggtccctacgtcccggtaaggcccttaacgggccccaaggtaccccaaccgtaccgtataccctaacg

SEQ ID NO: 287205 - DNA, 559 bp, Homo sapiens
  misc_feature: GYAE6OF02G2L7I.49.62.F07.1.454.CMB.1.raw
  modified_base (295)..(295): a, c, t, g, unknown or other
  misc_feature (295)..(295): n is a, c, g, or t
  modified_base (322)..(322): a, c, t, g, unknown or other
  misc_feature (322)..(322): n is a, c, g, or t
  modified_base (332)..(332): a, c, t, g, unknown or other
  misc_feature (332)..(332): n is a, c, g, or t
  modified_base (343)..(343): a, c, t, g, unknown or other
  misc_feature (343)..(343): n is a, c, g, or t
  modified_base (378)..(378): a, c, t, g, unknown or other
  misc_feature (378)..(378): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
tcagagtcgagagacacgaccggtgctcgatttagtagtcgcataaagggaaagggggcgtgtgggtccaggaggcagaactctgggtgtctcaccatggcctggatccctctacttctcccctcctcactctctgcacaggctctgaggcctcctatgagctgacacagcccaccctggtgtcagtcgtccccaggacagacggccaggactcacctgctcgtggagatgacattcgaccaaacgatatgcttatggtaccagcaagacggccggcacggccctgtgttcggtnacgtagtataaagacactagagcgccncgaggctccnggatcgattcnctggctcgagtcgaggacacgtcatgtcgcatcgngtgagtcgaggngagacggacgnggtctaggtactaagtttctagtacaactacgaacagacctacgtagttgtaacttagtacgttcgttaaacggtactggtacccaacggtacggtcctaccggttccgtggaactacggacccgaacggacccctaaccgaccttcgacgttacccg

SEQ ID NO: 287206 - DNA, 715 bp, Homo sapiens
  misc_feature: GYAE6OF02FM2V1.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacacgccaccctcggtgtcagtcgtccccaggacagacggccaggatcacctgctctggagatgcattcgaccaaaccgatatgtcttattggtaccagcgtaagaacggccgggcccgacggtcccccgtggttcggttggtacgtagtacggtaagtaaaacgacctacgtaggaaggtaccggccccgtgaacgggtaccgttaccccgtaggacgacggttactttccgtccgttcgggtcctacccgtaggtaccggaaggggtaaccctaacgggtaccaaccggtagttaccggacctactcggaacggttcgggtacgtaccgaacggtcgaaacggtacgggaaccggtaacggtcgtacgtaacgttactttagttacgtacaacgttaacaacgtaacaaccgtactagtttagtacttattcgtacgttacgtactacggaccgtaacgaacggttcccgtaaccgttccggtacgggtacctaacccggacccaacggaccccctaaacccgtccgttaccggtccttaaccccgg

SEQ ID NO: 287207 - DNA, 606 bp, Homo sapiens
  misc_feature: GYAE6OF02IQ9BW.49.62.F07.1.454.CMB.1.raw
  modified_base (225)..(225): a, c, t, g, unknown or other
  misc_feature (225)..(225): n is a, c, g, or t
  modified_base (337)..(337): a, c, t, g, unknown or other
  misc_feature (337)..(337): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattcgaccaaaaccgatatgcttattggtaccagcagaagccggcaggccctgtgttggtgatgtataagacactgagacggccctgaggactccgtgacgcgattcncgtggctcgaggtcgagggacacgtcacagttcggacagtcaggtggacgtccgaggcaggacggacgaggcgtagtacttagtttacttgtactaataccgaacgtacgtaacctaccgtaagtttacggttaactttagttacgttacgtttaaccggaacttacggaccgtaaccgtaacgggtcccgtaacccggttccggttacgggtcccgaacggaccccgtaacggtacccctaaaccccgacgttaccgacccttacccg

SEQ ID NO: 287208 - DNA, 690 bp, Homo sapiens
  misc_feature: GYAE6OF02IZWB8.49.62.F07.1.454.CMB.1.raw
  modified_base (230)..(230): a, c, t, g, unknown or other
  misc_feature (230)..(230): n is a, c, g, or t
  modified_base (313)..(313): a, c, t, g, unknown or other
  misc_feature (313)..(313): n is a, c, g, or t
  modified_base (343)..(343): a, c, t, g, unknown or other
  misc_feature (343)..(343): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacacgcccaccctcggtgtcagtcgtccccaggacagacggccaggatccacctgctcgtgganatgactattcgaccaaaccgtataatgtacttattacggtaccagacacggaacgcccgggaccacggccctggtcggttggngatgtaactaaaggcacgtgagacgcccgngacggtactcctagacgtcgattccgtagtcgacctcgacggtacgaacgggtaacctacggtactactacgttaccggacctagtacggacggtagggaccgtaccggacggacgaacgggtaacgggaacggacggtacgtacgtaacgttatttacgttacgtaacctaaacgtaccaaacgtacgaacccgtacttaacgtttcgttaacgtttacgttacgtaaccggtttaccgaagtccggtaccgtaaccgttaaccggtcccgtaccggttacccggttaggaccccgtaggacccccgtaacgacccccctaaccgtccgttaccgtaccctacccg

SEQ ID NO: 287209 - DNA, 620 bp, Homo sapiens
  misc_feature: GYAE6OF02HJVBS.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctcgtggagatgcattgaccaaaccgatatgacttattggtaccagcagaacggccgggccacggcccctggtcgttggtgagtgtaataaagacatggacgacggccctacgagggtactcccgtggacgcgtacttccgtcgtggcctccgaggtcgagggactaacggacactagttcgccactcgagtaggacgtccgagggacagggacgggaacggaggcgtagtacgttagttattcggtaactaactaccaacacgaacctaccgtagtttacggttaactttacgttagttccgttaccggtaacgtgaccgtaccgtaacggtcctaacccggttcgtcggtaccgaccggacccgaacggacccctaaccccgtacttccgtacctaccg

SEQ ID NO: 287210 - DNA, 617 bp, Homo sapiens
  misc_feature: GYAE6OF02F9IZZ.49.62.F07.1.454.CMB.1.raw
  modified_base (258)..(258): a, c, t, g, unknown or other
  misc_feature (258)..(258): n is a, c, g, or t
  modified_base (394)..(394): a, c, t, g, unknown or other
  misc_feature (394)..(394): n is a, c, g, or t
tcagagtcgagagacacgaccggtgctcgatttagtagtcgcataaaagggaaagggggctgtgggtccaggaggcagaactctgggtgtctcaccatggcctggatccctctacttctccccctcctcactctctgcacaggctctggaggcctcctatgagctgacacacgcccacccgtggtgtcaggtcgtccccaggacagaccggccaggatccacctgcctcgtggagatcgctacttcgaacccaaacgntatgctttatcggtacagcagaagccgggccacggcccctggtgttgggtgattgtaataaagactagtagagcggcctgaggtctccagacgcgtattctcgtcgcctcgacggtcgacggaactacggtccaangtaggcacgtcaggtcggtagtaccgacggacgaacggacgggtacggacggtcgtaaggtattaagttattacggtactaactacgaaactacggaccaacgttaagttgtaactttagtacgttcgttacgacgtacgacgtaacctagggtccctccgttaccggtggtaccgacggtacccaacgggacccccaaaccgtacgtacggtaccctacccg

SEQ ID NO: 287211 - DNA, 588 bp, Homo sapiens
  misc_feature: GYAE6OF02IAQIW.49.62.F07.1.454.CMB.1.raw
  modified_base (227)..(227): a, c, t, g, unknown or other
  misc_feature (227)..(227): n is a, c, g, or t
  modified_base (293)..(293): a, c, t, g, unknown or other
  misc_feature (293)..(293): n is a, c, g, or t
  modified_base (342)..(342): a, c, t, g, unknown or other
  misc_feature (342)..(342): n is a, c, g, or t
tcagagtcgagagacacgaccggtgctcgatttagtagtcgcataaaagggaaagggggctgtgggtccaggaggcagaactctgggtgtctcaccatggcctggatccctctacttctccccctcctcactctctgcacaggctctgaggcctcctatgagctgacacagccaccctcgggtgtcagtcgtccccaggacagacggccaggatcacctgctctggngatgcattgaccaaaaccgatatgcttattggtaccagcagaagccgggcacggccctgtgttggngatgtataaagacactgaggaggccctgagggactcctgagcgattctntgctccgagtcgagggacaacggtcacagttcggcctagtcaggtggacggtaccgaggcgaaggacgggacgagggctagtacttattagttgtactaagtaccaacacgaacctactatttacggttactttaagttcgttcgttacggaacttcgacgtaaccgtaacggttctaccccggtcgtcgggtacctacggaccccgtaacggacccctaaccccgtacgttaccgtactaccccg

SEQ ID NO: 287212 - DNA, 772 bp, Homo sapiens
  misc_feature: GYAE6OF02JKHSY.49.62.F07.1.454.CMB.1.raw
  modified_base (230)..(230): a, c, t, g, unknown or other
  misc_feature (230)..(230): n is a, c, g, or t
  modified_base (234)..(234): a, c, t, g, unknown or other
  misc_feature (234)..(234): n is a, c, g, or t
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
  modified_base (415)..(415): a, c, t, g, unknown or other
  misc_feature (415)..(415): n is a, c, g, or t
tcagagtcgagagacacgaccggtgctcgatttagtagtcgcataaagggaaagggggacgtgtgggtccgaggaggcgagaactctgggtgtctcaccatggcctggatccctctacttctccccctcctcactctctgcacaggctctgaggcctcctatgagctgacaccagcccaccctcggtgtcagtcgtcccccaggaccagaccggccaggatcactgctcngganatcgctattcgaccaaaccgntactgtcttattcgaccgtaancaagaaggccggccaggcccctagttgtggtgatgtaactaaagcctagtagacgacgcccagagggactccccgtggaagccgtacggttcctaccgtcggtacgtccgtaggtccgagggtacctaacgggttacncgtaacggtttcggcctacggtacgtagggtacggtaacgttacccggaggtaccgaacgggaacggtaccgggacggtaccttacgggtaactttaacgtttacgtttacggtaacttaaacgtaacccgtaaacgttaccgaaacccgtaccgtaacgttttaacggggttaaccgtttaccgttaagggttacccgtttaacggttaaaccgttccgggtaaccgtaaccggtaaacccggggtttaccgtaaccccgggtttacccgttaacgggggttacccgaacccggttaacccggaacccgggtaccccctaaaacccccgtcggttaacccgttacccttaacccgg

SEQ ID NO: 287213 - DNA, 720 bp, Homo sapiens
  misc_feature: GYAE6OF02IE2OW.49.62.F07.1.454.CMB.1.raw
  modified_base (226)..(226): a, c, t, g, unknown or other
  misc_feature (226)..(226): n is a, c, g, or t
  modified_base (246)..(246): a, c, t, g, unknown or other
  misc_feature (246)..(246): n is a, c, g, or t
tcagagtcgagagacacgaccggtgctcgatttagtagtcgcataaagggaaagggggctgtgggtccaggaggcagaactctgggtgtctcaccatggcctggatccctctacttctcccctctcactctctgcacaggctctgacggcctcctatgagctgacacagcccacccgtggtcgtcagtcgaccccaggacagacggccaggatcactgctctgganatgctattcggaccaaacgnttagtgtcttagttacggtacagacgaagaacggccggccgacggccccgtgtcggttggtgtagtataagtaaagacacgtagacggacgcccgtacgacggtactcccgtaggacgtcgtacgttctcggttcggctccgtaggtcgaagggtacaacgggttaccaacgtacgttcgaccgtacgtacgtacgtacgggtacgtaccgacgggacgaaagggtaacgggaaccggaggaccggttacgttaaccgttaagtttaacgttacgttaacgaacttaaccgaaacgtaaccggaacctaacggtacgtttacggtttaaacttacggttaccgtttacgttaccggtaacggtttaccgaaccggttaaccgaacggtttaaccgaccggttacgaccgggttacccgaacgttacccgaaaccggttacccccaacccggtcctttaccgacccttaacccgg

SEQ ID NO: 287214 - DNA, 670 bp, Homo sapiens
  misc_feature: GYAE6OF02I0MXC.49.62.F07.1.454.CMB.1.raw
  modified_base (213)..(213): a, c, t, g, unknown or other
  misc_feature (213)..(213): n is a, c, g, or t
  modified_base (228)..(228): a, c, t, g, unknown or other
  misc_feature (228)..(228): n is a, c, g, or t
tcagagtcgagagacacgaccggtgctcgatttagtagtcgcataaaagggaaagggggctgtgggtccaggaggcagaactctgggtgtctcaccatggcctggatccctctacttcctccccctcctcactctctgcacaggctctgaggcctcctatgagctgacacagccaccctcggtgtcagtcgtcccgaggacagacggccaggntcacctgctctgganatgctatcgaccaaaccgatatcgtcttattcggtaccagcaaggaagccgggccacggccctggtggttggtgagtagtaagtaaacgacgtactaggagacggcctcgacgggtctccgtgagcgtattctcgtcggctccgaggtcgagggacgaacggtacactacgttacggcctagtcgaaggtcgggacgtccgaggcgaaggacgggacggacggcgtagtaattacgtttagtttagtactaaactaaccgaacaacgtaacctaaccgtacgtttaacggttaactttaggttacgtttaccggtttacgggtaaaccgttccgaaccgttaacccggtaaccgggtacccgtaacccggttccggtacgggtaccgtaaccgaccccggtaacccggacccctaaccccgtaccgtaccgttaccgtaccc

SEQ ID NO: 287215 - DNA, 1009 bp, Homo sapiens
  misc_feature: GYAE6OF02HB587.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggactcacctgctcgtggagatgcattcgacccaaaccgattaatcgtactttagttggtaacccagtaccgaacggtaacggccccggggccccgtaacgggcccccccgttaggttcggttttagggttacgtaagttacggttaaagttaaaacggaacccgtaaccgtttaggaacgggtaaccgggtcccccgtaccggaacgggggtaccttcccccggttaaggacggtaccggttaaacgtttcccggtaccgtttccgggcctttaccccggtaagggtttaccggaaacggggtaaccgtaaacccgggttaccgaaccgttaaggtttccgggtaaccctaggttcccgtaagggttcggggtaccggttaacccgggaacggggtacccgtaagggtaaaccgggggaaccggggtaaacggggtcccgttaacgggtttaacccgttttaaacggttttaacggtttaaccggttaaccctaaaccgttacccgaaaaccgttaaaccggtacccgtaaacccgtttaagtttaacgggttttaaacccgtttacggtttaacgggttttacccgtttaaccggggtaaacccgtttccgggggtaaccccggttaaaaccccggtaagggggtttaaccccccggttaacccccgggtttaaccccgggttacgggggttaacccccgtaaccccgggtaaccccccggttaaaacccggggttaaacccccccgaaaccccccggtttaacccggtttaccccggttaccccgtttaaacccccggg

SEQ ID NO: 287216 - DNA, 806 bp, Homo sapiens
  misc_feature: GYAE6OF02I3O1J.49.62.F07.1.454.CMB.1.raw
  modified_base (348)..(348): a, c, t, g, unknown or other
  misc_feature (348)..(348): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaacgccgggcaggcccctgtgttggtgagtgtaagtaaagacgactggaagtacgggccctacgagggacttcccgtggtacgngtaacttccgtacgtcgggccttaccgacgggtacggtaacggggaacccgtaaccgggtcctaaacgtagtttaccggggacccgaactacccgtaagggttacggggaaccgtttaccgaacgggtacgaacggggtaacgggaacgggtaacgggtcgtacggtaaacgtttaacgttttaacgtttacggttaaactaaacgtaaccgtaaaacgaaccgtaaacccgtaaaccttaaacggtttttaacgggtttaaaccttttttaacggttacggttttaacccggttttaccgggaaaccgttttaccgggtaccgtaaacccggttaaaaccgggtttcccggtaaccccggtttacccggttaaccggggtacccgtacggtaacccccggaaaaccggtaaccccccgaaaccccccgtaacggtttacccgcccgtttaaccccgg

SEQ ID NO: 287217 - DNA, 802 bp, Homo sapiens
  misc_feature: GYAE6OF02HY65E.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttcctccccctcctcactctctgcacaggctcgtgaggcctcctatgagctgacacacgcccaccctcggtgtcagtccgtccccgaggaccacggacggccaggactccgacctgctcgtggatagtcgctattcggaacccaaacgtattaatgttctttagttacggtaaccgagacgaagaacgggccccgggacgaccggttccccttggttcggttggtagtattaggtaaagtaaagacctacgtggacggaccggtccctaggacgggtacctcccgtggaccgtggtacctttcggtccgtacggccttacccggaagggtaccggaacgggtaaaccgtaacggggtaccaacgggttcgtacgggacccttacgtacgtacggtacggtaccggttacggacggacgaacgggaaggggacggtaacggtcgtaacggttaacgttagtttacgttacgttaaccgagtaacctaacgaaaccgtaacctaccgtaaaaagtttccggttaactttacgtttacggttaccggtaaccgttaccgtacggtacccgtaaccggtaaccggtaacccggttacccggttaccgggtaacccggttacccggaaccggtaccccggaaccggtaacccccgttaacccccggtacccgttaccgtacccgttaaccccg

SEQ ID NO: 287218 - DNA, 586 bp, Homo sapiens
  misc_feature: GYAE6OF02FS1W3.49.62.F07.1.454.CMB.1.raw
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (414)..(414): a, c, t, g, unknown or other
  misc_feature (414)..(414): n is a, c, g, or t
  modified_base (579)..(579): a, c, t, g, unknown or other
  misc_feature (579)..(579): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggcaggactcacctgctctggagatgcagttcgaccaaaaccgatatgtcttatcggtacagacaaagccggccacgcccgtgtcgttggngtagtgtaanaaagactactgagacgtcctcgaggactcccgtgacgcgtacttcgtcgtcgctccgtaggtcgaggacgaacgtacactagttcggacctagtcgagtggacgtaccgnggacgaggaaggacggagctacgtaacttagttagttacgacaactacaaactacgaactacctagttacgttattacttcgttacgtacgtaacgtcgaccgacgtaagtcccgtaaccggtaccgtcgggacaccgccgaaccgacccaaccctagtctaccnccttccc

SEQ ID NO: 287219 - DNA, 605 bp, Homo sapiens
  misc_feature: GYAE6OF02HIVX5.49.62.F07.1.454.CMB.1.raw
  modified_base (246)..(246): a, c, t, g, unknown or other
  misc_feature (246)..(246): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaaggatccacctgctcgtggagatgcattcgccaaaacgntatgcttattggtaccagcagaagccgggccacggcccctgtgttggtagagtgtaataaagacacgtgaagacggccctcgagggactccctggacgcgtacttcgtccgtgggcctaccgtagggtcgaacggggtaaccaacggtacacctagttcgggccctaatccgaggttgggacgttccgaggcgaaggacggacggaggacgtggtaacttattagttgactaaatcaacagaaccaccgtaagttcggtactttatcgttacttacggaacttggaccacgtaacggtccgtacccgtcggtcggtaccgacgcccgaaccggacccaaccccgtactccgtactaccg

SEQ ID NO: 287220 - DNA, 592 bp, Homo sapiens
  misc_feature: GYAE6OF02IHAWK.49.62.F07.1.454.CMB.1.raw
  modified_base (234)..(234): a, c, t, g, unknown or other
  misc_feature (234)..(234): n is a, c, g, or t
  modified_base (252)..(252): a, c, t, g, unknown or other
  misc_feature (252)..(252): n is a, c, g, or t
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
  modified_base (359)..(359): a, c, t, g, unknown or other
  misc_feature (359)..(359): n is a, c, g, or t
  modified_base (405)..(405): a, c, t, g, unknown or other
  misc_feature (405)..(405): n is a, c, g, or t
  modified_base (417)..(417): a, c, t, g, unknown or other
  misc_feature (417)..(417): n is a, c, g, or t
  modified_base (436)..(436): a, c, t, g, unknown or other
  misc_feature (436)..(436): n is a, c, g, or t
tcagagtcgagagacacgaccggtgctcgatttagtagtcgcataaagggaaagggggctgtgggtccaggaggcagaactctgggtgtctcaccatggcctggatccctctacttctcccccctctcactctctgcacaggctctgaggcctcctatgagctgacacagcccaccctggtgtcagttcgtccccaggacaggacggccaggactccaccttgcttcgtggatntgactatcgaccaaacgntagtgtcttagttgtaccagcgaagacgccggccacggccctgtgttgtgattgtaataaagcntagngacgcctagaggtactccgtgagcgtattctcgtcggcncgaggtcgaggacacgtcatcttcgcactgagtgacgtacgagganaggacggtacgnggatacgtagtttacgttntttacgactaatacaaacgacgaactacgtagtttacgttaacttagttgttccgttacgtaacgtcgaccgtaaccgtacggtaccgtcccgttacggtacggtacccacggtacccgaaccggtcccaaaccccgtcgttacctaccgtacccg

SEQ ID NO: 287221 - DNA, 653 bp, Homo sapiens
  misc_feature: GYAE6OF02I0PKU.49.62.F07.1.454.CMB.1.raw
  modified_base (301)..(301): a, c, t, g, unknown or other
  misc_feature (301)..(301): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcacctgctctaggagatgcattcgacccaaaccgatatgtcttagttggtaccagcaagaacggccgggcccacggcccctgtcgttggngtatgtataaagacatgagacggcctcgagggactcccgtaggacgacgtactttctcgtcggcctccgagggttcgaacgggtaacgaaccggtcacgtagttcggaccatcgtaggtaggacgtccgagggcgaaggacggacgagggctaggtacttagttagttcgtactaataccaaacgaacgactaaccgtagttttacggttaatttacgtttgttaccggtttacggtaaccgttcggaccgaacccgttaagggtaccccgttacccggtccggttacgggtacccaccgggaacccgtaaccgggaaccccaacccgtacccgttacggtacccttacccg

SEQ ID NO: 287222 - DNA, 783 bp, Homo sapiens
  misc_feature: GYAE6OF02FJGPB.49.62.F07.1.454.CMB.1.raw
  modified_base (340)..(340): a, c, t, g, unknown or other
  misc_feature (340)..(340): n is a, c, g, or t
tcagagtcgagagacacgaccggtgctcgatttagtagtcgcataaagggaagggggctgtgggtccaggaggcagaactctgggtgtctcaccatggcctggatccctctacttctccccctcctcactctctgcacaggctctgaggcctcctatgagctgacacacgcccaccctggtctcagttcgtccccaggaccagccggccaggactccacctcgcctcgtggacgctcgctagttcgaccctaaaccgattacgtcgtaccttagttcggtaccacgaccgtaacgaaccggccccgggcccaaccggtcccccgttaggtcttcgggtanagttacgtaaagtaaacggacctacgttaggaaccggtaccggtccccgttaaggaacgggtaccttccccgaggtaccgtaccggtactttccgtacggttccggtacccgtttacccggaacgggttaccggaaccgggtaaccgtaaccgggttaccaacgtacggttaccggaccctaacgtccgtacgggtcggaccgtaccgaaggcgaacggacggacgtacgtcgtacgttaacttacgtttacgtacgttacaaactccgaaacgtacgaaaccttaccgttaggtttaccgttaacctttagtccgtttaacggttacgaacccgtacggtaccctaacccggacggttaaccccgaccggttccggtaacgggcccaaccggaccccggtaaccggacccccctacccggacgttttcgacccgtttacccg

SEQ ID NO: 287223 - DNA, 808 bp, Homo sapiens
  misc_feature: GYAE6OF02I3AMP.49.62.F07.1.454.CMB.1.raw
tcagagtcgagagacacgaccggtgctcgatttagtagtcgcataagggaaagggggacgtgtggggtccaggaggcagaactctgggtgtctcaccatggcctggatccctctacttctcccctcctcactctctgcacaggctctgaggcctcctatcgagctgacaccagtcccacccgtcggtcgtcgacggttcgtccccgacgggaccaggaccggccgaggactcgacctgcctcgtggagatcgacattcgaccaaacccggtattacgtacgtctttaagtttcgggtaaccgacggtaccaacggtaaccgggacccggggccccggtaaccgggtccccccgttagggttcggtttaggggttacggtagttacggtaactaaacgacgtaaccgtaggaggtaccggtcccgtacgtacgggtaactcccggtaggtacgtacggttacttccgtacggtcggtccgttaccggaacgggtaccgaacggggtaccaaacgggttcccgaaccgtacgtttaccgggtaccctacggtcggtaaggtccggggtaagacccggtaaggggacctaagggggaacggggaaccgtagggtacccgttaacggttacgtttaacgttttagttaacgttaccgtaaactacggaacaaccgttaacccgctaagggttttacgtaacttttcgtacggttaaccgttacggacgttaccaccggtaacgtcgggtaccaccggttcccgagggttaccacggtacccggaccggtacccaccccgtagtctccgtacg

SEQ ID NO: 287224 - DNA, 764 bp, Homo sapiens
  misc_feature: GYAE6OF02H0087.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctcccctcctcactctctgcacaggctctgaggcctcctatgagctgacacagccaccctcggtgtcagtgtcccaggacagacggccaggactcacctgctcgtggagatgctattgaccaaacgatagtcgtcttagttcggtaccagcaggaacgccgggtaccacggtcccctggtgttggcgtaattgtaataaacgactactaggagacggaccctgagggtactccccgtaggacgtacggtactttcgttcgtacggtccttaccggtaagggtccgaaacggggtaccgtaaaccgggttacaaccgtaggtttaccgggaccgtaagtaccgtaagggttcggaaccggttacgacgggactagggaaacgggtaccggtagggaccgttacggtaacgtttaagtttaacggtttacgtaacgtaaacttacccgaaacgtaacgtaaacccgtaaccgtaaggttttacggtaaccgttttacgtaccggtttcgttaaccggtaaacttccggaaccgtaacccgttaacgggtccctaaacccgggtttcccgtaacggggttaccctaaccgggtaccccctaaacgggtaccccctaaacccccggtacgtacccggttaccgtaaccccgg

SEQ ID NO: 287225 - DNA, 663 bp, Homo sapiens
  misc_feature: GYAE6OF02GZHO3.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaccgatatgcttattgtaccagcagaacgccggccacggccctgtgttggtgatgtaataaacgacactggagacgccctacgacgggacccctgacgacgacttctcgtggcctaccgagcctacgaacgggaacaacgacgtacaccgttagaaccctatccgtaaggtcggaccggttacccgggacctaagggaacgggaacggtacggactacggtaaaccttaacgttaacgttacgtaaccgtacggtacccgagaacgtaacgaacgtacgaaggtcggtaacgttaagttacggtacgttacgtaacggttccgggtacgggaacgggtaccttaaggtaccgtaccggtaacccgtacccggtaggtacccgacgggaccctaaacggccctttacccggacccgttacccgg

SEQ ID NO: 287226 - DNA, 728 bp, Homo sapiens
  misc_feature: GYAE6OF02F84D1.49.62.F07.1.454.CMB.1.raw
  modified_base (229)..(229): a, c, t, g, unknown or other
  misc_feature (229)..(229): n is a, c, g, or t
tcagagtcgagagacacgaccggtgctcgatttagtagtcgcataaagggaaagggggctgtgggtccaggaggcagaactctgggtgtctcaccatggcctggatccctctacttctcccctcctcactctctgcacaggctctgaggcctcctatgagctgacacacgccaccctcggtgtcagtcgtccccaggacagacggccaggactcacctgctcgtggagntgctattcgaccaaacgatatcgtcttagttcggtaaccagtcgaagaacggcccgggaccacgggtccccttggtggttcggtgtacgttagtaataaaacgaccacgtaggaaggtaccgggccctacggaagggtcctccgtggacgtcgtacttcgtcgtcggcctaccggtaggtacgaacggggtaactaaccgggtaccaacggtacgttcggaaccctagtaccgtagggtacggacggtcccggaaggtccgaaagggtacgggaacgggcggtaacgttggtaaaccgttagttttacgttaacgtactaaacgttaccgaaaccgtacgtaaccctaaccgttagtttaaccggttactttacgtacggtttaccgttaacggaacgttcgaccgtaccgttaaccggtacccgtacccggtttcggtacgggtacccaaccggacccgtaacggaccccctaaccgcgttaccggtcccttaacccg

SEQ ID NO: 287227 - DNA, 639 bp, Homo sapiens
  misc_feature: GYAE6OF02HISQ8.49.62.F07.1.454.CMB.1.raw
tcagagtcgagagacacgaccggtgctcgatttagtagtcgcataaaagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtggagatgcattcgaccaaaccgatatgtcttagttggtaccagacaagacggccgggccacggcccctgtgttggtgatgtaataaagcactgagacggcctcgaggctcccgtgacgcgtacttccgtcgtggacctccgacggtacgaacgggaacgtaacggtcacgtacgttcggacctagtcgaggtcggacgtcgaggacgagggacgggacggacggtctagtaacttagttagttcgtaactaactaccaacgacgtaaccaacgttagtttacggttaactttagttcgttacgttaaccggtaacgtacggaccgtaaccgtacggtccgtacccggttcggtaccgggtacgaacccggcccgaaccggacccctaaccccgtacgttaccgtacctaacccg

SEQ ID NO: 287228 - DNA, 920 bp, Homo sapiens
  misc_feature: GYAE6OF02HCDTJ.49.62.F07.1.454.CMB.1.raw
  modified_base (187)..(187): a, c, t, g, unknown or other
  misc_feature (187)..(187): n is a, c, g, or t
  modified_base (265)..(265): a, c, t, g, unknown or other
  misc_feature (265)..(265): n is a, c, g, or t
  modified_base (896)..(896): a, c, t, g, unknown or other
  misc_feature (896)..(896): n is a, c, g, or t
tcagagtcgagagacacgaccggtgctcgatttagtagtcgcataaaagggaaagggggctgtgggtccaggaggcagaactctgggtgtctcaccatggcctggatccctctacttctccccctcctcactctctgccacaggctctgacggcctcctatgagctgacacacgcccacccgtggtntcaggtcgtccccgaggacaggaccggccaggactccacctgactcgtggatatgactacgttacgaccaaaaccgtntacgttcgtctttaagttcggtaaccagacctaaggaaccggccccgggacccgaccggtccccgttggttcggtttaggtgtaacgttagttaaacgtaaaacggtaccaacgttggaacggaccggtaccccgtacggacgggtacttccccgaggtaacgtccgttaactttcgtacgtcggtacccgtaccgtacgggtacgaacggggtaaccgtaacgggtttaccaacgttacggttaccgggaccttaacgtacggtacgggtaacgggtacccggtacccggtaaggggaacgtaacgggggaaccggtaaccgggtacgggtaccgttacggttaaccgtttaagttttaacgttccggttaaaccgttaaacttacccggaaaacgttaacccggttaacccgtaaacccgtttagggtttttaaacccggtttaactttaccgggttttaccggttaacccgggttttaaacccggaaccgggttttaaccgggtaaaccccggttaacccggttaaacccggggtttcctaccccccggggtttttacgggaccgggtttaaccccggaccggtaaacccccggtaaacccgggtacccccttaaaacccccgggttnttaccccggttaacccttccccgg

SEQ ID NO: 287229 - DNA, 880 bp, Homo sapiens
  misc_feature: GYAE6OF02JIYKP.49.62.F07.1.454.CMB.1.raw
  modified_base (231)..(231): a, c, t, g, unknown or other
  misc_feature (231)..(231): n is a, c, g, or t
  modified_base (255)..(255): a, c, t, g, unknown or other
  misc_feature (255)..(255): n is a, c, g, or t
tcagagtcgagagacacgaccggtgctcgatttagtagtcgcataaagggaaaggggctgtgggtccaggaggcagaactctgggtgtctcaccatggcctggatccctctacttctcccctcctcactctctgcacaggctctgaggcctcctatgagctgacacagccaccctcggtgtacagtcgccccaggacagaccggccaggatccacctggcctcgtggaacntcgctagttcgaccgaaaaccgtnttacgtcgtccgtttaagtttcggttaacccgaaggtaccgtaaaggtaaacggccccgggggtacccggaaccgggtcccccccgttagggttcgggtttttgggtaggaacggttaggttaaacggttaaaaacggaaccgtaacgtacggtaacgggaaccgggtcccccgttacggtaaaggggggtacctttccccccggttaaggaccggtaccggtaaccttttccgttaaccgggttcgggtacccggttacccgttaaggggttacccggtaacgggggaaacccgtaaacccggggtaccgtaaaccctaacggttttcgggaccctaacgttaccggtaaacgggtcgggaccgttacccggagggtaccagggtaaccggggaacggtaccgggtacgtgggtaaccttaacgtttcggtacgttcgtaaacgtcccgtacgtaaacgggtacccaagccgtaagggttcggtacccgttaagggttaacgttcgttacggttacgttccggggtacggggtaacggtaccgtacgggtacccgtacggttaccgtacccggttaacgggtaccaccggtaacccggtaacggtcccgtccggtaacccccgg

SEQ ID NO: 287230 - DNA, 856 bp, Homo sapiens
  misc_feature: GYAE6OF02GJBA4.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacacgccacccgtcggtgtcagtcgtccccaggacagacggccaggatccacctgctcgtggagatggctattcggaccaaaaccgtatacgtgtacttaagttcggtaccagtacgaagtaacggcccgggaccgaccgggcccccttggttcggtttggtagtacgttaggttaaataaaacggtaccaacgttagaagggtaccggacccgttacggaacgggtaccttccccggtaggaacggtaccgtagtttaccgtcgttcgggtccttaccggtaacgggttaccgaacggggtaacctaaaccggggtccgaaacgttacggttaccgggacctaagttccggtaaaggtcgggaacggtcccgtaacgggaccgaggggaaacggggtaaccggtacgggtaccgttacggtaaactttaacgttttaacgtttaccggtaacgttaaacgttaccgaaaaccgtacgtaaacccgtaacccgttagttttaaccggggtttaaccttttaagttaccggttttaacccggttacggtaaccgttaacgggtacccggttaaacccgtaacggggttaaccccttaacccgggttacccggttacgggtacccgtaaaccggaccccgtaacccggtaccccgtaaacccccggtacgttaccggtacccttaaccccgg

SEQ ID NO: 287231 - DNA, 729 bp, Homo sapiens
  misc_feature: GYAE6OF02HC7VK.49.62.F07.1.454.CMB.1.raw
  modified_base (252)..(252): a, c, t, g, unknown or other
  misc_feature (252)..(252): n is a, c, g, or t
tcagagtcgagagacacgaccggtgctcgatttagtagtcgcataaaagggaaagggggctgtgggtccaggaggcagaactctgggtgtctcaccatggcctggatccctctacttctcccccctcctcactctctgcacaggctctgaggcctcctatgagctgacacagcccaccctcggtgtcagtcgtccccaggacagacggccaggactcacctgctctggagatgcattcgacccaaaaccgtntatgtcttagttggtaccagcagaacggccgggccacggcccctggtgttcggtagattgtaactaaagacctacgtggaacggacggcccttacggacgggtactccccgtggtacggtcgtaactttccgtcgtcggtcctaccgaggttaccgaacggggtacctaaaccggggtcaaacgtacgtttcgggaccctagtaccgaggttacggacgttaccgagggtaccaagggaacgggaccggaggtaccgtacggttaaacgtttaattttaacgttacgttaccgaaatttacccgaaacgaacggtaaacccctaacgtagttttaccggtttaactttaagttccggtttaccgttaccgggaacctttcggtaccgaaccgtacgggttccctacccggttcggtacgggtaccgaaccggacccgtaacccggaccccaacccgtaccgtccgtaccttaccccg

SEQ ID NO: 287232 - DNA, 692 bp, Homo sapiens
  misc_feature: GYAE6OF02H8F99.49.62.F07.1.454.CMB.1.raw
tcagagtcgagagacacgaccggtgctcgatttagtagtcgcataaaagggaaagggggctgtgggtccaggaggcagaactctgggtgtctcaccatggcctggatccctctacttcctccccctcctcactctctgcacaggctctgacggcctcctatgagctgacacacgcccaccctcggtgtcagtcgtccccgaggacacggacggccaggactcacctgctcgtggagatgctattcgaccaaaccgatatgtctttagttacggtaccgagacaagacggccgggccgaccggtcccgtcggttggttggtgtaccccccccgttagttaagtaaagaacgacgtagacggacggcccgtacgacgggtacgtccgtggacgtcgtacttcgttcgtcggtcctaccggtacggtacggaacggacgtaaccgtacgtacgtacgttcggccgtacgtacgtacggtacggtacgtacgacggacgaggacggacggacggtacgtacgtaacgttattagttacgtactaactaacaacgacgaacgtacgtacgttacgttacgttacgttcgttacgttaccggtacgtacgaccgtaccgtaacggtccgtaccgttaccggtcggtaccgaccgacccgaccggaaccccgaaccccgtaccgtaccgtacctacccg

SEQ ID NO: 287233 - DNA, 699 bp, Homo sapiens
  misc_feature: GYAE6OF02G729X.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagcccacccgtggtgtcagtcgtccccgaggaccaggaccggccaggactccacctgcctcgtggacatgctattcgaccaaaccgatatgctttattcggtaccagcagaagccggccacggccctgttgttggtgagtgtaagtaaagacgatagaagacggccctacgagggtctcccgtgacgcgtattcgtcgtcgtcctccgaggtacgaacgggactaaccggtcacgtagttcgggacctagtcacggtcggaacgtccgaggcgtaagggacggaacggaggtctaggtaacttagtttaacgttcgtactaacgtacgaaacgaacgtaaccctaacgttaacgttacggttaacctttagttcggtttaaccgttaacgggtaaccgtacgggtaccctaacgggttaaccggtaacccggttacccggttaccggttaccggggtaccgtaacccgggtaccccgtaacccgggaccccctaaacccccgtacggttacccgttacccgttaaccccgg

SEQ ID NO: 287234 - DNA, 811 bp, Homo sapiens
  misc_feature: GYAE6OF02IAMWG.49.62.F07.1.454.CMB.1.raw
  modified_base (260)..(260): a, c, t, g, unknown or other
  misc_feature (260)..(260): n is a, c, g, or t
tcagagtcgagagacacgaccggtgctcgatttagtagtcgcataaagggaaggggctgtgggtccaggaggcagaactctgggtgtctcaccatggcctggatccctctacttctcccctctcactctctgcacaggctctgacggcctccgtatgagctgacacagcccaccgtggtgtcagtcgtcccaggacagacggcagggatcgaccgtgcctcgtagggactatcgactaacgttcgacccgtaaaacggtntaacgtcgtacctttaagttacggtaccagacgtaaggaaacggcccgggaccgaacgggtcccccttaggttacggttaggtacgtaagttacggttaacgtaaaacggaacctacgttacggaacggtaacgggaccccgttacggaaggggtaccttccccggtaggaacggtcgtaaacgtttccgtacgttacggaccgttaaccggtaacggttacggaaacggggtacgtaaaccgtccgaacgtacggttacgacccgtaacgtacgaacgggttacggtaacgttaccgacgggaaccgaagggaacggttaacgggacgtaacggttacgtaaacgtttaagtttaacgtaccgtttaacgaactaaccaaacgtacgaaaccgtaccgttaacgttcggttaactttaagtccggttaacgtacggaaaccgttcgaaccggtaaacccgtaacggtacccgtaacccggtcggttaaccggtaccaaccggtccgaaaccgggtcccctaaacccgtcgttaccgtaccttaaccccgg

SEQ ID NO: 287235 - DNA, 671 bp, Homo sapiens
  misc_feature: GYAE6OF02HKGF6.49.62.F07.1.454.CMB.1.raw
  modified_base (234)..(234): a, c, t, g, unknown or other
  misc_feature (234)..(234): n is a, c, g, or t
  modified_base (259)..(259): a, c, t, g, unknown or other
  misc_feature (259)..(259): n is a, c, g, or t
  modified_base (615)..(615): a, c, t, g, unknown or other
  misc_feature (615)..(615): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctggagcctcctatgagctgacacacgcccacccgtcggtgtcagtcgtaccccgaggacaggacggccaggactcacctgctcgtgganatgacagttacgacccaaaacggtntagtgtctttagttcggtaaccagccaaggaacggcccgggcctaaccgggccccgtggtggtttcgggtagaagttagtaataaacggactaacgtggacggacggtccccgtaggacgggtcctccgtaggacgcgttacttccgtcgtcggccttaccggaagggtccgaaagggaccgtaacggtccacgttagtccggctaagtcgagggtgacggtacgacggacgaggaggacggaggtcgtacggtaactttagttagttacgaacgtaacacaaacgtaacgaacctacgtagttaacggtactttagtacgttcgtttaacgacgtcgaccgtaacgtacggtccnccggttacgtcggtacgaccgcccgtaacgacccctaaccctcgtccgtacctacc

SEQ ID NO: 287236 - DNA, 583 bp, Homo sapiens
  misc_feature: GYAE6OF02JBBIA.49.62.F07.1.454.CMB.1.raw
  modified_base (170)..(170): a, c, t, g, unknown or other
  misc_feature (170)..(170): n is a, c, g, or t
  modified_base (184)..(184): a, c, t, g, unknown or other
  misc_feature (184)..(184): n is a, c, g, or t
  modified_base (231)..(231): a, c, t, g, unknown or other
  misc_feature (231)..(231): n is a, c, g, or t
  modified_base (254)..(254): a, c, t, g, unknown or other
  misc_feature (254)..(254): n is a, c, g, or t
  modified_base (271)..(271): a, c, t, g, unknown or other
  misc_feature (271)..(271): n is a, c, g, or t
  modified_base (347)..(347): a, c, t, g, unknown or other
  misc_feature (347)..(347): n is a, c, g, or t
  modified_base (432)..(432): a, c, t, g, unknown or other
  misc_feature (432)..(432): n is a, c, g, or t
  modified_base (487)..(487): a, c, t, g, unknown or other
  misc_feature (487)..(487): n is a, c, g, or t
  modified_base (554)..(554): a, c, t, g, unknown or other
  misc_feature (554)..(554): n is a, c, g, or t
  modified_base (577)..(577): a, c, t, g, unknown or other
  misc_feature (577)..(577): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatggagctgacacncgccacccgtggtntcagtcgtccccaggacaggacggccaggactcacctgctcgtgganatgactattcgaccaaaaccgtntatgtcttagttcgacngacagacggccggccacggtcctggtggttgagtatgtaataacgtacacgtagagacgccctagacgggctccgnggacgcgtatcctcgtgccgtcgaggtccggacggaacgtaacgtcactaggttccgactagtcgaggtacggagttccggaggngtaaacgggacggaacggaggtaccgtagtaactttagttaacttcgtaacacanaactacgacaccttagttcgtattcttgtctacggacttggaccagaccgtcgaccgttcgagggcnccgactaccgacccactacgtcncctacg

SEQ ID NO: 287237 - DNA, 766 bp, Homo sapiens
  misc_feature: GYAE6OF02JCUTL.49.62.F07.1.454.CMB.1.raw
  modified_base (140)..(140): a, c, t, g, unknown or other
  misc_feature (140)..(140): n is a, c, g, or t
  modified_base (182)..(182): a, c, t, g, unknown or other
  misc_feature (182)..(182): n is a, c, g, or t
  modified_base (256)..(256): a, c, t, g, unknown or other
  misc_feature (256)..(256): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacnggctctgagcctcctatgagctgaacacagccaccctcggtntcagtcgtccccaggacagccgccaggatccacctgctcgtggagatgctattcggaacccaaaccgattactnacttagttcggtacacgacaggaacggccccgggaccaacggtcccccgttggtggttacgggtgacgttgttaaagtaaaacgtaccgtacgttacggacgggtaaccggtacctcggtaacgggtaacttccccgtacggaccggtacggtactttccgtaccgttcgggtccttaccggtaggtaccgaacgggtaaccgaacgtaccgactaacggttcggactacgtaccgtaggtacggtaggtaccgtaggaccgtaaggaccgggtagaacggtactacggtaaaccgtttatttacggtttacgtactaaacggttacaaacgtcgaaaccgttaccgtacgttttacggtttaacctttaagtttcggttaacgttaccgggtaaactccggtacggtaaacccaacggttcccgttaacccggttcgttacccgggttaacccgaccgtacccggaacccgtaacccgttaacccccgacgttacccgtacctaacccg

SEQ ID NO: 287238 - DNA, 541 bp, Homo sapiens
  misc_feature: GYAE6OF02JC81N.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcaagaagccgggccaggccccctgtcgttggtgatgtataaagacactgagaggccctcgagggactccctgagcgattctctggctccgaggtcagggactaacggtcaactagttcggcctagtcaggtgacgttccgaggcaggacggacggaggctgacttattattgctaagtcaacagaacaccgtaagttggtaactttatcgttacttcggtaactgacgacacggtcaccgtcgtcggctacgccgaacggcccaacccactcgtctaccg

SEQ ID NO: 287239 - DNA, 647 bp, Homo sapiens
  misc_feature: GYAE6OF02HISV6.49.62.F07.1.454.CMB.1.raw
  modified_base (181)..(181): a, c, t, g, unknown or other
  misc_feature (181)..(181): n is a, c, g, or t
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctggtntcagtcgtcccaggacagacggccaggatcacctgctctgganatgcattcgaccaaaacgntatgcttattggtaccagcagaggccaggccaggcccctgtcttggtgtactttataaagtctttggagacggtccctcgacggtaccctggacgcgattcctctcggccttccaagtcctacgaacgggactaaacgtacggtacctaccgtttcgaacctagttacgacggtacgggtacggttacccgggacccgtaaggggaacgggaacggaacgggtacgtacggaactttaacgttaaccgttgtacgtacgtccgacacgtacgacgaccgtaggtcggacctagtttatcggttacgttacggttcggacgggacggttaccgtacggtaccgtcgtaaccgttccgtaggtccgaacgggccctaggtacccgtcggtacccccgttggtaccc

SEQ ID NO: 287240 - DNA, 630 bp, Homo sapiens
  misc_feature: GYAE6OF02I8J6P.49.62.F07.1.454.CMB.1.raw
  modified_base (501)..(501): a, c, t, g, unknown or other
  misc_feature (501)..(501): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgctattcgaccaaaaccgatatgcttattggtaccagtcagaacggccgggaccacggtccccctggttgttgggttgagtgtaataaagactacgtagacggaggcccgtacgagggtactcccgtagagccgtattccgtacgtcggtacctccgtaggtcgaagggtaccaacggtcacgacgttcggacatcctagttcggtagtcccgagggtcaaggacggacgtacggtcgtaggtaacttagtttactacggtacataccgaanacgtaactacctagtttacggtaactttatcggtacttaccgaactcggaccgtaccgtaagtcccggtaccgttaccgtacgggtcaaccgcccggaacgaccccgaacccttagcgtaccctaccgg

SEQ ID NO: 287241 - DNA, 630 bp, Homo sapiens
  misc_feature: GYAE6OF02INVT1.49.62.F07.1.454.CMB.1.raw
  modified_base (247)..(247): a, c, t, g, unknown or other
  misc_feature (247)..(247): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtcccaggacagaccggccaggatcacctgctctggagatgctattcgaccaaaaccgntatgtcttagttggtaccagcagacgccggcacggccctggtgttggtgatagtaataaagactacgtgaggacggtccgtacgagggtactcccgtgagtcgtacttctcgtcggtcctaccgtaggtcgaacgggacgaacgtcacgtagttacggcctagtacgaggttacggcgtccgaaggtcgaaggagggaacgagggtctagtacttattagttagtacaatacaaacgacgaacacgttagtttaggtaacctttagttcgttacgttaacggtaacgtcgaccgtaaccgtaacgggtcctaacccggttcgtacgggtaccaaccgacccgtaaccgggaccccaaccccgtcgttaccgtacccttacccg

SEQ ID NO: 287242 - DNA, 874 bp, Homo sapiens
  misc_feature: GYAE6OF02FHIGR.49.62.F07.1.454.CMB.1.raw
  modified_base (180)..(180): a, c, t, g, unknown or other
  misc_feature (180)..(180): n is a, c, g, or t
  modified_base (221)..(221): a, c, t, g, unknown or other
  misc_feature (221)..(221): n is a, c, g, or t
  modified_base (251)..(251): a, c, t, g, unknown or other
  misc_feature (251)..(251): n is a, c, g, or t
tcagagtcgagagacacgaccggtgctcgatttagtagtcgcataaagggaagggggctgtgggtccaggaggcagaactctgggtgtctcaccatggcctggatccctctacttctcccctctcactctctgcacaggctctgaggcctcctatgagctgacacagcctaccctgggtntcagtcgtcccaggaccagacggcaggtactcacctgctcnggtagactcgcagttcgacccaaaaccggnttactcggtaccttaattcggtaaccacggtcaacggaaacggccccgggaccctaacggggtccccccgttgggttacgtttagggttagagttaagtaaacgttaaaagacctaacgttggaacggacggtcccctaggtaacggggaccttaccccggtaggacggtaccgtaacgtttccgtaccgttcggggtctttaccccggacgggttaaccgaacggggggtaaaccctaaaccggggtttaccctaaaccggtaccgggttttaacgggaccccttaaacgttaccgtaaacggggttccgggaacggtttaaccccgaagggggtaccaaacggggtaccggggtaaccgggtaacgggtacttacgggtaaacttacgttttaaacgttacggtacctaaacggttacaaacgttaacggaccttaaaccgtacgtttaacgggttttaacctttaagttacgtttaccggttaaacgtaccgttacgggacccgaaccgtttaacgggttaaccccggtacccggttaccgggttcgggtttaacccaccggtttaaccccgaacgggtaacccctaaccccggtacgttacccgtacccgttaaccccg

SEQ ID NO: 287243 - DNA, 582 bp, Homo sapiens
  misc_feature: GYAE6OF02FIDV9.49.62.F07.1.454.CMB.1.raw
  modified_base (242)..(242): a, c, t, g, unknown or other
  misc_feature (242)..(242): n is a, c, g, or t
  modified_base (571)..(571): a, c, t, g, unknown or other
  misc_feature (571)..(571): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaacggccgggccacggccccctggtgttggtgatgtaataaagacactgagacggccctacgagggactcccctgacgcgatttctcgtggctccgaggtcgagggaacaacggtcacgtagttcggcctagtcgaggtcggtacgtaccgagggccaaggaacgggtacggaagggcttaggaacttaatttattcggtacaactaccaaagtacgacacctagtttcggttactttagtctcgttacggtaactagaccgaccgaagtccaccgtccgtcggtcacgacccgacgaccccaacccnctcgtactccg

SEQ ID NO: 287244 - DNA, 740 bp, Homo sapiens
  misc_feature: GYAE6OF02IWUUW.49.62.F07.1.454.CMB.1.raw
  modified_base (166)..(166): a, c, t, g, unknown or other
  misc_feature (166)..(166): n is a, c, g, or t
  modified_base (238)..(238): a, c, t, g, unknown or other
  misc_feature (238)..(238): n is a, c, g, or t
  modified_base (259)..(259): a, c, t, g, unknown or other
  misc_feature (259)..(259): n is a, c, g, or t
  modified_base (263)..(263): a, c, t, g, unknown or other
  misc_feature (263)..(263): n is a, c, g, or t
tcagagtcgagagacacgaccggtgctcgatttagtagtcgcataaagggaaagggggctgtgggtccaggaggcagaactctgggtgtctcaccatggcctggatcccctctacttcctcccccctccctcactctctgcacaggctctggaggcctcctatganctgacacacgcccaccccgtcggtgtcacggtcgtcccccaggacaggccggccaggatcacctgctctggnatgcattcgaccgaaaaccgntatntacttacgttaggaccagcgaagaaccggcccggaccacggtcccttggtggtttgggacgtagttaggtaacgtaaagaaccgtacgtaggacggtaccggtaccccgtaggacgggtaccttaccccggagggtaaccggccggttaacttccggttgtacgggcccgtaccgtagggtaccggtaaacgggaacgtaaccggggtacctaaccgtaagttcccgggactaactcggtagggtacggaacggtaccgagggcgaacgggacgggacggaggtctaggttaaccttagtttagttctactaaataacacgaacgacctaacgtagtttacggtacgttaacgtcgtttacgtacggttaaccgtacggtaccgtaaccgtacggtaccgttacccggtaccggttcggaccggtaccggaccctaaccgggtaacccctacccggacgttacccgtactaccccgg

SEQ ID NO: 287245 - DNA, 788 bp, Homo sapiens
  misc_feature: GYAE6OF02JCBZ7.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatcgagctgacacagcccaccctcggtgtcagttcgtccccaggacagacggccaggatcactgctctggagatcgcattcggacccaaaaccgatacgttcgactttacgtttacgggtacctacgaccgaaggaaaccggtcccgggggccccaacgggtccccctcgggttggtttacgggttaggtataacggttaacgtaaaacgactaccgtacggtaacgggaccgggtaccccgttacggaagggtacccgtaccccgttaggaacgtacggtactttaccgtccggtacggtccttacccgggaggtttaccggaacggggtaaccgtaaaccgggttccgaaccgtagttaccggaccttaagtccgtagggtacgggtacggtacccgtagggacgtaggaacgggacgtaaggccgtaggtaacttagtttactggtaactaactaccaacgaacgtaccaccgttaagttaccggttaccgtttaagttacgttacgttaacggtacctcgggtaccgtaaccggttacgtaacccggtaccgttaccggtacggtacggtaacccgaacccggtacggaccccctaaaccccggtacgtttacctacccggttaaccc

SEQ ID NO: 287246 - DNA, 733 bp, Homo sapiens
  misc_feature: GYAE6OF02JJBEL.49.62.F07.1.454.CMB.1.raw
  modified_base (181)..(181): a, c, t, g, unknown or other
  misc_feature (181)..(181): n is a, c, g, or t
tcagagtcgagagacacgaccggtgctcgatttagtagtcgcataaagggaaagggggctgtgggtccaggaggcagaactctgggtgtctcaccatggcctggatccctctacttctcccctcctcactctctgcacagctctgaggcctcctagtgagctgacacagccaccctcggtntcagtcgtccccgaaggacacggaccggccagggacttccgaccctggactccgtgggactagtcgctattacgaaccgtaaaaccgataattgtacttacgttcggtacctagtacgaacggaacggcccgggccgaaccgggtcccccgtaggttcggttacggtacggtacgttacgtaaagtaaaacggaaccaacgttacggaacggaccggtacccgtaccggtaaccgggaccccgtacggtaacggaccgtacgttacgttaccggtacggtactaaccgtacggtaccgtaacgtaacgggaaaccaacgttaaccggtacctaaccgttacgtaccgtacgtaaccgtacgggtacggtacggtacccggaacgacgggtaagaccggtagacgtacgtaatacgttacgtcgtacgtacgtccgacgacgacgagtacgtacgaggtacgtagttacgtcgtcgtacgtacgggtacgacgaccgttcgagtaccggtcgtacgtcgtacgacggaccgtacgtcccgtcgtacccgtacg

SEQ ID NO: 287247 - DNA, 767 bp, Homo sapiens
  misc_feature: GYAE6OF02JNNI3.49.62.F07.1.454.CMB.1.raw
  modified_base (228)..(228): a, c, t, g, unknown or other
  misc_feature (228)..(228): n is a, c, g, or t
  modified_base (250)..(250): a, c, t, g, unknown or other
  misc_feature (250)..(250): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacgccaggactcacctgctacgtgganatgctattcgaccaaaaccgtntagtcgtacttagttacggtacacgacgaacggacggcccgggaccgaccggtcccgtaggttcggttacggtacgtagttaggttaaacgtaaacgtaccgtaacgtacggacggtacccggtaccccgtacggtaacgggtaccttcccgtaaggaccgtaccgttacgttcccgtacgtaccgggtaccgttaccggtaacgggtaccggaacgggtaaccgtaaccggttacctaacgtacggttacggtacctaagtcggtacggtacggtaccggtaccgacggacgaggacgggacggtacgtacgttacggtaactttacgttacgttacgtaacgtaaactaccgaaacgtaccgtaaccgtaaccgtttagttaacgttaactttacgttcgttaccggttaaccgtacgtcggtacccgtacgtaaccggtcccgttacggttacggtccggtaaccaccggaacccgtaccggtacccctaacccgtccgttaccgtacctcccg

SEQ ID NO: 287248 - DNA, 857 bp, Homo sapiens
  misc_feature: GYAE6OF02JVFVK.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctcgtgacggccttcctatgacgctcgaccacgacgccctacccgtcgggtcgtccaggttccgccccgaggacacggaccggccaggactccaccgtggcctcgtagggacgtctcggacctaagttcggaacccaaaaccggattacgtcggttactttacgttacggtaaccacgacgacggtaaccggcccgggaccgaaccggtcccccgttgggttcggtttacgggttggtacgttaggttaaacgttaaacgaaccggtacgttacgggaacggtaacccgggtaccccttacgggtaaaccgggtccgttaccccggtaaggtaccggtaacgttctttaccggttccggtacggttacccttaccgggtacgggtaacgggtaaccggggtaacgtaaccggtacccgtaacgttacggttacccgggtacgacgttacggaaccggttaggggtaaccgtacccggaagggacgtaaccgggaaagggggtacgtacggtaccgtggttaaactttattaacgtcgtaaacctagactaaaccgtacgtaccgaacgttaagttcgtttaacttgttaccgttaacggttaccgacgttacgacccggttaacgaccggttaaccctccggttacggtaccggtcccgaaacgttaccccggaaccgtaccccgttaaacccggtcttacggtaccctacccgg

SEQ ID NO: 287249 - DNA, 918 bp, Homo sapiens
  misc_feature: GYAE6OF02JBREL.49.62.F07.1.454.CMB.1.raw
  modified_base (682)..(682): a, c, t, g, unknown or other
  misc_feature (682)..(682): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcacctctctgcacaggctctgaggcctcctatgagctggacacacgccacccttggtctccaggtctccccgaggaccacggaccggaccgacggtactcctaccggtcgtccttacgggtggaacgacgttacggccttaacgtttaccgaacccgaaaaccgtagttaacgttcgttaccgtttacgttaccggtaccggacggacgtaacgggaccggtccccgggtaccgtcccggtacccgttagggttacggtttacggtaaggttaacgttaacgttaaaccggtaaacggtaaccgtacggtaccgggtaccgggtaaccccgggtaccggtaaccggtaaccggtaccccgtttaccggtacggtaccgggttccttacccgtttaccgggtccggtacgggtcccgttaacggggtaaccggtaccgggtaaccggtaaccggtaccggtacgttaccgggaccggtttacgacccgtacggtacggtacggacccggttacggacgggaccgtacgggaggggtaacccgggttaggacggttnaacgtttacttaggtacgtacgaaccaacgtccgaaatacccggttagttcggtttaacgtttaccgttaccgtacgggttaccgttacggtaccgaaccgttcccggacccggtacggtttacccggcccgggttaaccgtaaccggtaaccccgggttaccgacccccgtttaaccccgggaacccttacccccggttaaccgcccgttttaccccggttaccttaccccccgg

SEQ ID NO: 287250 - DNA, 725 bp, Homo sapiens
  misc_feature: GYAE6OF02HRIDP.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctagacacacgcccacccgtcggtgtcaggtcgtcccaggacaggcggccaggactccaccgtgctcgtggagatgcctagttcgacccaaaccgtatatgtctttagttcggttaccagacgtacggaacggcccgggacccgaccgggtcccccgttggttggtttacgggtgaagttaggtaaagtaaaacggactacgtaggaacggtaccggtcccgtacggacgggtaccttccccggtaggacggtacgtacgtttcctcggtcggtccgtacggtacggttacggaacgggtaaccgtaaccggtaccaacgtagttcggacctacgtacgtagggtcggtaacgtccgaggtacgaagggacgggcggacggtcgtagtaccgtttagttactttacgactaataccgaacacgtacctaaccgttagtttacggttatttacggttcgttcgtaacggtacgtcgaccgtaccgtaacggtccgtacccggttcggtaccggtacgacccgtacccggaaccgacccctacccggtacgttccgaccgttcccg

SEQ ID NO: 287251 - DNA, 616 bp, Homo sapiens
  misc_feature: GYAE6OF02F5YVB.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatccacctgctctggagatgcattgaccaaaccgatatgtcttattcggtaccagcagaagccggccacggccccgtgtggttggtgatgtataagacactgagacggccctcgagggactcccgtgacgcgtattcgtcgtcggtctccgaggtcgacgggactacgtcactagttacgactatcgagtcggacgtccgaggtacaggacggacggaggtcgtaggtaacttagtttacgttataccgaattaccgaaactaacgaaccgtactaagtttcggttaactttatcggtttaccgttacggtactcggaccgtaaccgtacggttcccgtaccgtccggtggtaccgtaccgacccgtaacgggacccctaaaccctccgtacgttacccgtacccg

SEQ ID NO: 287252 - DNA, 684 bp, Homo sapiens
  misc_feature: GYAE6OF02HZH4Q.49.62.F07.1.454.CMB.1.raw
  modified_base (368)..(368): a, c, t, g, unknown or other
  misc_feature (368)..(368): n is a, c, g, or t
tcagagtcgagagacacgaccggtgctcgatttagtagtcgcataaaagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccgaaggatcacctgctcgtggagatgctattcgaccaaaccgtataagtgactttagtggtaaccagtacaggaacggccgggacccgacggtccccctggttcgttcgggtgagtagtaagtaaacgacacgtgacggacgcccgtgagggactcccgngagcgtatctcgtgctccgagcgaggactacgtcacgtgttcgacctatacgagtggtaacgtccgaggacgtaagggacgggacggtaacggtacgttaacggactttaagtttagttacgtaaccgtaaataccgaaacgaccgtaaacgtaccgttaagtttaccggttaacttaagtttcgtttcccggttaaggtaaccgtcgggtacctaaccggtaacgggtaaccctacccgggttccgttccggggtacctaaccggaccccggaaccggtaccccctaaaccccggcgtttcccaccgttaacccg

SEQ ID NO: 287253 - DNA, 718 bp, Homo sapiens
  misc_feature: GYAE6OF02HSNDP.49.62.F07.1.454.CMB.1.raw
  modified_base (231)..(231): a, c, t, g, unknown or other
  misc_feature (231)..(231): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgacggcctcctatgagctgacacagcccacccgtggtgtcaggtcgtcccaggacagacggccaggatccaccgtgctcgtgganatgctagttcgaccaaacgtatagtcgtcttagttcggtaaccgagaccgaggaaccggccccggaccgaccgggccccttggttcggttggtagattagtaagtaaacgactacgtgaacggcggtccctaggaggtcctccgtaggacgtcgtacttcgtacgtcggtccgtaccgaggtacggaagggaaccgtaaccggtacacgttagtcggacctattcggagggtacggtacggtaccggaagggaggaagggacggaacgggtacgggtaccgttaggttaaactttaagttactttacgaaccgtaaattacccaaaggaccgtaaaccgtaacgtaaggtttacgtttaacgttcgttacggttaccgtaacggttacgtccggtaccgtaaccggtacgtccccgtaccggttaccggtaccggtaccacccgggacccgtaaccggacccctaccccggtatccgtaccctaccg

SEQ ID NO: 287254 - DNA, 857 bp, Homo sapiens
  misc_feature: GYAE6OF02G6VP3.49.62.F07.1.454.CMB.1.raw
  modified_base (186)..(186): a, c, t, g, unknown or other
  misc_feature (186)..(186): n is a, c, g, or t
  modified_base (267)..(267): a, c, t, g, unknown or other
  misc_feature (267)..(267): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgacgctgacacacgcccacccgtcggtntcgacgtcgtcccccgaggaccaggaccggccaggactccacctgcctcgtggagatcgctacgttcgacccgaaaacgtnttacgtgtacgtttagttcggtaaccacgacgaacggaacggcccggggaccccacgggtccccccgttggttaggtttcgggtacggaagtttaggttaaagtaaaacgtacctacgttagggaacggaccgggtaccccttacgggacgggtaacctcccggtaggacggtccgtactttccgtcgttcgggccttaccggaggttaccggaacgggtaccgtaaccgggtacctaacgtacggtttccggaccctacgtaccgtaacgggtcggtaaccggtccgtaacgggacgtacggggaacggggtaaccggagggtacgtaggttaacgtttaactttaacggttcgtaactaaacgaaccgtaaaccgaacgtaacccgtaaccgtttagttttaccgggttaactttaacgtttccggttaacgttaacccggttaaaccgtccgtaccggttaaaccgtaccgggttaacccgtaaccccggtttccgggtaaccggggttacccctaaccgggtaaccccggtaaccccggtaccccctaaaaccccccgttacggttcccgtaccccggttaacccc

SEQ ID NO: 287255 - DNA, 733 bp, Homo sapiens
  misc_feature: GYAE6OF02IB1R4.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctcccctcctcactctctgcacaggctctgaggcctcctatgagctgacacagcccacccgtcggtgtcagtcgtccccaggacaggacggccaggatccaccgtgcctcgtggagtagtgctattacgacccaaaaccgatagtcgtactttagttacggtacctaggaccgtaacggaaccggtccccgggggaccccgaaccggggtccccccgttaggggtttcggtttggggttacggtaagtttacggttaaaaacgttaaaacggaccgtaacgttacgggaacgggtaccgggtaccccgtacggtaacggggtaccttcccggtacggaacgtcgttaactttccgtacgtcgggtcctaccggtagggtaccgaacgggtaccgaacggtactacgtacgttcggacctagtacgaggtcggacgtccgaggacgaagggacgggaacgacgggtctacgtaacgtttagttagttacgtaactaactaccaacaacgaactacgtagttagtacttagtcgtacgtacgactcggaccgtaacgtacgtcgtaccggtcgtcggacaccggaccgaccggaccctacccgtagtccgtactacccg

SEQ ID NO: 287256 - DNA, 872 bp, Homo sapiens
  misc_feature: GYAE6OF02JEVRZ.49.62.F07.1.454.CMB.1.raw
tcagagtcgagagacacgaccggtgctcgatttagtagtcgcataaagggaaagggggctgtgggtccaggaggcagaactctggggtgtctcaccatggcctggatcccctctacttcctcccccctcctcactctctgcacaggctctgaggcctcctatgagcctgacacacgccctaccctcggtgtcaggtccgtaccccgaggacaggaccggccaggtatccaccgtgctcgtagggactatggcctaagttcgacccaaaccggcttagtcgtaccttagttacggtaaccgaggtccgaagaacgggccccgggacgaccgggtcccccgtggttacgtttgggtaggtacgtattaagtaaacgacctacgtacggtaggaccggtcccttcggaagggtaccgtacccgtagtacggtacgtaactttcccgttcgttacggtacctaccggtacggtaccggaacgggtaacgaaccgggtcctaacttaccggttcgaccgtagttaccggtacgggttacgggaccggttacccggtaagggacccggtaacgggaacggggtaaccgggtacggttaccgttaccggttaaacgtttacgttttaaacggtccttaaccgaactaaacccgtaacggtaacccgtaacccgttaacgttacggtttaaccggtttaccgttttaacggttgtttaaccggtaaccggtaaccgttaccgggacccttaacgggttacccgggttaacccggttaaccccgttaccggggttaccggtacccaccccgggtaacccccgggttaacccgacccccgtaaacccgttccccggttacgttaacccccggtttacccccg

SEQ ID NO: 287257 - DNA, 723 bp, Homo sapiens
  misc_feature: GYAE6OF02GKXS7.49.62.F07.1.454.CMB.1.raw
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (561)..(561): a, c, t, g, unknown or other
  misc_feature (561)..(561): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccacccgtggtgtcagtcgtcccaggacagacggccaggatcacctgactcgtgganatcgactagttcgaccaaaaccgtntagtcgactttagttcggtaacctagacaaggtaacggcccgggaccgaacgggtcccccgttggttacggtttagggtagtaacgttaggttaaaactaaaaacggtacctaacggttacgggaacggtaaccgggaccccgttacggaacggggtaccttccccggtaggaacgaccgttaacttcgtacggtcggtacctaccggtaggtacgaacgggtactaacggtccaagtacgttacggacctagtcgaacggtggacgtaccgaggacgagggacgacggtacggctagtattaacgttntacgtaagaactacgaactaacggaacctacgtaattgggttaacttacgttcgttaccgttaacggacttcggaccgtaacgtacgtacccgtaaccgttcggtacggtaccaccggaaccccgtacggaaccccgtaacccgtacgtacgtactacccgg

SEQ ID NO: 287258 - DNA, 807 bp, Homo sapiens
  misc_feature: GYAE6OF02JO52W.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctggaggcctcctatgagctgacacagccaccctcggtgtcagtcgtccccgaggacagacggccaggatccacctgctctcgggagactgcagttacgaccctaaaaccggtataacgttaggtacctttagtttacggtaacccgaaggaccaaggaaaccgccccggggcctaaccgggtacccccgttggttacgggtttgggtacggtaagttagggttaaacaaaaacggtaccgtaacggttacggaacgggtaccggtaccccgttacgaagggtaaccgttccccctagggaaccacggttaacttcgttaccgtggtaccctaccggttaggacggaacgggtaacacgggttaccacgtacggttaccggcctaactacggaaggttaccgggacgtaaccgacggtcggaaggtaacgggacggtacggccgtacgtactacgttaagtcgttaacgaacttaacggaaactacgaaccgtacgttaacgttacggtttaaccgttattcggttaaccgttacgggtaacctaccgggttaccgaaccggttaaacggtccgttaaccccgggtcggttacgggtaaccgtacccggaacccgtaaaccgggtacccccgttaaccccgacgttaccggaacccgttaccg

SEQ ID NO: 287259 - DNA, 896 bp, Homo sapiens
  misc_feature: GYAE6OF02HISSQ.49.62.F07.1.454.CMB.1.raw
  modified_base (282)..(282): a, c, t, g, unknown or other
  misc_feature (282)..(282): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacagctctgaggcctcctatgagctggacacgacgccctacccgtgggtcgtacgacgttcgcccccgaggaccgaggaccggcctaggactacaccgttgtctcgtaggagtatcggactacggttaccaaccgtaaaaccgtnttaacgttcgttaccttttaacggtttaccggaacccgtagaccggttaaacggaaccgggcccccggggacccgtaacccggggttccccttgggttaccggggtttagggtattaacggttaacggttaaacgtaaaacggtaaccgccgggtttaagggaaccgggtaacccgggttcccccggtaaggggtaaccggggttaccttacccccggtaggggtaccttaaccgttaacgttttccccggttcggtaccggttccgttaccggtacgggttaaccgacggggtaacctaaccgttacgtaacgttcggttacgccgtaaagtccgtagggtggacccgtaggacgggtaccgagggtaacggaccgggagttaccggttagtaaactttaggtttacgtttacgaacgtaaccttaaccgaagttaccgaccttacgtttacgtaaccgttaccggtttcttaccgggtacgttaacggttaccggtacggtccgtaaaccggtccggtacccggttacgtacccgggtttacgggacccgaaccggaccccgggttaacccaaccccccgttaaccgtccgttaaccggttcccgtaccccg

SEQ ID NO: 287260 - DNA, 668 bp, Homo sapiens
  misc_feature: GYAE6OF02JODTF.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgagcctcctatgagctgacacagcccacccgtcggtgtcagtcgtcccccaggacagaccggccaggactccacctgctcgtggagatgctagttcgacccaaaccgatagtgtcttagttcggtaccagacaggaacgccgggaccacggtccctggtggttggtagtagtagtaataaacgacgtacgtaggacggtacggcccgtacgaacgggtacctacccgtaggacgtccgtacgttccgttcgtcggtaccgtccgtagggtaccggaacgggaaccgtaaccggtaccaacgttcgtaccgggacctagtaccgaggtacggtacgtacccggaggacgaggacgggacggacgtcgtagacgttaagttagttacgtactaacgtaccaaagacgtaccacgttagttagttacttagttcgttacgttacgtaacgtcgacgtaccgacggtcctacggtacgtcggacctacgacccgacgtaccccgacctacgttaccgtacctaccg

SEQ ID NO: 287261 - DNA, 769 bp, Homo sapiens
  misc_feature: GYAE6OF02JWP3B.49.62.F07.1.454.CMB.1.raw
  modified_base (120)..(120): a, c, t, g, unknown or other
  misc_feature (120)..(120): n is a, c, g, or t
  modified_base (261)..(261): a, c, t, g, unknown or other
  misc_feature (261)..(261): n is a, c, g, or t
  modified_base (290)..(290): a, c, t, g, unknown or other
  misc_feature (290)..(290): n is a, c, g, or t
  modified_base (407)..(407): a, c, t, g, unknown or other
  misc_feature (407)..(407): n is a, c, g, or t
tcagagtcgagagacacgaccggtgctcgatttagtagtcgcataaagggaaagggggctgtgggtccaggaggcagaactcgtgggtgtctcaccgatggcctggatccctctacttcnccccctctcactctctgacacaggctcgtgacgcctcctatgagtctgaccacgacgccctacccgttggtcgtctacggttccgccccgaaggaacacggaccggccaaggtactccgaccttgaccttcgtaggaagtnttcgactagttaccggaacccaaaacgtntacgttagttacgttagtacgtacagacgaacgggaccggaccggccgtaccggtccgttggttggttacggtacgtacgttaagtaacgtaacgctacgacggacgtacgtaccgngtaacggtccgtaccggtagtcgtacgttacgttcgttaccgtcgtccgtaccgggtaacggtaacggaccgggtaccgtaacggtaccgtacggtttacggaccgtaccacgtacggtacggtacggtaccgtaccggcggacggaaggtacggtaacgacggttacgttagttaacgtggttaacgttacgaacgtaaccgtaacgaacgttagtaaccttaacgtttacgttacgttaacgtttagttccggttaacgttacggttacgtacgtacccggacgttaccggtcgtaccggttacggtaccgaccgtacccgaacccgtaccggtccccttacgcgtacgttcccgtcccg

SEQ ID NO: 287262 - DNA, 926 bp, Homo sapiens
  misc_feature: GYAE6OF02IR5PR.49.62.F07.1.454.CMB.1.raw
  modified_base (265)..(265): a, c, t, g, unknown or other
  misc_feature (265)..(265): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagcccaccctcggtgtcagtcgtcccccaggaccagaccggccaggactccaccgtgccttctgggagtatcgctagttcggaccctaaaaccggtnttaagtcggtacctttaacgtttacggttaacccaagtaccgaacggaaacgggtcccccgggaccgtaacgggtccccccgtgggtttcggtttcgggtaggtaagttaggttaaacgtaaaacggtaccgtaacgttacggaaggtaacccgggtaccccttaacggaacggggtaccttaccccggtaggtaacgggtccgttaaacgtttcccgttacgtcgggtacccgttacccggtaacggggttaccggtaacggggtaaaccgttaaaccggggttccaaacggtttaacgtttacgggacccttaacgttacccggtaaaggggttacgggaaacccggttacccgggaagggaccggtaaacgggtaacgggggaaccgggtaacgggccgttaacgggttaaacctttagttttaacggttaccgttaacgtaaaacgtacccgtaaacgtaacggtaacccttaaccgttaacgtttaacgggtttaccttaacggttaccgtttaaccggttaaccggtaaccgttcgaaccgttaaccggtaacggtttcccgtacccggttaccggttaccgggttaacccaccggtaaccccgaaccgggtaaccccctaaccccgtacggttacccgttaacccttaccccgg

SEQ ID NO: 287263 - DNA, 893 bp, Homo sapiens
  misc_feature: GYAE6OF02FIAYY.49.62.F07.1.454.CMB.1.raw
tcagagtcgagagacacgaccggtgctcgatttagtagtcgcataaagggaagggggctgtgggtccaggaggcagaactctgggtgtctcaccatggcctggatccctctacttctccccctctcactctctgcacaggctctagaggccctcctatgagtctcgacacacgccctacccgtggtcgtacacggttccgtaccccgaggtacacggaccggaccaggacttccaccgtcggtaccttcgtgggacgtacttcggcctacgttacggacccctaaaaccggttaacgttccgttaccgttagttaccggttaacccgacggtacgaacggaacccggtaccccggggtacccgtaaccgggttccccccgttgggtttcgttacgggtagttacgttaagttaaacgttaaacgaccgtacgtacgggaaccggtacccggtacccgttaggaaccgggtaccgttacccgttaggaccggtaccgtacgttccgtaccggtaccggtacccgtttaccgggtaaccggtaccggtaaccgggtaaacccgaacgggttaccctaacccggttacggttacccggacctaacgttaaccggtaggtaaccgggttaccgtacccggtaaggggaccggtaaccgggtaaccgggaaccgggttcgaaccggttaagttaacttagttttactaaccgggtacctacgtaacccgaaacgtaaccggtaaccgttaaccgttaagtttacggttaaccttcgggttaaccttaccggttacggtacctacggacccgtaccggtacgttacccggaccggttaccgtacgggtaccaccggttacccgaacggtaccccaacccgttcgtaccgtccttacccg

SEQ ID NO: 287264 - DNA, 760 bp, Homo sapiens
  misc_feature: GYAE6OF02GSRT8.49.62.F07.1.454.CMB.1.raw
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagcccacccgtcggtgtcagtcgtccccgaggacagacggccaggatcacctgctcgtggatagtcgctattacgacccaaaccgatactcgactttagtacggtaccagacgaggaacggccgggaccacggtcccctgtcggttaggtgagttaggtaataaacgaccgtactaggacgacggccctacggtaagggactcccgtaggacgcgtacttacgttcgtacggtccgtcgacgggttcggaacgggaaccgtaacggtccaacttacggtacgggtactacgtacgtacgggtacggaacggtaccggaacggacggaaacggggtaacggtaaccgggacggtacgttaaccggtaacgtttacgttttaagttaccggtttaaactaaactaccgtaaaacgacccgtaaaccgtaccgttttaaacgggttttaacgtttaacgttttaaggttccgtttacggtttaacccgggtaacgttaccggtaaccgaccggttaaaccggtccggtaaccgtttcccgggtacgtaccgaccggtacccgaccgaccctaacccgtccgtacgtaccctaccg

SEQ ID NO: 287265 - DNA, 849 bp, Homo sapiens
  misc_feature: GYAE6OF02HH06E.49.62.F07.1.454.CMB.1.raw
  modified_base (140)..(140): a, c, t, g, unknown or other
  misc_feature (140)..(140): n is a, c, g, or t
tcagagtcgagagacacgaccggtgctcgatttagtagtcgcataaagggaaagggggctgtggggtccaggaggcagaacgtctgggtgtctcaccataggcctggatccctctacttctcccccctcctcactctctncacaggctctgaggcctcctagtgagctgacacagccaccctcggtgtcagtcgtcccccaggacagaccggccaggatcaccgtgctcgtggagatgacgattcgacccaaaaccggtataagttcgcgtttaattcgggtaaccacggcaacggaaggtaccccggggacccctacggggtacccccccttggttgggtttagggttaggtaagtaggtttaaacgttaaaaaggacccgtaaccttaagggaagggtacgggacccccgttaccggaaggggtaaccttacccccggtaggaaacggtccgggtaactttccctcggttacgggtcccttaccggtacggttacggaacgggaaccgtaaacggtaccgtactaacgttccgggtaaccgactacgtacggtacgggacggtacccgaagggtaccgtaagggaagggaccgggaacgggtccgtaaggttaacccgttaagttttacggtttaccggtaactaacgttaaccgaaaccgtaggaaccctaccgtaagtttacggttactttaacgtttcgttacgttaccggtaacgtaccggaccgtaacccgtaaacgggttcccgtaaccccggttaccggtacgggttacccgaaccggtacccccggaacccggaacccccgtaacccccgtaaccgttaccggtaccccgttaccccgg

SEQ ID NO: 287266 - DNA, 719 bp, Homo sapiens
  misc_feature: GYAE6OF02HAYRF.49.62.F07.1.454.CMB.1.raw
tcagagtcgagagacacgaccggtgctcgatttagtagtcgcataaagggaaagggggctgtgggtccaggaggcagaactctgggtgtctcaccatcggcctggatccctctacttcctccccctcctcactctctgcacaggctcgtgaggcctcctatgagctgacacagcccacccgtcggtgtcagtcgtccccgaggacaggaccggccaggactccaccgtgctcgtgggagatgctattcgaacccaaaaccgtatagtgtactttagttacggtaccagacgaagaacggcccgggaccgaccggtccccgttggttggttggtaaaaaaagtgttaaggttaacgtaaaacgactaacgtaggaacggacggtcccgtaccggaccgggtaccccgtggacgcgtacttccgtcgtcggtcctccgacgtcgtacggaacggaacaacgtacgtacctacgttacgacctagtacgtaggtacggaccggtcccggacgacgggacgggacggacggacgtacgtaaccttaacgttacgtacgtaccgtacgtaccgacgacgacgacgtcgtacggtacggtacgttagttaggttcgttacggttacggtccggggacgggtacgggtacgtaccggtccgtaccggtcccgttacgtaccggtaccgaccgtacccggaccggtccgttcccggtaccccgtccg

SEQ ID NO: 287267 - DNA, 793 bp, Homo sapiens
  misc_feature: GYAE6OF02H2EDB.49.62.F07.1.454.CMB.1.raw
  modified_base (183)..(183): a, c, t, g, unknown or other
  misc_feature (183)..(183): n is a, c, g, or t
  modified_base (213)..(213): a, c, t, g, unknown or other
  misc_feature (213)..(213): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacagctctgacggcctctatgagctgacacacgccacccgtcggtntcagtcgtccccaggacagaccggccaggntccgacctgcctcgtagggagtatcggactacgttcgaacccgtaaaaccgattagtcgtactttagttcggtaaccgacgactaaggacggtccccgggaccaccggtacccccgtggtttacggttcggtaggtattaggtaaagtaaaacgtaccgtacgtaggaacgggtaccggtacccgtacggaacgggtacctcccggtggacgcgttacttccgtcgtcggcctcgacggtcggaacgggacaacggtcacgtacgttcgggaaccctagtacggaggttacgggtacggtaccgtagggacgaagggtaaacgggaccggacgggtcgttaaacggttacgtttacgtttaagtttaccgttaaccgtaaacgtacctaaaaccggtacgaaaaccgtacccgttaaggtttttacgggtaaccttttacgttaccggttttacggttaccgaaccgtttacggaacccgttaacccggtagttacccgtaccccgggttaccggtcgggtacctacccgggtaccccgaaccggacccctaaccccgtacggttcccgtacttacccgg

SEQ ID NO: 287268 - DNA, 639 bp, Homo sapiens
  misc_feature: GYAE6OF02IZCN8.49.62.F07.1.454.CMB.1.raw
  modified_base (226)..(226): a, c, t, g, unknown or other
  misc_feature (226)..(226): n is a, c, g, or t
  modified_base (230)..(230): a, c, t, g, unknown or other
  misc_feature (230)..(230): n is a, c, g, or t
  modified_base (248)..(248): a, c, t, g, unknown or other
  misc_feature (248)..(248): n is a, c, g, or t
  modified_base (322)..(322): a, c, t, g, unknown or other
  misc_feature (322)..(322): n is a, c, g, or t
  modified_base (349)..(349): a, c, t, g, unknown or other
  misc_feature (349)..(349): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (398)..(398): a, c, t, g, unknown or other
  misc_feature (398)..(398): n is a, c, g, or t
  modified_base (458)..(458): a, c, t, g, unknown or other
  misc_feature (458)..(458): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgagcctcctatgagctgacacagtcccacccgtcggtgtccagtcgtccccaggacagaccggccaggatccactgctcngganatgcagtgacccaaacgntatgactttatgtaccgagaccgagaacgccgggaccacggccctgtggttcgagtacgtagtaacaaagtacnctaggacgacgcctaggaagcttccgngaagcgtattcgtcgngcctacgngtacgacggtaacacgtcgaacgtntcgggtaccagtaccgagggttaacgacggttacgaacggtacgaggtaacggaaccggnggtacgtcgtaagttaacgttactgttaacaacgtacaaaccgacgaaacaccgttcggttagtttaaacttacgttcgttaccgtagtaacgtacgtacgacccgtaacggtaaccgtccgttacggtaaccggtcgaccgtaccggaaccggacccttaacccgacttacgctaacccg

SEQ ID NO: 287269 - DNA, 673 bp, Homo sapiens
  misc_feature: GYAE6OF02H1E76.49.62.F07.1.454.CMB.1.raw
tcagagtcgagagacacgaccggtgctcgatttagtagtcgcataaaagggaaagggggctgtgggtccaggaggcagaactctgggtgtctcaccatggcctggatccctctacttctcccccctcctcactctctgcacaggctctgaggcctcctatgagctgacacagcccaccctcggtgtcagtcgtccccaggacagacggccaggatcacctgctcgtggagatgctattcgacccaaaaccgatatgtctttattcggtaccagcaaggaacggccgggccacggccccttggttcggttggtgagttggtaagtaaagtacgtttggaaggacggtccctacgaccgggtaccccgtggacgtcgtacttcgtcgtcggccttccgagtccgtacgaagggaaccaacgtacgtcctaccgttcgacctacgtcgaggtcggtacggtcccgggaccgaggacggacggaggtcgtacgaacttacttacgtgtcgacgttccgacgacgacgacgcgtaggtcgacgtaggtttagtcggttacgttacggttccgggacgggtacgggacgttccggtaccggttaccggtacccggttccgtacggtaccgaccggtacccggtaaccggtcccgtacccggttcccccgtcggtacccg

SEQ ID NO: 287270 - DNA, 741 bp, Homo sapiens
  misc_feature: GYAE6OF02IYNFX.49.62.F07.1.454.CMB.1.raw
  modified_base (141)..(141): a, c, t, g, unknown or other
  misc_feature (141)..(141): n is a, c, g, or t
  modified_base (163)..(163): a, c, t, g, unknown or other
  misc_feature (163)..(163): n is a, c, g, or t
  modified_base (168)..(168): a, c, t, g, unknown or other
  misc_feature (168)..(168): n is a, c, g, or t
  modified_base (190)..(190): a, c, t, g, unknown or other
  misc_feature (190)..(190): n is a, c, g, or t
  modified_base (205)..(205): a, c, t, g, unknown or other
  misc_feature (205)..(205): n is a, c, g, or t
  modified_base (225)..(225): a, c, t, g, unknown or other
  misc_feature (225)..(225): n is a, c, g, or t
  modified_base (236)..(236): a, c, t, g, unknown or other
  misc_feature (236)..(236): n is a, c, g, or t
  modified_base (312)..(312): a, c, t, g, unknown or other
  misc_feature (312)..(312): n is a, c, g, or t
  modified_base (336)..(336): a, c, t, g, unknown or other
  misc_feature (336)..(336): n is a, c, g, or t
  modified_base (419)..(419): a, c, t, g, unknown or other
  misc_feature (419)..(419): n is a, c, g, or t
  modified_base (521)..(521): a, c, t, g, unknown or other
  misc_feature (521)..(521): n is a, c, g, or t
  modified_base (728)..(728): a, c, t, g, unknown or other
  misc_feature (728)..(728): n is a, c, g, or t
tcagagtcgagagacacgaccggtgctcgatttagtagtcgcataaagggaaagggggctgtgggtccaggaggcagaactctgggtgtctcaccatggcctggactccctctacttcctccccctctcactctctgcacnggtctcgtgacggcctctatgntccgngacacagccctccgtggtctcngtccgcccgaggacncggacgcgagctacgtccgngctacgtgagngtcgactagttcgaaccctaagtattgacgttacgtttaacgtggaacccagacgaacggaccgggccgggtaccnccggtccgtggtaaggttgtaagngttaacgtaaagtaacgcctacgtagacggtacgtccgacggtaggtccctaccggatacggtactacgtccgttgaccggtntaccggggtacgtaccggaacggtactaaacccgggttctaaaccggtggtttccggaacgtttccggacggttaggacggaacgtccgggacgttaccggnggaaacgacgggcgtttacaaggttaccgtttaatttaacggaccttaagaccgtaaccgtaagaccgtaacctacccggttagtttaaccggtattacgggttcctacgggttacgtaacgcggttaacgtaacggccgggtaaccctggttacccggtaggtaccccgtaggacccggttaacccgaccccttacggacccggtnaccccgggttacc

SEQ ID NO: 287271 - DNA, 853 bp, Homo sapiens
  misc_feature: GYAE6OF02GFOD8.49.62.F07.1.454.CMB.1.raw
  modified_base (182)..(182): a, c, t, g, unknown or other
  misc_feature (182)..(182): n is a, c, g, or t
tcagagtcgagagacacgaccggtgctcgatttagtagtcgcataaagggaaagggggctgtgggtccaggaggcagaactctgggtgtctcaccatggcctggatccctctacttctcccccctctcactctctgcacaggctctgagcctcctatgagctgacacagcccaccctcggtntcagtcgtccccaggacaggaccggccaaggactcgacctgctcgtaggagtatgactagttcgacccaaacgtatatgtactttagttcggtaccagtacgaaggaaccggcccgggaccgaccggtcccccttaggtttcggttcgggttagtaagttagtaaacgtaaaacgtaaccgtaaccgttacggaacgggtaccgggtaccccgtacgggtaacggggtaccttaccccggtaggtaaccgtacggttaactttccggttacgttccgggtaccgttacccgggaacggtttaccggaaacgggggtaaccgtaaacccggttaccgaacggttaacggttccggtaaccgttaacgtaccggtacgggttacgggaaccggtttacccgggacgggaacgggtaacgggtaaaccggggtaacgggtaccgggtaccgttaacgggttaaactttaacggttttaacgttacggtaactaacgttacgtaaaccgacggtaaccctaacgtttaacggtttacggttaactttaacggtttcgttaccgttaaccggaacttaccggaccgtaaccggtaacggtcccgttaacccgttcggtaccgtacgtacccgaaccgtacccggaacccctaaccggtcctacgtaccttacccgg

SEQ ID NO: 287272 - DNA, 822 bp, Homo sapiens
  misc_feature: GYAE6OF02HR3QM.49.62.F07.1.454.CMB.1.raw
  modified_base (230)..(230): a, c, t, g, unknown or other
  misc_feature (230)..(230): n is a, c, g, or t
tcagagtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccacccgtggtgtcagtcgtccccgaggacaggaccggcaggatccacctgctctagganagtcgactagttcgaccaaacgataactgtactttacgttacggtaaccagacgtaaggaaacggccccgggtaccaaccggggtccccttaggttggtttacgggttacgtaacggttaggtttaaaacgtaaaacggaaccgttaacggtagggtaacggtacggtacccccgtttaggaaacggggttaccttaccccgtagggtacgtacggttaactttccgtacgtacgtccgttacgaggtacgaacgggtaaccgtaaacggtcaacgttacgttacgacctaacgtcgtaggtacggtaacgtaccggtaacggacggaacgggaacggacgggtaacgtacgttaaccgggtaaactttaagtttacgttaacggtaactaaacgtaccgaaacgttaacgtaaaccgtaaccttaggtttaaccggttaacgtttaagttaccggttacggttaaccggtaacgttccggtaaccgtacccgggtttaaacgggtccgttaacccggttacgggtacggttaaccggaccgtaaccccggtaacggacccccgtaaccgtacgtacccggtaccgtaaccg

SEQ ID NO: 287273 - DNA, 716 bp, Homo sapiens
  misc_feature: GYAE6OF02G289N.49.62.F07.1.454.CMB.1.raw
  modified_base (173)..(173): a, c, t, g, unknown or other
  misc_feature (173)..(173): n is a, c, g, or t
  modified_base (278)..(278): a, c, t, g, unknown or other
  misc_feature (278)..(278): n is a, c, g, or t
  modified_base (469)..(469): a, c, t, g, unknown or other
  misc_feature (469)..(469): n is a, c, g, or t
  modified_base (486)..(486): a, c, t, g, unknown or other
  misc_feature (486)..(486): n is a, c, g, or t
  modified_base (592)..(592): a, c, t, g, unknown or other
  misc_feature (592)..(592): n is a, c, g, or t
tcagagtcgagagacacgaccggtgctcgatttagtagtcgcataaagggaaagggggctgtgggtccaggaggcagaactctgggtgtctcaccagtggccctggactccctcttacttccgtcccccctcctcacttctctcgcaccaggctctgacggtcctactatganctgacaactcgcctaccttcggctacgagtcgtcccgaggacacggaccgcgacgactcacctcgccttgagaagtcgtcacttagtaccgaaccgtaaaccgtntaacggttcggtactttagttaccggaaccgtacgaacggaacggtacccggaccggtaccgtaccgtccccggtggtttaggttgggtacctaacgttagtaaagtaaacccgggattacggtaacggtcgtacggtaacccgtgggacctaccgtccgttagagtcttcgttcgcgttacggccacggnggaacctggtaaaaccnccgtataacgttcggtaagtaccctgtacgacggtagtacgacggaacgtcggacggacggacggcgtaccgttaacggtacttagttcgttcgtacgtcgtaacnctacgacgactacgtagtacgacttaacgtggttcgtaccggagtttacggacggtacggtcctagggttccctaccggaccgttacgtcgccgaacgtcccggtcgttcccgaccgggttccc

SEQ ID NO: 287274 - DNA, 741 bp, Homo sapiens
  misc_feature: GYAE6OF02HB1QN.49.62.F07.1.454.CMB.1.raw
  modified_base (173)..(173): a, c, t, g, unknown or other
  misc_feature (173)..(173): n is a, c, g, or t
  modified_base (225)..(225): a, c, t, g, unknown or other
  misc_feature (225)..(225): n is a, c, g, or t
  modified_base (236)..(236): a, c, t, g, unknown or other
  misc_feature (236)..(236): n is a, c, g, or t
tcagagtcgagagacacgaccggtgctcgatttagtagtcgcataaagggaaagggggctgtgggtccaggaggcagaactctgggtgtctcaccaatgggcctgggatccctctacttctccccctcctcactcgtctgacacaggtctctggaggcctctatgagctgacncagcccaccctcggtgtcaggtcgtcccaggacagacggtccagatccaccngcctcgtgganatcggactagttggaacccaaacgattaacgtcggtacctttagttacggtaccgtagtaccgaaggaaacggcccgggacccgtaaccggtcccccgttaggttcggtttacgggtagtacgttagtaaaccgtaaacggtaccttaacgaggaaccgtaacggtacccgtacggtaacggttaccgtaccccgttaggaacgtccgtaaattttcccggacgtttacggccgttacggtacggtaacggtacgggaaaccgaacgtacgaacgtacgttaaccggctaagtcggtacgggtacgtaccggcaacggggtacgaagaccgggaagtacgtcgtaagacttagttaccgttgactaactacgaacacgtaacgtactagttaacggtactttagtccgttacgtaacgactacggacgtaacctacgggtccctacgttcggtaccggtcgaacggcccgaacgtacccctaaccgtactacgttaccctaaccg

SEQ ID NO: 287275 - DNA, 772 bp, Homo sapiens
  misc_feature: GYAE6OF02HV1AO.49.62.F07.1.454.CMB.1.raw
  modified_base (111)..(111): a, c, t, g, unknown or other
  misc_feature (111)..(111): n is a, c, g, or t
  modified_base (259)..(259): a, c, t, g, unknown or other
  misc_feature (259)..(259): n is a, c, g, or t
tcagagtcgagagacacgaccggtgctcgatttagtagtcgcataaagggaaagggggctgtgggtccaggaggcagaactctgggtgtctcaccatggcctggatccctntacttctcccctctcactctctcgcacaggctctagacggcctctatgacgctgacacagcctaccgtggtcgtcagtcgtcccaggacacggcggcaggactcgacctgctcgtggagtactcgactacgttacgaaccctaaacgnttacgtgtacgttagttacggtaacacgacgaagaccggaccggaccgacggtccttggtttaggttcggtagtagttaacgtaacgtaaacgacgtacgtacggacgtacggtaccgttcggaggttacctccgtaggacgtcgttacgttcgtcggtacggtccgtaccggtacggtacgacgggaccgtaacggttccacgttacgtcgggacctagtacggtacgtcgggtaccgtcgacggtacggaacggacggaaccgggtacggtctaacgttaacgttacgtttacttacgtaacgtaacgtaaccttaacgaaaccgtaacttaaccgttaggttaaccgtttaacggtttacgttccggttaaaaccggttcgttaaacccgttacgggacccgtaaccgggttacggaccggtttaccccgtaggggtttcccggaccgaacccgggttacccggaaccctttaccccggaacccgttactacccggttaacccttcccgg

SEQ ID NO: 287276 - DNA, 775 bp, Homo sapiens
  misc_feature: GYAE6OF02GMN5T.49.62.F07.1.454.CMB.1.raw
  modified_base (187)..(187): a, c, t, g, unknown or other
  misc_feature (187)..(187): n is a, c, g, or t
  modified_base (235)..(235): a, c, t, g, unknown or other
  misc_feature (235)..(235): n is a, c, g, or t
tcagagtcgagagacacgaccggtgctcgatttagtagtcgcataaagggaaagggggcgtgtgggtccaggaggcagaactctgggtgtctcaccatggcctggatccctctaccttttccccctcctcactctctgcacaggctctgacggcctcctatgagctgacacagcccacccgtcggtntcagtcgtccccaggacacggacggccaggactccactgcctctgganatgacattcgaccaaaccgatatgtactttacgttacggaacctagacgaacggaaccggcccgggacccgtaccggaccccgttgggttcggtttgggtacgtaagttaacggttaaaacgtaaaacggtaaccgtaacggttacgggaaaccggtaccggtaccccgttacggaacggggtaacctaccccggttaggaacgtaccgtacgtttccgtacggtcgtaccgtacccgaggtaaccggtacgggaaccgtaacggtacgtacgttacgtaccggacctacgtacggtagtacgggtacgtacccgaaggtacgaacgggagggtaacgaggtaccgtagtaacgttagttttacgtactaacgtaacgtacaaacgtaacgaaccgtaacgttacggttacttaacgttacgtttgttaaccgtttcggagttaccgaccgtaacgtacggttacccgccggttacggttcggtacccgaacctaccggaaccgtacccaaccgtcctcggttaccctacggtttccccg

SEQ ID NO: 287277 - DNA, 797 bp, Homo sapiens
  misc_feature: GYAE6OF02J04DT.49.62.F07.1.454.CMB.1.raw
  modified_base (179)..(179): a, c, t, g, unknown or other
  misc_feature (179)..(179): n is a, c, g, or t
  modified_base (199)..(199): a, c, t, g, unknown or other
  misc_feature (199)..(199): n is a, c, g, or t
  modified_base (454)..(454): a, c, t, g, unknown or other
  misc_feature (454)..(454): n is a, c, g, or t
  modified_base (544)..(544): a, c, t, g, unknown or other
  misc_feature (544)..(544): n is a, c, g, or t
tcagagtcgagagacacgaccggtgctcgatttagtagtcgcataaagggaaaggggctgtgggtccaggaggcagaactctgggtgtctcaccatggcctggatccctctacttctccccctctcactctctgcacgagctctaggacggccttacctagtgacgtctacgacctacncgaccctacccgttcgggtntcgtagttccggacccagggacctaggaccggtacgacggtacttccgaccgttggcgttccggtaggacgtagtcgtacctacgttcgaacccgaaacgttatgttcgtaccgttacgttacggtaccagtaccgtaacggaccggaccggtacccgacggtcccgttaggtcgttacggtagtattaacggtaagtaaccgacgtaaccgttggaacggtttccggaccggtacgtacggtacctcggtacgngtacgttactcggtacgcgtacgcgttaacggcgtacggtacgtactcggtacgtacgtccgatacgtacgcgtaggcgtcgaggtaccngggacgtacgggtataccggtattaaccgtaggtttaccgtaacggttaaactacccgtaaaacgtccggtaactaaacgtaccgtttaacgtttaaacggttaccgtttagttcccgtttaaacggtaccgttaacgtaacccgttacggtaaacccgttacgggaaccccttttaccgggaccgttagggacccgtacggttaaccccggaccgtaccccgttcgaaccggtttcctaaccccgttaccgg

SEQ ID NO: 287278 - DNA, 223 bp, Homo sapiens
  misc_feature: GYAE6OF01CILW3.37.67.G01.1.454.CMB.1.raw
  modified_base (174)..(223): a, c, t, g, unknown or other
  misc_feature (174)..(223): n is a, c, g, or t
tcagtagtgtagatcacgaccggtgctcgatttagagtatacatattgggtttggggaagaggaagactgacggttccccaggagttcaggtgctgggcacgagcggccctgggctagcctggtcaaggactacttccatctacactactgagcgggctggcaaggcgcatagnnnnnnnnnnnnnnnnnnnnnnnnnnnnnnnnnnnnnnnnnnnnnnnnnn

SEQ ID NO: 287279 - DNA, 217 bp, Homo sapiens
  misc_feature: GYAE6OF01A4S2W.37.67.G01.1.454.CMB.1.raw
  modified_base (166)..(217): a, c, t, g, unknown or other
  misc_feature (166)..(217): n is a, c, g, or t
tcagtagtgtagatcacgaccggtgctcgatttagagtatacatattgggtttggggaagaggaagactgacggtccccaggagttcaggtgctggcacagcgcctggctgcctggtcaaggctacttccatctacactactgagcgggctggcaaggcgcatagnnnnnnnnnnnnnnnnnnnnnnnnnnnnnnnnnnnnnnnnnnnnnnnnnnnn

SEQ ID NO: 287280 - DNA, 504 bp, Homo sapiens
  misc_feature: GYAE6OF01EST1U.6.19.B08.1.454.CMB.1.raw
tcagatatcgcgagcacgaccggtgctcgatttagtgagtcagtaaggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaatcctgatctatgatgcatccactttgcaaagtgggtccatcaaggttcagtggcagtggatctgggacagatttcactctcaccatcagcagtctgacaacctgaagtattttgctaacttactactgtacaacagagttacagttcgcccctcggtacgttccggaccgaaacgggaaccaagggtacggaaatacgaaaacgaactgtacggctcgacaccatctcg

SEQ ID NO: 287281 - DNA, 484 bp, Homo sapiens
  misc_feature: GYAE6OF01BNRW1.6.19.B08.1.454.CMB.1.raw
  modified_base (479)..(479): a, c, t, g, unknown or other
  misc_feature (479)..(479): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtgggtccatcaaggttcagtgcagtgatctgggacagatttcactctcaccatcagcagtctgcaacctgaagattttgctaaccttactactgtcaacagagttacagtgcccctcggacgttcggccgaagggaccaaggtggaaatcaaacgactgtagctgacaccntctcg

SEQ ID NO: 287282 - DNA, 508 bp, Homo sapiens
  misc_feature: GYAE6OF01C7G6Z.6.19.B08.1.454.CMB.1.raw
  modified_base (268)..(268): a, c, t, g, unknown or other
  misc_feature (268)..(268): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaancccctaaatcctgatctatgatgcatccactttgcaaagtgggtccatcaaggttcagtgcagtggatctgggacagatttcactctcaccatcagctagtctgacaacctgaagtattttgactaactttactactgtacaactagtagttacagtcgaccccgtggaccgttcggaccaaacgggtaccaagggtacgaaatacaaacgaacgtgtacggactagacaccatcgtacg

SEQ ID NO: 287283 - DNA, 504 bp, Homo sapiens
  misc_feature: GYAE6OF01CIXXV.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggcaagtcagagcattagcacctagtttaaattggtatcaggagaatccagggaaagcccctaaactcctgatctatgatgcatccactttgcaaagtgggtccatcaaggttcagtgcagtggatcgtgggacagatttcactctcaccatcagcagtctgcaacctgaagtattttgactaactttactactgtacaactagtagttacagtcgccccgtcggaccgttcggaccgaagggaccaagggtacggaaatacgaaacgactgtcggctagaccactgtcttcg

SEQ ID NO: 287284 - DNA, 501 bp, Homo sapiens
  misc_feature: GYAE6OF01EJJCZ.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaagcccctaaactcctgatctatgatgcatccactttgcaaagtgggtccatcaaggttcagtggcagtgatctgggacagatttcactctcaccatcagcagtctgcaacctgaagtattttgactaactttactactgtacaacagtagttacagtcgcccctcggacgttcggaccgaacgggaccaagggtcggaaatacgaaacgaactgtacggtctagacaccatcgtcg

SEQ ID NO: 287285 - DNA, 584 bp, Homo sapiens
  misc_feature: GYAE6OF01C0MVJ.6.19.B08.1.454.CMB.1.raw
  modified_base (215)..(215): a, c, t, g, unknown or other
  misc_feature (215)..(215): n is a, c, g, or t
  modified_base (272)..(272): a, c, t, g, unknown or other
  misc_feature (272)..(272): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggnaagtcagagcattagcaccttatttaaattggtatcaggagaatccgaagggaaacncccctaaactcctagatctatgatgacatccatttgacgtaaaggtcgggtacccagtacgaaggttcaggtggactaggtggatcgtagggactagtatttcactctacacatcagctagtctagacctaacctagtaagtattttacgaaccttaaactttactaacttcgtaacctaacgtagtaacgtttaacacggttccgtacccccgttcgggtaaccgttccggaaccgaaccgggtaaccgaagggtacgaaactaacgaaacgtacgtaggtacggtactacggaccaaccgtatcgttacg

SEQ ID NO: 287286 - DNA, 488 bp, Homo sapiens
  misc_feature: GYAE6OF01B1NBN.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaactcctgatctatgatgcatccactttgcaaagtgggtccatcaaggttcagtgcagtggatctgggacagatttcactctcaccatcagcagtctgcaacctgaagattttgactaactttactactgtcaacagtagttacagtcgcccctggacgttcggccaacgggaccaaggtggaaatcaaacgactgtagctagcacatcgtcg

SEQ ID NO: 287287 - DNA, 507 bp, Homo sapiens
  misc_feature: GYAE6OF01CS2AQ.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcactattaatggtatcaggagaatccagggaaagcccctaaactcctgatctatgatgcatccactttgcaaagtggggtcccatcaaaggttcagtggcagtggatctgggacagatttcactctcaccatcagcagtctgacaacctgaaagtattttgactaaactttactactgtacaacagaagttacagtcgcccctcggacgtcgtaccgaaggaaccgaaaggtaggaaatacaaacgaaacgtagtaggcgtagacaccatcgttacg

SEQ ID NO: 287288 - DNA, 495 bp, Homo sapiens
  misc_feature: GYAE6OF01AJ7HU.6.19.B08.1.454.CMB.1.raw
  modified_base (479)..(479): a, c, t, g, unknown or other
  misc_feature (479)..(479): n is a, c, g, or t
tcagatatcgcgagcacgaccggtgctcgatttagtgagtcagtaaggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaatcctgatctatgatgcatccactttgcaaagtgggtccatcaaggttcagtgcagtggatcgtgggacagatttcactctcaccatcagcagtctgacaaccgtgtaagtattttgactaactttactactgtcaacagtacgtttacagttcgccccgtggacgttcggaccaagggaccgaaggtgaaatacaaacgactgngtcagacacatcgtcg

SEQ ID NO: 287289 - DNA, 749 bp, Homo sapiens
  misc_feature: GYAE6OF01CNU1K.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcccctcctgtctgctatcgtaggtacggacacgagacgtaccacctatcctacgttcggccgggactaacgtcgaaggacgactaagttacgacctaaccttttaaaagttttaaagttaggttaactaccggaaagggaacgtaaaccgtaccgggaaaacggggaaaaccccgtaacccccttaaaaccgttccctagtacttacttagtagtagtcgacctactacccttacgtttgaacgtaacgggttccgggtacctagtacgtaaacggtcgtaaggtcggacgtaggtggtaacgtcggtacgggactaagtttacttacctacttcctaacccaacctactacgacgtaccgtaacgttcgtacgtaacccgtaacgtaaggtaacgtttacgttttacgaacctttaaacctttactaaccgttacgttaaaccaaacgtacggttaacgttacgacggttcccgtaccccgtacgggtaccggtccggaaccggaaacgggaccgtaaagggtaacgaaacgtaaaccgaaacgtacgtacgggtcggtactaccgacaacctgttcgttacg

SEQ ID NO: 287290 - DNA, 514 bp, Homo sapiens
  misc_feature: GYAE6OF01C56MB.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctattaaattggtatcaggagaatccagggaaagcccctaaaactcctagatctatgatgcatccactttgcaaagtgggtccatcaaggttcagtgcagtgatctgggacagattcactctcaccatcagcagtctgcaacctgaagtattttgactaactttactactgtacaacagtagttacagtcgcccctgggacgttcggccaaagggtaccaaagggtacggaaattacgaaaacggtaactggtacggacgttacgacaaccattcgttacg

SEQ ID NO: 287291 - DNA, 514 bp, Homo sapiens
  misc_feature: GYAE6OF01B7LJE.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaactcctgatctatgatgcatccactttgcaaagtgggtcccatcaaggttcagtggcagtggatctgggacagatttcactctcaccatcagcagtctgcaacctgaagtattttgctaaactttactactgtacaactagagttacagttcgccccttggaccgttccggaccgaacgggaaccgaagggtacggaaatacgaaaacgaactagtacggtctagaccaccatcgtacg

SEQ ID NO: 287292 - DNA, 572 bp, Homo sapiens
  misc_feature: GYAE6OF01EADG0.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcactatttaaatggtatcagagaatccgaggaacgcccctaaatcctgatctatgatgactatcctacttttgactaaaggtcgggtccagtcaaggttcaggtggctagtggatcgtgggacagtatttcacttctcacctatcacgcagtctcgacctaaccgtgaagtattttcgacctaaactttacctactcgtaacaacgtagtaacgttaacgacgttccgtaccccgtacgggtaccggttaccggaccgtaaacggggaaccgtaaagggtacggtaaacgtaccgaaaaccgaacgttagacgggtactacggactacctagtccgttacg

SEQ ID NO: 287293 - DNA, 555 bp, Homo sapiens
  misc_feature: GYAE6OF01CQDT3.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcaacctatttaaatggtatcaggagaatccagggaaagcccctaaatcctgatctatgatgcatccactttgacaaagtgggtccatcaaggttcagtggcagtggatcgtgggacagatttcactctcaccatcagcagtctagccaacctgtaatattttgacctaaactttactaactgtaaccaagacgtaacgttacacggtccgtacccccgttggaaccggtttccggaccgaaacgggtaaccgaaagggttacggaaaattaccgaaaacggtaacgttggtacggtactacggtaccaaccctagttccgttacg

SEQ ID NO: 287294 - DNA, 495 bp, Homo sapiens
  misc_feature: GYAE6OF01CVEDS.6.19.B08.1.454.CMB.1.raw
  modified_base (479)..(479): a, c, t, g, unknown or other
  misc_feature (479)..(479): n is a, c, g, or t
  modified_base (485)..(486): a, c, t, g, unknown or other
  misc_feature (485)..(486): n is a, c, g, or t
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacgcccctaaactcctgatctatgatgcatccactttgcaaagtgggtccatcaaggttcagtggcagtggatcgtgggacagtatttcactctcaccatcagcagtctagctaacctgaacgtatttgactaacttactactgtacaactagtagttacagttcgcctcgtcgtacgtccgacgacggacgtaaggtagaacacgaactagngtgacnncncgtntcg

SEQ ID NO: 287295 - DNA, 526 bp, Homo sapiens
  misc_feature: GYAE6OF01CO3O1.6.19.B08.1.454.CMB.1.raw
  modified_base (223)..(223): a, c, t, g, unknown or other
  misc_feature (223)..(223): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagngcattagcacctatttaaattggtatcaggagaatccagggaaacgcccctaaaactcctgatctatgatgcatccactttgcaaagtgggtccatcaaggttcagtggcagtggatcgtgggacagtatttcactctcaccatcagcagtctgcaacctgaagtattttgactaactttactactgtacaacagtattacagtcgtcccctcggaccgttcggaccgaaacgggaccgaaagggtacggaaagtaccgaaaacgtaacgttggtacggtacgtcgaccaacctagtcgttcg

SEQ ID NO: 287296 - DNA, 489 bp, Homo sapiens
  misc_feature: GYAE6OF01DWJJA.6.19.B08.1.454.CMB.1.raw
  modified_base (483)..(483): a, c, t, g, unknown or other
  misc_feature (483)..(483): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaagcccctaaactcctgatctatgatgcatccactttgcaaagtgggtccatcaaggttcagtgcagtgatctgggacagatttcactctcaccatcagcagtctgcaactgaagtattttgctaacttactactgtcaacagagttacagtgcccctggacgttccggccgaagggaccgtaaggtggaaatcaaacgaactgtaggtctagccaacntctacg

SEQ ID NO: 287297 - DNA, 511 bp, Homo sapiens
  misc_feature: GYAE6OF01CU932.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccggcaagtcagagcattagcactattaaattggtatcaggagaatccgaggaaagcccctaaactcctagatctatgatgcatcctatttgacaaagtgggtccatcgaaggttcagtgcagtggatgtgggacagtattcactctcaccatcagctagtctgctaacctgtaaagtattttacgactaaactttactactgttacaatagtagttacagtcgccccgtggacgttcggaccgaacgggaccgaaggtaggaaatacaaacggactgtgtacctcgacacctatcgttcg

SEQ ID NO: 287298 - DNA, 515 bp, Homo sapiens
  misc_feature: GYAE6OF01A4VXW.6.19.B08.1.454.CMB.1.raw
  modified_base (254)..(254): a, c, t, g, unknown or other
  misc_feature (254)..(254): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcagganaatccagggaaagcccctaaatcctgatctatgatgcatccactttgcaaagtgggtcccatcaaggttcagtggcagtggatcgtgggacagatttcactctcaccatcagcagtctgcaacctgaagtattttgctaactttactacttgtacaacagtacgttacagttcgccccgtcggaccgttcggacccgaaagggacccaagggtacggaaataccgaaacggaactggtacggcttagaccaccatcgtacg

SEQ ID NO: 287299 - DNA, 497 bp, Homo sapiens
  misc_feature: GYAE6OF01CYGPD.6.19.B08.1.454.CMB.1.raw
  modified_base (491)..(491): a, c, t, g, unknown or other
  misc_feature (491)..(491): n is a, c, g, or t
tcagatatcgcgagcacgaccggtgctcgatttagtgagtcagtaaggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctattaaattggtatcaggagaatccagggaaagcccctaaaactcctgatctatgatgcatccactttgcaaagtgggtcccatcaaggttcagtggcagtggatctgggacagatttcatctcaccatcagcagtctgcaacctgaaagtattttgactaactttactactgtacaacagagttacagttcgcccctggacgttcggaccaaagggaccaaggtggaaatcgaaaacgaactgtaggctagcaaccntctacg

SEQ ID NO: 287300 - DNA, 545 bp, Homo sapiens
  misc_feature: GYAE6OF01CA9BX.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccaggaaagcccctaaaatcctgatctatgatgcatccactttgcaaagtgggtcccatcaaggttcagtgcagtggatctgggacagatttcactctcacatcagcagtctgcaacctgaagtattttgacctaaactttactactagtacaaactagtaagtttacagttcgacccccgttcgggtaaccgttccggaccgaaacgggtaccgtaaagggtacggtaaaataccgtaaaaccgaacgttaggtacggtacgtacgaccaaccgtagtccgttacg

SEQ ID NO: 287301 - DNA, 496 bp, Homo sapiens
  misc_feature: GYAE6OF01AC68N.6.19.B08.1.454.CMB.1.raw
  modified_base (265)..(265): a, c, t, g, unknown or other
  misc_feature (265)..(265): n is a, c, g, or t
  modified_base (364)..(364): a, c, t, g, unknown or other
  misc_feature (364)..(364): n is a, c, g, or t
  modified_base (387)..(387): a, c, t, g, unknown or other
  misc_feature (387)..(387): n is a, c, g, or t
  modified_base (413)..(413): a, c, t, g, unknown or other
  misc_feature (413)..(413): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaatggtatcagagaatccagggaacncccctaaatcctgatctatgatgcatccactttgactaaaggtcgggtcccatcaaggttcagtggcagtgatcgtgggacagtatttcactctcaccntcagcagtctgacaacctgaatnttttgactaacttctactgtcaaacngtagttacagtcgacccctggaccgttcgaccgaagggaccaaggtggaaactacgaaacgactgtgctgaccactatctacg

SEQ ID NO: 287302 - DNA, 544 bp, Homo sapiens
  misc_feature: GYAE6OF01A3GZG.6.19.B08.1.454.CMB.1.raw
  modified_base (270)..(270): a, c, t, g, unknown or other
  misc_feature (270)..(270): n is a, c, g, or t
  modified_base (379)..(379): a, c, t, g, unknown or other
  misc_feature (379)..(379): n is a, c, g, or t
  modified_base (418)..(418): a, c, t, g, unknown or other
  misc_feature (418)..(418): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcacctatttaaattggtatcaggagaatccagggaaacncccctaaactcctgatctatgatgcatccactttgacaaaggtgggtcccatcgaaggttcagtgcagtggatcgtgggacagtatttcactctcaccatcagcagtcngcaactgaagtatttgactaacttactactagtaccaanagtagttaacacgtcgaccccgtcggaaccgttcggaccgtaaacgggaaccgtaaaggtacggtaaataccgaaaacgtaaccgtaggttacgggacttacggacctaaccctgttccgttacgg

SEQ ID NO: 287303 - DNA, 573 bp, Homo sapiens
  misc_feature: GYAE6OF01BCEP4.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagctacttattaaatgtatcgaggagaatccgaaggaaaccgacccctaaactcctagactctatgatgctatcctatttgactaaggtcggtaccaatacgtaaggttcaggtcggacgtaggtggactcggtagggactagtactttcactctacactatacagctacgtctgacctaacgtgtaacgttatttacgactaacttactacttgtaacaagtacgtagttacacgtccgacccgtaggtaccgtcggaccgaaacggtaaccgtaaggtaacggaaattaaccggaaaacgtacgttagggtacggtaccgtacgaccctaactcgttcgttcg

SEQ ID NO: 287304 - DNA, 538 bp, Homo sapiens
  misc_feature: GYAE6OF01BY9FN.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatgtatcagagaatccaggaagcccctaaatcctgatctatgatgcatccactttgacaaagtcgggtccatcaaggttcagtggcagtgatcgtgggacagatttcactctcaccatcagcagtctgacaaccgtgtaagtattttcgactaacttaactacttagtacaaactagtagttaacacgttcgtaccccgtacgggtaccggttccggaccgtaaacggggaaccgtaagggtacgaaacgtacgaaaacgtaacgtggtacggtctacggaccaccgtatccgtacg

SEQ ID NO: 287305 - DNA, 491 bp, Homo sapiens
  misc_feature: GYAE6OF01D71L1.6.19.B08.1.454.CMB.1.raw
tcagatatcgcgagcacgaccggtgctcgatttagtgagtcagtaaggggaggtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtgggtcccgatcaaggttcagtggcagtggatctgggacagatttcactctcaccatcagcagtctgccaacctgaagattttgctacttactactgtcaacagagttacagtcgcccctcggcgtcgccgacggaacacggtagaagacaacgaaactcgtaggtctacgcgaccatcgtcg

SEQ ID NO: 287306 - DNA, 558 bp, Homo sapiens
  misc_feature: GYAE6OF01DLRYT.6.19.B08.1.454.CMB.1.raw
  modified_base (410)..(410): a, c, t, g, unknown or other
  misc_feature (410)..(410): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagctacctatttaaattggtatcaggagaatccgaagggaaacgacccctaaactcctagatctatgatgacatcctatttcgacgtaaaggtcgggtacccagtacgaaaggttcaggtggcaggtggatcgtagggactagtatttcactctacacatcagcagtctgacaactgtaatntttacgacttaacttactactatacaaacgtagtaagttacacggttccgtaccccgtacggtaccgttccggaccgaaacgggtaaccgaagggtacggaaataacgaaacgtacgtaggtcggtactacgaccacgtatcgttacg

SEQ ID NO: 287307 - DNA, 513 bp, Homo sapiens
  misc_feature: GYAE6OF01DPN0X.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagctacctatttaaatggtatcaggagaatccagggaaacgcccctaaatcctgatctatgatgcatccatttgactaaagtgggtccatcaagttcagtgcagtgatcgtagggacagtatttcactctacaccatcagctagtctgacctaacctgaatattttgactaacttactactgtacaacagtacgttacacgttccgcccgtcggacgttccggaccgaacggaccgaaggtacgaaatacgaaacgacgtgtcggactacgacacctgtcgtacg

SEQ ID NO: 287308 - DNA, 541 bp, Homo sapiens
  misc_feature: GYAE6OF01C8WP7.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctattaaattggtatcaggagaataccgaaggaacgcccctaaactcctagatctatgatgcatcctactttgactaaaggtcgggtaccagtacgaaggttcagtggacaggtggatcgtagggacagtattcactctcactatcagctagtctagaccaaccgtgtaagttattttacgacctaactttactacttgtaaccaacgtagtagttacagttccgccccgttacgggtaccgttcggaccgaagggtaccgaaggtacgaaatacgaaacgtacgtgtcgctacgacaccatcgtacg

SEQ ID NO: 287309 - DNA, 634 bp, Homo sapiens
  misc_feature: GYAE6OF01DGW79.6.19.B08.1.454.CMB.1.raw
  modified_base (356)..(356): a, c, t, g, unknown or other
  misc_feature (356)..(356): n is a, c, g, or t
tcagatatcgcgagcacgaccggtgctcgatttagtgagtcagtaagggggagtcagtctcagtcaggacacagcatggacatgagggtccccgctcagctccgtggggcctccgtgctactctggctccgaggtgccagatgtgacatccagatgacccagtcctccatccctccctgtctgcatctgtaggacacagacgtacacctatccacttggccgggacaagtcaagagcaattagctaaccttatttaaattggtatcaaggagaatacgaagggaacaccctaaactcctagactctatgatgcatccatttgacgaaggtcgggtaccagtacaaggttcagtganagtggatcgtaggactagtacttcactctacaccatacacgtactagtactacgacctaacgtgtaaacgtacttttagaccttaactttacctacttacgtaacctaataacggttacgttaacgtacggttacccgttaccccggtaccgggtaaccgggttacccggaaacccggtaaacggggaaccgtaaacgggtaaacggaaacttaacggaaaaccggtaacgtacggttacgggtactacgtaccgtaaaccctagttccgttaaccgg

SEQ ID NO: 287310 - DNA, 509 bp, Homo sapiens
  misc_feature: GYAE6OF01BCJAD.6.19.B08.1.454.CMB.1.raw
  modified_base (412)..(412): a, c, t, g, unknown or other
  misc_feature (412)..(412): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaaagcccctaaactcctgatctatgatgcatccactttgcaaagtgggtccatcaaggttcagtggcagtggatcgtgggacagatttcactctcaccatcagcagtctgcaacctgaagtattttgactaactttactactgtacaanagtagttacagttcgccccgtcggacgttcggaccgaacgggaccgaaggtaggaaatacgaaacgaacgtggtacggtactacgaccaccatctcg

SEQ ID NO: 287311 - DNA, 498 bp, Homo sapiens
  misc_feature: GYAE6OF01CETKI.6.19.B08.1.454.CMB.1.raw
  modified_base (269)..(269): a, c, t, g, unknown or other
  misc_feature (269)..(269): n is a, c, g, or t
  modified_base (385)..(385): a, c, t, g, unknown or other
  misc_feature (385)..(385): n is a, c, g, or t
  modified_base (492)..(492): a, c, t, g, unknown or other
  misc_feature (492)..(492): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacncccctaaactcctgatctatgatgcatccatttgcaagtgggtccatcaaggttcagtggcagtggatcgtgggacagtatttcactctcaccatcagcagtctgcaactgaagtntttagactaacttactactgtacaactagtagttacagttcgccccgtggtacgttcggaccgaaggaccgaaggtacgaatacgaaacgactggtagctagacacntcgtcg

SEQ ID NO: 287312 - DNA, 576 bp, Homo sapiens
  misc_feature: GYAE6OF01EL2F5.6.19.B08.1.454.CMB.1.raw
  modified_base (345)..(345): a, c, t, g, unknown or other
  misc_feature (345)..(345): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacgcccctaaactcctgatctatgatgcatccactttgacaaaggtgggtcccatcaaggttcagtggcagtggatcgngggacagtatttcactctcaccatcagcagtctgacctaacctagtaacgtattttacgacctaactttactactacgtacaactagtaagttacgtagttccgtaccccgtacgggtaccggttaccggacccgtaaacggggaacccgtaaacggggtaacggtaaagtaaccgaaaaccggtaaaccgttaggtacggtcgtacgacccgtaacctacgttcgttacg

SEQ ID NO: 287313 - DNA, 611 bp, Homo sapiens
  misc_feature: GYAE6OF01CI2A9.6.19.B08.1.454.CMB.1.raw
  modified_base (249)..(249): a, c, t, g, unknown or other
  misc_feature (249)..(249): n is a, c, g, or t
  modified_base (262)..(262): a, c, t, g, unknown or other
  misc_feature (262)..(262): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctcgaggtgccagatgtgacatccagatgacccagtctccatcctccctgtctgcatctgtaggacacagagtcaccatcacttgccgggcaagtcagagcattagcactattaatgtatcagganaatccagggaacncccctaaatccagatctatgatgcactcctactttgactaaaggtcgggtacccaatcgaaaggttcagtggactagtggatcgtgggactagtattcactctacacatcagctagtctacgtaactagtaagttattttagaccttaacttacttactacgtaacaaacgtaacgtagtttaaccgacgttaccgtacccccgttacgggtacccggtttaccgggaacccggtaaacggggtaaaccgtaaaagggtacgggtaaaaacctaccggaaaaacggtaaccgttagggttacggtaccgttacggaacctaacccgtagttacccgttcggtttacccg

SEQ ID NO: 287314 - DNA, 496 bp, Homo sapiens
  misc_feature: GYAE6OF01DR4ZQ.6.19.B08.1.454.CMB.1.raw
  modified_base (490)..(490): a, c, t, g, unknown or other
  misc_feature (490)..(490): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcactatttaaatggtatcaggagaatcagggaagcccctaaatcctgatctatgatgcatccactttgacaaagtgggtccatcaagttcagtgcaggtgatctgggacagtattcactctcaccatcagctagtctgccaacctgaagtattttgactaacttactactgtacaacagtagttacagttcgccctcggacgttccggacgaacgggaccaaggtacgaaatcgaaacgaactggtacggctagccaccntcgtcg

SEQ ID NO: 287315 - DNA, 639 bp, Homo sapiens
  misc_feature: GYAE6OF01C2P5Z.6.19.B08.1.454.CMB.1.raw
  modified_base (216)..(216): a, c, t, g, unknown or other
  misc_feature (216)..(216): n is a, c, g, or t
tcagatatcgcgagcacgaccggtgctcgatttagtgagtcagtaaggggagtcagtctcagtcaggacacagcatggacatgagggtccccgctcagctcctggggctcctgctactctggctccgaggtgccagatgtgacatcccagatgacccagtctccatcctccctgtctgcatctgtaggacacagagtcaccatcacttgccggganaagtcagagtcattagctacttaatttaattaggtatcgaggagaataccgaagggaaaccgtaccctaaactcctagtactactatagatgactactacctacgtttcgaacgtaacggtcggtacctagtacgtaaggtcgaggtcggacgtagtaggtactcgtaggactagtacttacactctacacctactacacgtactacgtactacgacctaaccgtagtaacgttacgttttacgaacttaaacgtttaacttaccttacgtaacctaaacgtaggttaacgttacgtacggtcccgtaccccgtacggtaccggttaccggaccggtaaaccgggtaaccggtaaagggtaacggtaaacgtaaccgtaaacgtacgtaggtacggtactacgacctaacctacgtcgttacg

SEQ ID NO: 287316 - DNA, 519 bp, Homo sapiens
  misc_feature: GYAE6OF01BNQFZ.6.19.B08.1.454.CMB.1.raw
  modified_base (215)..(215): a, c, t, g, unknown or other
  misc_feature (215)..(215): n is a, c, g, or t
  modified_base (386)..(386): a, c, t, g, unknown or other
  misc_feature (386)..(386): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggnaagtcagagcattagcacctatttaaatggtatcaggagaatccagggaaacgcccctaaactcctgatctatgatgcatccatttgacaagtgggtccatcaaggttcagtgcagtggatcgtgggacagtattcactctcaccatcagcagtctacgcaacctgaagtnttttacgactaacttactactacgtcaactagacgttacgagttcgccccgtaggaccgtttcggaccgtaacgggaaccaagggtacgaaatacgaaaccgaactggtacggtctacgacctacagtctacg

SEQ ID NO: 287317 - DNA, 511 bp, Homo sapiens
  misc_feature: GYAE6OF01BFXTY.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaaagcccctaaactcctgatctatgatgcatccactttgcaaagtgggtcccatcaaggttcagtggcagtggatcgtgggacagatttcactctcaccatcagcagtctgcaacctgaagtattttgctaacttactactgtacaacagagttacagtcgccccgtcggacgttcggaccaagggaccgtaaggtacggaaataccgaaacgaacgtggtacggtctacggaccacctatcgttacg

SEQ ID NO: 287318 - DNA, 715 bp, Homo sapiens
  misc_feature: GYAE6OF01BBSSK.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcaccttaatttaaatggtatcaggagaatccgaagggaaacgcccctaaactcctagactctatgatgctactcctactttgacgtaaaggtcgggtacccagtacgtaacggttcaggtggacgtaggtggtacgtcgtaggggtaacctaaggtacttttccaaccgtttcctaccgtaaccctaagttaccgaaacggtcctaacggttccgttaacggaacctaaacccgttaggtaaacggtttacgttttttacggaaccctttaaaaccgttttaaccgttaaccgttacgttaacctaaaccggttaaggttaacgttttaaccgaacggtttcccgtacccccggttacgggtaacccggtttaccggggaacccgtaaaacgggggtaacccgtaaaggggtaacggtaaaacgtaaccgaaaacggtacgttacggtacgggtaccttacggaacctacctagttccgttaccg

SEQ ID NO: 287319 - DNA, 516 bp, Homo sapiens
  misc_feature: GYAE6OF01B1GVB.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacgcccctaaactcctgatctatgatgcatccactttgcaaagtgggtacccatcaaggttcagtgcagtggatcgtgggacagatttcactctcaccatcagcagtctgcaacctgtaagtatttgactaacttactactgtacaacagtagttacagtcgcccgtacggaccgttcggaccgtaagggacccgaagggtacgaaatacgaaacgactaggtcggactacggaccacctagttcctacg

SEQ ID NO: 287320 - DNA, 516 bp, Homo sapiens
  misc_feature: GYAE6OF01CDB4O.6.19.B08.1.454.CMB.1.raw
  modified_base (223)..(223): a, c, t, g, unknown or other
  misc_feature (223)..(223): n is a, c, g, or t
  modified_base (387)..(387): a, c, t, g, unknown or other
  misc_feature (387)..(387): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagngcattagcacctatttaaattggtatcaggagaatccagggaaacgcccctaaaactcctgatctatgatgcatccactttgcaaagtcgggtccatcaaggttcagtggcagtggatctgggacagtatttcactctcaccatcagcagtctgcaactgaatnttttgactaacttactactgtacaactagacgttactattcgcccctacggtacgttcggccgaaagggacccgtaagggtacggaaataccgaaacgaactggtacggcctagaccacctatcttacg

SEQ ID NO: 287321 - DNA, 534 bp, Homo sapiens
  misc_feature: GYAE6OF01BXTXP.6.19.B08.1.454.CMB.1.raw
  modified_base (253)..(253): a, c, t, g, unknown or other
  misc_feature (253)..(253): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaganaatccaggaaacgcccctaaactcctgatctatgatgcatccactttgactaaaggtcgggtacccagtcaaggttcagtggcagtggatcgtgggacagatttcactctcacatcagcagtctgacaactagaagtattttagactaacttactacttgtacaacagtagttacagttcgaccccgtacggaaccgttccggaccgtaacgggaacccgaaagggtacggtaaatacgaaaacgacgtaggtacggactacggacaacctagtcgttacg

SEQ ID NO: 287322 - DNA, 496 bp, Homo sapiens
  misc_feature: GYAE6OF01EPOMG.6.19.B08.1.454.CMB.1.raw
  modified_base (267)..(267): a, c, t, g, unknown or other
  misc_feature (267)..(267): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaaancccctaaactcctgatctatgatgcatccactttgcaaagtgggtccatcaaggttcagtgcagtgatcgtgggacagtatttcactctcaccatcagcagtctgacaacctgaatattttgactaactttactactgtacaacagacgttacagtcgcccgtcggacgttcgaccgacgggaccaaggtgaaatacgaaacgaacgtgtcggactgacactgtctacg

SEQ ID NO: 287323 - DNA, 485 bp, Homo sapiens
  misc_feature: GYAE6OF01C13ON.6.19.B08.1.454.CMB.1.raw
  modified_base (480)..(480): a, c, t, g, unknown or other
  misc_feature (480)..(480): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaatcctgatctatgatgcatccactttgcaaagtgggtccatcaaggttcagtggcagtggatcgtgggacagatttcactctcaccatcagcagtctgcaacctgaagattttgctaacttactactgtacaacagagttacagtcgcccctggaccgttcggaccaagggaccaaggtgaaatcaaacgaactgaggctagcacntctcg

SEQ ID NO: 287324 - DNA, 519 bp, Homo sapiens
  misc_feature: GYAE6OF01ETMHL.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctcctgtctgcatctgtaggacacagagtcaccatcacttgccggcaagtcagagcattagcacctatttaaattggtatcaggagaatccagggaaacgcccctaaactcctgatctatgatgcatccactttgacaaagtcgggtccatcaaggttcagtgcagtggatcgtgggacagtatttcactctcaccatcagcagtctgaccaactgaagtattttgactaacttactactgtacaacagtagttacagtcgccccgtcggacgttcggaccgaacgggaacctaagggtaggtaaatacgaaaaccgaacgtggtacggtctacgaccacctagtcgttacg

SEQ ID NO: 287325 - DNA, 590 bp, Homo sapiens
  misc_feature: GYAE6OF01C503G.6.19.B08.1.454.CMB.1.raw
  modified_base (269)..(269): a, c, t, g, unknown or other
  misc_feature (269)..(269): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacttattaaattggtatcaggagaatccgaagggaacncccctaaaactcctagatctatgatgcatcctactttgacaaaggtcgggtacccataccgaaaggtttcaggttgggactaggtggaactcgtagggaactagtacttttcacttcctacaccatcagctagtctagcctaaccgtgtaaacgtattttgaccttaaacttcctactgtaccaactagtaacgttacagttccgccccgttaggtaccgttaccgggaccgtaaacggggaaccgtaaggggtaacggtaaaagtaccgaaaacggtaccgttaggtacggtcctacggacccaacctagttcgttaccg

SEQ ID NO: 287326 - DNA, 515 bp, Homo sapiens
  misc_feature: GYAE6OF01BFFJX.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaaagcccctaaactcctgatctatgatgcatccactttgcaaagtgggtccatcaaggttcagtggcagtgatctggacagatttcactctcaccatcagcagtctgcaactgaagtattttgactaacttactactgtacaactagaagttacagtcgccccgtacggaccgttcggaccgaaacgggaccgaaagggtacggaaatacgaaaacgaacctggtacggtctacgaccaacctagtcttacg

SEQ ID NO: 287327 - DNA, 486 bp, Homo sapiens
  misc_feature: GYAE6OF01A5FSA.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaatcctgatctatgatgcatccactttgcaaagtgggtccatcaaggttcagtggcagtggatctgggacagtatttcactctcaccatcagcagtctgcaacctgaagtattttgctaacttactactgtcaacagattacagtcgccccgtcggacgttcggaccgaaggaccaaggtgaatcgaaacgaactgcgtctgcacatctcg

SEQ ID NO: 287328 - DNA, 519 bp, Homo sapiens
  misc_feature: GYAE6OF01B6ALI.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaaacgcccctaaactcctagatctatgatgcatccactttgcaaagtgggtccatcaaggttcagtgcagtggatcgtgggacagtatttcactctcaccatcagcagtctgacaacctgaagtattttgactaactttactactgtacaacagtagttacagttcgccccgtcggacgttccggaccgaaacgggacccgaaagggtacgaaatacgaaacgaacgtaggtcggactacgaccacctatcgtacg

SEQ ID NO: 287329 - DNA, 530 bp, Homo sapiens
  misc_feature: GYAE6OF01CINBO.6.19.B08.1.454.CMB.1.raw
  modified_base (522)..(522): a, c, t, g, unknown or other
  misc_feature (522)..(522): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtgggtcccatcaaggttcagtgcagtggatcgtgggacagtatttcactctcaccatcagcagtctgcaacctgaagtatttgactaactttactacttgtacaaactagtaagttacagttcgcccccgttcggaaccgttccggaccgtaagggaacccgaagggtacggtaaataccgaaacgaacttggtacggtactacgaccaacctntcgttacg

SEQ ID NO: 287330 - DNA, 546 bp, Homo sapiens
  misc_feature: GYAE6OF01EMYJI.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaaagcccctaaaactcctgatctatgatgcatccactttgcaaagtgggtccatcaaggttcagtggcagtggatctgggacagatttcactctcaccatcagcagtctgacctaacctgaagtattttgacctaaacttactaactgtacaaacgagtacgttaacacgttcgcccccgtacgggtaccgttccgggacccgaaacggggaaccctaagggtacggaaacttaacgaaaaccgtaaacgtggtacggtctaggaccaacccatccgttacgg

SEQ ID NO: 287331 - DNA, 520 bp, Homo sapiens
  misc_feature: GYAE6OF01DPH76.6.19.B08.1.454.CMB.1.raw
  modified_base (512)..(512): a, c, t, g, unknown or other
  misc_feature (512)..(512): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtagacacagagtcaccatcacttgccgggcaagtcagagcattagcactatttaatgtatcaggagaatcaggaacgccctaaactcctgatctatgatgcatccatttgacaagtcgggtccatacaaggttcagtggacagtggatcgtgggactagtattcactctacactatcagctagtctgacctaacgtgaagttacttttgactaactttactaacttgtaaccaatagtacgttacagttcgccccgtggaccgttcggaccgaaacgggacctaaggtacggtaaatacgaaacgaagtgtacggactaggacctaacngtcgtacg

SEQ ID NO: 287332 - DNA, 545 bp, Homo sapiens
  misc_feature: GYAE6OF01DIQZF.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggcaagtcagagcattagcacctattaaattggtatcaggagaatccagggaacgccctaaactcctgatctatgatgcatccactttgacaaagtcgggtccatcaaggttcagtggcagtgatcgtgggacagtatttcactctcaccatcagcagtctgcaacctgaagtattttgactaactttactacttgtacaactagtagttacagttcgaccccgttcgggtaccgttaccggaccgaaacgggtaccgaagggtaaggaaacttaccgaaaaccggtaacgttcgggtacggtaccgttacgacctaaccctagttcgttacgg

SEQ ID NO: 287333 - DNA, 499 bp, Homo sapiens
  misc_feature: GYAE6OF01BZREJ.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcacctatttaaattggtatcaggagaatccaggaaagcccctaaactcctgatctaatgatgcatccactttgacaaagtgggtaccatctaaggttcagtggcagtggatcgtgggacagtatttcactctcaccatcagcagtctagacaacctgaagtattttgacctaattactactgtacaatagattacagtcgccctggacgtcgaccgaaggaccgaaggtacgaaatacgaaacgacgtagtgtctagacactatctcg

SEQ ID NO: 287334 - DNA, 499 bp, Homo sapiens
  misc_feature: GYAE6OF01A65XT.6.19.B08.1.454.CMB.1.raw
  modified_base (493)..(493): a, c, t, g, unknown or other
  misc_feature (493)..(493): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaaagcccctaaactcctgatctatgatgcatccactttgcaagtgggtccatcaagttcagtgcagtggatctggacagatttcactctcaccatcagcagtctgcctaacctgtaagtattttagctaacttactactgtacaacagtagttacacgtgccccgtcggaccgtcggccgaaagggaccctaaagggtggaaatacgaaacgactgtacgtcacgacacntctacg

SEQ ID NO: 287335 - DNA, 514 bp, Homo sapiens
  misc_feature: GYAE6OF01ESD4J.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaaacgcccctaaactcctgatctatgatgcatccactttgacaaagtcgggtccatcaaggttcagtggcagtggatcgtgggacagtatttcactctcaccatcagcagtctgaccaacctgaagtatttgactaactttactactgtacaacagtagttaacagtcgcccgtacggacgttcggaccgaacgggaaccgaagggtagaaatacgaaacgaacgtgtacggtctagacacctagtctacg

SEQ ID NO: 287336 - DNA, 637 bp, Homo sapiens
  misc_feature: GYAE6OF01CPZ8T.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatcgacccagtcctccactccctccctgtctgctatctggtaggacacagagtccaccatcacgttgccgggacaagtcagagctattacgactaaccttaatttaaagttggtaatcgaaggagaacgtaccgaagggaaaccacccccttaaactcctagtacttactatcgatcgactacttccctatttcggacgtaaacggtcgggtacccagtaccgtaaggttcaggtggacgtaggtggtacttcggtagggtactaggttactttaccacttacctaccgaacctagttaccaacgtaccctagttcctacggaaccctaaccgtaggtaaacttcgtttacgaaccttaaactttacgtactacgttacaaacgtacgtacgttacgacggtcctacccggtggtaccggtacgaccgtaacgggacgtaaggtacgaatacgaaacgtactgcggtacacgaccactcttgtacg

SEQ ID NO: 287337 - DNA, 575 bp, Homo sapiens
  misc_feature: GYAE6OF01DZCNP.6.19.B08.1.454.CMB.1.raw
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
  modified_base (566)..(566): a, c, t, g, unknown or other
  misc_feature (566)..(566): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcagganaatccagggaacncccctaaactcctgatctatgatgcatccactttgacaaaggtcgggtacccatacaaggttcagtggcagtggatcgtgggactagtatttcactctccaccatcagcagtctgacaaccctagaaagttattttacgacctaaactttactacttacgtaccaacgtaagtaacgttacgtacggttaccgtaccccgttacgggtaccggttccggaaccggtaacgggaaccggtaaagggtacggtaaaagtaccgaaaacggtaaccgttggtacggtacgtacgacaacctntcgttaccg

SEQ ID NO: 287338 - DNA, 510 bp, Homo sapiens
  misc_feature: GYAE6OF01DC5F8.6.19.B08.1.454.CMB.1.raw
  modified_base (253)..(253): a, c, t, g, unknown or other
  misc_feature (253)..(253): n is a, c, g, or t
  modified_base (388)..(388): a, c, t, g, unknown or other
  misc_feature (388)..(388): n is a, c, g, or t
  modified_base (429)..(429): a, c, t, g, unknown or other
  misc_feature (429)..(429): n is a, c, g, or t
  modified_base (503)..(503): a, c, t, g, unknown or other
  misc_feature (503)..(503): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggcaagtcagagcattagcaccttattaaatggtatcagganaatcaggaacgccctaaactcctgatctatgatgcatccattgacaagtgggtccatcaagtcagtggcagtgatcgtagggacagtatttcactctccaccatccagccagtctacgctaaccgtgtaaacgtnttttacgactaaactttactactgtacaacgagtagttacncgtacgtccccgtggacgttcgaccgaagggacctaagggtagaaatcgaaaacgattggacggctagaccacnttcgtac

SEQ ID NO: 287339 - DNA, 535 bp, Homo sapiens
  misc_feature: GYAE6OF01B71UA.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagagcattagcacctatttaaattggtatcaggagaatccagggaaagcccctaaactcctgatctatgatgcatccactttgcaaagtgggtccatcaaggttcagtggcagtgatcgtggacagatttcactctcaccatcagcagtctgcaacctgaatattttgactaactttactactgtaccaaactagtagttacacgttcgccccgtaggtaccgttcggaccgaaacggggaaccctaaagggtacggtaaaagtacgaaaaccggaacgttggacggtacgtacggacacccgtagttccgttacg

SEQ ID NO: 287340 - DNA, 525 bp, Homo sapiens
  misc_feature: GYAE6OF01EYMOH.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctattaaatggtatcaggagaatccagggaaagccctaaactcctgatctatgatgcatccactttgcaaagtcgggtccatcaagttcagtggcagtggatctggacagatttcactctcacatcagcagtctgcaacctgaagtattttagactaacttactactagtcaacagtagttacagttcgcccctaggtaccgttcgggacccaaacggggaaccgaaagggtacggaaaagtaccgaaaacgtaacgtaggtacggtacgtacgaccacctagtcgttacgg

SEQ ID NO: 287341 - DNA, 566 bp, Homo sapiens
  misc_feature: GYAE6OF01DNWNN.6.19.B08.1.454.CMB.1.raw
  modified_base (255)..(255): a, c, t, g, unknown or other
  misc_feature (255)..(255): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcagganaatccagggaaagcccctaaatcctgatctatgatgcatccatttgcaaagtgggtccatcaaggttcagtgcagtggatctgggacagtatttcactctcacatcagcagtctgacaactgaagtattttcgactaactttactacttacgtaccaaacgtacgtaaggtttaaccaggttccgacccccgttacgggtaaccggttccggaccgaaaccggggaaccgtaaaggggtacgggtaaaattaaccggaaaaccgtaaacgttggtacggtaccttaggacctaaccctagttccgttacgg

SEQ ID NO: 287342 - DNA, 496 bp, Homo sapiens
  misc_feature: GYAE6OF01EXGM3.6.19.B08.1.454.CMB.1.raw
  modified_base (491)..(491): a, c, t, g, unknown or other
  misc_feature (491)..(491): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaaagcccctaaatcctgatctatgatgcatccactttgcaaagtgggtccatcaaggttcagtggcagtggatcgtgggacagatttcactctcacatcagcagtctgaccaactgaagtattttgactaactttactactgtacaacagagttacagtcgcccctacggtacgttcggaccaacgggaccaaggtacggaaatacgaaacgacgtagcgctgacacntctcg

SEQ ID NO: 287343 - DNA, 541 bp, Homo sapiens
  misc_feature: GYAE6OF01CCLNA.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtcctccatcctccctgtctgcatctgtaggacacagagtcaccatcacttggccgggcaagtcagagcattagcaacctaatttaaattggtatcaaggagaatccgaagggaaacgcccctaaaactcctgatctatgatgcatccactttgacaaaggtgggtacccatcaaggttcagtggcagtggatcgtgggacagtatttcactctcaccatcagcagtctgacaacctgaagtattttgactaactttactactgtacaacagtagttacagtcgcccgtcggaccgttcggaccgaaacggaaccgaaagggtaggtaaactaacgaaaacgtaaaccgtaggtacggtcgtacgaccgaacctagtcttacg

SEQ ID NO: 287344 - DNA, 490 bp, Homo sapiens
  misc_feature: GYAE6OF01B282O.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaactcctgatctatgatgcatccactttgcaaagtgggtcccatcaagttcagtggcagtggatctgggacagatttcactctcaccatcagcagtctgcaacctgaagattttgcaacttactactgtcaacagagttacagtcgccctcggacgttcgccgaacggacaaggtacggaaatacaaacgaactagacggtctgcacagtctacg

SEQ ID NO: 287345 - DNA, 536 bp, Homo sapiens
  misc_feature: GYAE6OF01EEWSC.6.19.B08.1.454.CMB.1.raw
  modified_base (194)..(194): a, c, t, g, unknown or other
  misc_feature (194)..(194): n is a, c, g, or t
  modified_base (217)..(217): a, c, t, g, unknown or other
  misc_feature (217)..(217): n is a, c, g, or t
  modified_base (531)..(531): a, c, t, g, unknown or other
  misc_feature (531)..(531): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacanagtcaccatcacttgcccggganaagtcagagcattagcactatttaattaggtatcaggagaataccgaagggaaacgaccccttaactcctagattctaatgatacgtactactaccttactacgctaaaaaggttgggggttaccccaagtccaaagggtttccaaggttgggcagtggaatctggggacaggatttcacttctcaccatcagcaagtctgacacctgaatattttgactacttactactgtacaacagtagtacagttgcccctacggacgttcggaccaaagggaccaaggtcggaaatcgaaacgactagtgctagacacntctcg

SEQ ID NO: 287346 - DNA, 528 bp, Homo sapiens
  misc_feature: GYAE6OF01BMAVZ.6.19.B08.1.454.CMB.1.raw
  modified_base (268)..(268): a, c, t, g, unknown or other
  misc_feature (268)..(268): n is a, c, g, or t
  modified_base (521)..(521): a, c, t, g, unknown or other
  misc_feature (521)..(521): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaaacncccctaaactcctgatctatgatgcatccactttgacaaaggtcgggtccatcaagttcagtgcaggtgatcgtgggacagtatttcactctcaccatcagcagtctgaccaacctgaagtattttgacctaactttactactgtaccaatagtagttacacgtcgcccctacgggtaccgttcggacccgaaacgggaccgaagggtacggaaataccgaaaacgaaccgtagtcggtctacgaccaccctntcgttcg

SEQ ID NO: 287347 - DNA, 566 bp, Homo sapiens
  misc_feature: GYAE6OF01BQMRY.6.19.B08.1.454.CMB.1.raw
  modified_base (215)..(215): a, c, t, g, unknown or other
  misc_feature (215)..(215): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggnaagtcagagcattagcacctaatttaaattggtatcaggagaatccgaagggaaacgcccctaaactcctagatctatgatgcatcctactttgactaaaggtcgggtacccagtcaaggttcagtggcaggtggatcgtgggacagtatttcactctacaccatcagcagtctagacaactgaatattttacgacttaacttactactacgtaccaactagtaacgttacacgtccgtccccgtacgggtaccgttaccggaccgtaaacgggtaaccgaaagggtacggtaaaacgtacgtaaaacggaccgttaggtacgtacgtacgacctacctacgtcgttaccg

SEQ ID NO: 287348 - DNA, 563 bp, Homo sapiens
  misc_feature: GYAE6OF01C07WJ.6.19.B08.1.454.CMB.1.raw
  modified_base (208)..(208): a, c, t, g, unknown or other
  misc_feature (208)..(208): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtccaccataacncttgccgggcaagtcagagcattagcacctatttaaattggtatcaggagaatccagggaaacgcccctaaactcctagatctatgatgcatcctactttgacaaggtgggtcccatacaaggttacagtggcaggtggatcgtgggactagtatttcacgttctaccaccattcagtcagtaccttaggaccaaccgtagtaagttagttttacgaccgttaaactttaccttacttagtacctaaacgagtacgttactagtcgtacccccgtgggtaaccgtttccggacgaacgggtaccgaaggtcggaaactacgaaaccgacgtagtcgctcgcaacctgtcgttacg

SEQ ID NO: 287349 - DNA, 518 bp, Homo sapiens
  misc_feature: GYAE6OF01DXLWP.6.19.B08.1.454.CMB.1.raw
  modified_base (224)..(224): a, c, t, g, unknown or other
  misc_feature (224)..(224): n is a, c, g, or t
  modified_base (254)..(254): a, c, t, g, unknown or other
  misc_feature (254)..(254): n is a, c, g, or t
  modified_base (502)..(502): a, c, t, g, unknown or other
  misc_feature (502)..(502): n is a, c, g, or t
  modified_base (510)..(510): a, c, t, g, unknown or other
  misc_feature (510)..(510): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagancattagcacctatttaaatggtatcagganaatccagggaacgcccctaaactcctgatctatgatgcatccactttgcaaagtgggtccatcgaaggtcagtggcagtggatcgtggacagatttcactctcaccatcagcagtctgccaacctgaagtattttgacctaacttactactcgtacaactagtagttacacgtcgccccgtggtaccgttcggaccgaagggacccaagggtaggtaaaatacaaaacggtaacgtggtaggtcgtanaccacctntcgttacg

SEQ ID NO: 287350 - DNA, 541 bp, Homo sapiens
  misc_feature: GYAE6OF01D91DT.6.19.B08.1.454.CMB.1.raw
  modified_base (414)..(414): a, c, t, g, unknown or other
  misc_feature (414)..(414): n is a, c, g, or t
  modified_base (510)..(510): a, c, t, g, unknown or other
  misc_feature (510)..(510): n is a, c, g, or t
  modified_base (536)..(536): a, c, t, g, unknown or other
  misc_feature (536)..(536): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctcctgtctgcatctgtaggacacagagtcaccatcacttgccgggcaagtcagagcattagcacctaatttaaattggtatcgaggagaatccgaagggaaacgacccctaaactcctagactctatgatgactatcctactttgactaaaggtcgggtaccatcgaaggttcagtggcaggtgatcgtgggactagtactttcactctacacctatcagctagtctagacaacctagtaacgttnttttacgactaactttactactcgtacaacgtagtaagttacacgtccgccccgttaggtaccgttccggacgaacgggaaccgagggtacgaaanacgaaacgagtcgagctcgaccactntctcg

SEQ ID NO: 287351 - DNA, 516 bp, Homo sapiens
  misc_feature: GYAE6OF01CZ5RQ.6.19.B08.1.454.CMB.1.raw
  modified_base (216)..(216): a, c, t, g, unknown or other
  misc_feature (216)..(216): n is a, c, g, or t
  modified_base (411)..(411): a, c, t, g, unknown or other
  misc_feature (411)..(411): n is a, c, g, or t
  modified_base (431)..(431): a, c, t, g, unknown or other
  misc_feature (431)..(431): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggnaagtcagagcattagcacctatttaaattggtatcaggagaatccagggaaacgacccctaaactcctgatctatgatgcatccactttgcaaagtcgggtaccatcaaggttcagtggcaggtggatcgtggacagtatttcactctcaccatcagcagtctagacacctgaatatttgactaacttactactntacaactagagttacagtcncccgtcggaccgttcggacgaaacggaccgaagggtacggaaataccaaacgtaacgtggtacgtctacgaccacctatcgtacg

SEQ ID NO: 287352 - DNA, 617 bp, Homo sapiens
  misc_feature: GYAE6OF01BRDK1.6.19.B08.1.454.CMB.1.raw
  modified_base (272)..(272): a, c, t, g, unknown or other
  misc_feature (272)..(272): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcaccttaatttaaattggtatcaggagaatccgagggaaacncccctaaatcctgatctatgatgctactcctactttgactaaaggtcgggtacccagtacgaaggttcagtggctaggtggatcgtagggactagtacttttacacttcctacacctatccagctacgtcctagacctaacctgtaaacgttatttcgaccttaacttactacttagacctaacgtagtaacgttacgacggttcccgtccccgtagggtaacccggttccgggaacccggtaaacgggtaaccgtaaacggggttacgtaaaaccgtaaccggaaaaccggtaaccgttagggacgggtaccgtacgaccctaacccgttagtccgtttacccg

SEQ ID NO: 287353 - DNA, 503 bp, Homo sapiens
  misc_feature: GYAE6OF01BU8QL.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcacctatttaaattggtatcaggagaatccagggaaagcccctaaaactcctgatctatgatgcatccactttgcaaagtgggtccatcaagttcagtgcagtgatctgggacagatttcactctcaccatcagcagtctgacaacctgaagtattttgctaacttactactgtacaacagagttacagtcgcccctcggaccgttcggccaaacgggaccaaaggtcggaaatacgaaacgaactggtacggtctcgacaccatcgttacg

SEQ ID NO: 287354 - DNA, 490 bp, Homo sapiens
  misc_feature: GYAE6OF01BDOOH.6.19.B08.1.454.CMB.1.raw
  modified_base (475)..(475): a, c, t, g, unknown or other
  misc_feature (475)..(475): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaagtgggtccatcaagttcagtgcagtggatcgtgggacagatttcactctcaccatcagcagtctgcaacctgaagtattttgctaacttactactgtaccaacagagttacagttcgcccctcggacgttcggacgaacggaccaaggtcgaaatacgaaacgaactgngctgacaccatctcg

SEQ ID NO: 287355 - DNA, 548 bp, Homo sapiens
  misc_feature: GYAE6OF01CS7DO.6.19.B08.1.454.CMB.1.raw
  modified_base (540)..(540): a, c, t, g, unknown or other
  misc_feature (540)..(540): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccgagggaaacgccctaaactcctgatctatgatgcatcctactttgactaaaggtcgggtacccatacgaaggttcaggtggcaggtggtatcgtgggactagtatttcacttctaccacatcagctagtctgactaacctagtaacgtatttcgactaactttactaactgtaaccaacgagtacgttacgagttccgaccccgtcggtaccggttcggaccgaaagggaccgaagggtacggaaatacgaaacgacgtaggtacggtctacgacacctntcgttacg

SEQ ID NO: 287356 - DNA, 561 bp, Homo sapiens
  misc_feature: GYAE6OF01AUCVA.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccgagggaaagcccctaaaactcctgatctatgatgctatcctactttgactaaaggtcgggtcccatcaaggttcagtggcagtggatcgtgggactagtatttcactctcaccatcagcagtctacgacaacctgaagtattttcgactaactttactaactgtaccaacgagtacgttacagttccgccccgtacggtaccgttccggaccgaaacgggacccgaaagggtacggtaaaactaccgtaaaacggtaacgtacggtacggtaccgtacgtacccaacctagttcgttaccg

SEQ ID NO: 287357 - DNA, 534 bp, Homo sapiens
  misc_feature: GYAE6OF01BIGQP.6.19.B08.1.454.CMB.1.raw
  modified_base (252)..(252): a, c, t, g, unknown or other
  misc_feature (252)..(252): n is a, c, g, or t
  modified_base (525)..(525): a, c, t, g, unknown or other
  misc_feature (525)..(525): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcactatttaaatgtatcagganaatccagggaaacgcccctaaactcctgatctatgatgcatccatttgactaaaggtcgggtaccatcgaaggttcagtggcaggtggatcgtgggacagtatttcactctcaccatcagcagttctcgacctaaccgtagtaacgtattttacaccttaactttactacttgtaacaactagtagttacacgttccgaccccgtggtaccgttcggaccgaacgggaccgaaggtacggaatacgaaacgtactggacgtctacgactaccngtcgttacg

SEQ ID NO: 287358 - DNA, 553 bp, Homo sapiens
  misc_feature: GYAE6OF01BQRE3.6.19.B08.1.454.CMB.1.raw
  modified_base (254)..(254): a, c, t, g, unknown or other
  misc_feature (254)..(254): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcagganaatccgaaggaaacgcccctaaactcctagatctatgatgcatcctactttgactaaaggtcgggtacccagtcgaaggttcaggtcggacgaggtggatcgtagggacagtatttcactctcaccatcagcagtctgacctaacctagaagtattttagactaacttactactgtacaactagtacgttacgacgttccgccccgtacgggtaccgttccggaccgaacgggaaccgtaagggtacggtaaactacgaaacgaacgtggtacggtctacgacctacctagtcgttacg

SEQ ID NO: 287359 - DNA, 498 bp, Homo sapiens
  misc_feature: GYAE6OF01DIFHD.6.19.B08.1.454.CMB.1.raw
  modified_base (492)..(492): a, c, t, g, unknown or other
  misc_feature (492)..(492): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcactatttaaatggtatcagagaatccaagggaagcccctaaactcctgatctatgatgcatccatttgacaagtcgggccatcaaggttcagtgcagtggatcgtgggacagtatttcatctcaccatcagcagtctgaccaacctgaacgtattttgactaactttactactgtaccaactagtagttaacagttacgccctcggacgttccggaccaagggacaaggtagaaatcgaaacgaactgacgtctgaccacntcgtcg

SEQ ID NO: 287360 - DNA, 670 bp, Homo sapiens
  misc_feature: GYAE6OF01CZ6MW.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttggccgggacaagtcagagcattagactaccttatttaaattggtatcgaaggagaatccgaagggaaacgtacccctaaactcctagatactatgatgactatcctacgtttagacgtaaaggtcggggtaccctaagtacgtaaggttcgaggtggacgtaggtggtatacgtagggaactaggtactttccgtaccttcttaccaacctattacgacgacgtacgtactacgacctaaccgtagtaaacgttacgttttacgaccttaaactttacgtaacttacgttaacaacgtacgtaacgttacgtaacgtccgtaccccgttacgggtacccggttaccggtaacccggaaacggggtaaccgtaaacggggtaacggtaaaacgtaaccggtaaaacgtaaccggttaggtaccggtaccgttaccgacccgtaaccgtacgttccgttaccg

SEQ ID NO: 287361 - DNA, 513 bp, Homo sapiens
  misc_feature: GYAE6OF01AUMMM.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaaagcccctaaaactcctgatctatgatgcatccactttgcaaagtgggtccatcaaggttcagtggcagtggatcgtgggacagatttcactctcacatcagcagtctgacaactgaagtattttgactaacttactactagtacaactagagttacagtcgcccctcggaccgttcggaccgtaaagggacccaagggtacggaaatacgaaaacgacgtaggtgtaccgtgaccaccagtcgttacg

SEQ ID NO: 287362 - DNA, 587 bp, Homo sapiens
  misc_feature: GYAE6OF01B3ZVM.6.19.B08.1.454.CMB.1.raw
tcagatatcgcgagcacgaccggtgctcgatttagtgagtcagtaagggggagtcagtctcagtcaggacacagcatggacatgacgggtccccgctcagctccgtggggctcctgctactctggctccgaggtgccagatgtgacatccagatgacccagtctccatccctccctgtctgcatctgtaggacacagagtcaccatcacttggccgggcaagtcagagcattagcaccttatttaaatggtatcaggagaatccgaagggaaacgacccctaaactcctagatctatgatgcatcctactttgacgtaaaggtcgggtacccagtacgtaaggttcgaggtcggacgtaggtggtaatcgtagggactaggtactttccgacttctccaacctatcaagctagtctacgaccaaccgttagaagttattttcgaaccttaactttactactagtaccaatagtaacgttacacgttccgccccgtacggtaccggttccggaccgaaacgggaaccgtaagggtacgaaagtaccgaaaacggacgttaggacggtactacgaccacctagtctacg

SEQ ID NO: 287363 - DNA, 521 bp, Homo sapiens
  misc_feature: GYAE6OF01CGFPY.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcactattaatgtatcaggagaatccaggaagcccctaaatcctagatctatgatgcatccactttgactaaagtgggtacccatcaaggttcagtggcagtgatctagggacagatttcactctcacatcagcagtctagcaacctgaagtattttgactaactttactaactgtaccaactagagttacacgtcgaccccgtggtaccgtcggaccgaacgggaccaagggtacggaaattacgaaaacggtaacttaggtacggtcctagaccacctaagtccgttacg

SEQ ID NO: 287364 - DNA, 500 bp, Homo sapiens
  misc_feature: GYAE6OF01EJ8DT.6.19.B08.1.454.CMB.1.raw
  modified_base (493)..(493): a, c, t, g, unknown or other
  misc_feature (493)..(493): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccaggaaacgcccctaaactcctagatctatgatgcatccactttgacaaagtcgggtccatcaaggttcagtggcaggtgatctgggacagtatttcactctcaccatcagcagtctgaccaacctgaatattttgactaacttactactgtacaacagtagttacagtcgcccgtcggaccgttcggccgaagggaccaaggtagaaatacgaaacgacgtgaggtctgacacntcgtacg

SEQ ID NO: 287365 - DNA, 529 bp, Homo sapiens
  misc_feature: GYAE6OF01ELNAR.6.19.B08.1.454.CMB.1.raw
  modified_base (269)..(269): a, c, t, g, unknown or other
  misc_feature (269)..(269): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttggccgggcaagtcagagcattagcacctatttaaattggtatcaggagaatccagggaancccctaaactcctgatctatgatgcatccatttgacaaagtcgggtccatcaaggttcagtggcagtgatcgtgggacagtatttcactctacaccatcagctagtctgccaactgaagtattttcgactaacttactactgtacaacagagttaacagtcgcccctacgggtaccgttcggaccgaacgggaaccgtaaagggtacgtaaacgtaccgaaacgaacgttggtacggtactacgaccaccgtatcttacg

SEQ ID NO: 287366 - DNA, 570 bp, Homo sapiens
  misc_feature: GYAE6OF01CLO2H.6.19.B08.1.454.CMB.1.raw
  modified_base (400)..(400): a, c, t, g, unknown or other
  misc_feature (400)..(400): n is a, c, g, or t
  modified_base (433)..(433): a, c, t, g, unknown or other
  misc_feature (433)..(433): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcacatcacgttgccgggcaagtcagagcattagctaaccttaatttaaattggtatacgaaggagaaatccgaagggaaactccccctaaatcctagatctaatgatgactactcctatttgacgtaaaggtcgggtacctagtacgtaaggttcaggtgacgaggtggtatcgtgggaactagtacttcactctacactancgagctagttcagactaacgtgtaatcgtttanaccttaaactttatactacgtacaacgtgtaacgttacacggttcccgacccgttaggtaaccgtcggaaccggaaacgggtacgtaaggtacgaaataccgaaagtaccgtggacgtactacgaccactatcgtcg

SEQ ID NO: 287367 - DNA, 553 bp, Homo sapiens
  misc_feature: GYAE6OF01EAR5A.6.19.B08.1.454.CMB.1.raw
  modified_base (265)..(265): a, c, t, g, unknown or other
  misc_feature (265)..(265): n is a, c, g, or t
  modified_base (354)..(354): a, c, t, g, unknown or other
  misc_feature (354)..(354): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaatggtatcagagaatccaggaaacnccctaaatcctgatctatgatgcatcctactttgactaaaggtcggggtcccatactaaggttcagtggcaggtgatcgtgggacagtntttcacttctacacatcagcagtctagctaactgtaatctttagactaacttacctacttgtaacaacgagtaacgttaacgaggttccgaccccgttcgggtaccgttccgggaaccgaaacgggtaaccgaaagggttacgaaaagttaaccgaaaacggaacgttggacggtcctacggacccacctagttctccg

SEQ ID NO: 287368 - DNA, 516 bp, Homo sapiens
  misc_feature: GYAE6OF01DKPE2.6.19.B08.1.454.CMB.1.raw
  modified_base (506)..(506): a, c, t, g, unknown or other
  misc_feature (506)..(506): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggcaagtcagagcattagcacctatttaaattgtatcaggagaatcaggaacgccctaaactcctgatctatgatgcatccactttgacaagtcgggtaccagtcaaggttcagtggcagtggatcgtgggacagtatttcactctacaccatcagcagtctgccaactgaagtattttgacttaacttactactgtacaactaagtagttacacgtcgccccgtcggacgttccggacgaacgggacgaaggtacggaaatacgaaaacgaacttagtacggtactagaccacncttcgttacg

SEQ ID NO: 287369 - DNA, 526 bp, Homo sapiens
  misc_feature: GYAE6OF01BZL4G.6.19.B08.1.454.CMB.1.raw
  modified_base (271)..(271): a, c, t, g, unknown or other
  misc_feature (271)..(271): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (397)..(397): a, c, t, g, unknown or other
  misc_feature (397)..(397): n is a, c, g, or t
  modified_base (521)..(521): a, c, t, g, unknown or other
  misc_feature (521)..(521): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctaatttaaattggtatcaggagaatccaagggaaacncccctaaaactcctagatctatgatgcatccactttgacaaaggtcgggtaccatcaaggttcagtggcagtggatcgtagggacagtatttcactctcacatcancagtcngacaacctgaagtnttttacgactaacttactactgtacaactagtaacgttacacgtccgcccctacggaccgttccggaccgaaacgggacccgtaaggtacggaaatacaaacgactaggcgtactagacacctntcgtc

SEQ ID NO: 287370 - DNA, 516 bp, Homo sapiens
  misc_feature: GYAE6OF01CDBGL.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccggcaagtcagagcattagcacctatttaaattggtatcaggagaatccaggaaacgccctaaactcctgatctatgatgcatccactttgacaaagtcgggtaccatcaagttcagtggcagtggatcgtgggacagtatttcactctcaccatcagctagtctgaccaactgaagtatttgactaacttactactgtacaactagagttacacgtcgccccgtaggtaccgttcggaccgaacgggaaccgaagggtacgaaataccgaaacgaacgtggtacggtctagacctacagtcttacg

SEQ ID NO: 287371 - DNA, 725 bp, Homo sapiens
  misc_feature: GYAE6OF01BORU2.6.19.B08.1.454.CMB.1.raw
  modified_base (234)..(234): a, c, t, g, unknown or other
  misc_feature (234)..(234): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccggaggtgccagatgtgacatccagatcgaccctagtcctccactccctccctgtctgctatcgtggacgacacgagtacgtacaccatcctacgttcggcccggganaaggtcaaggacgtactaacgttacgacctaacctttaaattttaaacgttggtaactacggaaagggaacgtaaacgtaccggaaacggggaaaacctaacccccttaaaacttccgtagtaacttctaatcgtaatcgactactaccgtacgtttacgaacgtaaacgggttcgggtaccaagttacgtaacggttcgaggtggacgtaggtcggtacgtcggtagggtaactagttacttaccgtactacctacctaactactacgacgtactacgtctacgacctaaccgtagtaagtttacttacgaactttaaccttacttaacttacgtaactaaacgtacgtaacgttaccgtaccggtaccgtacccccgtagggtacccggtacggtaaccggaaaccggtaacggtaacgggtaacggtaaactaacggaaaacgttacggtacggtacggtaccgtacgaccctactacgttgttaccg

SEQ ID NO: 287372 - DNA, 554 bp, Homo sapiens
  misc_feature: GYAE6OF01A5HOP.6.19.B08.1.454.CMB.1.raw
  modified_base (256)..(256): a, c, t, g, unknown or other
  misc_feature (256)..(256): n is a, c, g, or t
  modified_base (271)..(271): a, c, t, g, unknown or other
  misc_feature (271)..(271): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcaccttaatttaaatggtatcagganaatccgagggaaacncccctaaactcctgatctatgatgcatcctactttagacgtaaaggtcgggtacccagtcgtaaaggttcaggtggcaggtggatcgtagggacagtatttcactctcaccatcagtcagtctcgacctaacgtgaagttattttcgacttaaacttactactgtaccaagtagtacgttacagttccgaccccgttaggaccgttccggaccaaacggggaaccaagggtacgaaactaacgaaacgtaacgtggtacggactacgaccacctagttcgtcg

SEQ ID NO: 287373 - DNA, 545 bp, Homo sapiens
  misc_feature: GYAE6OF01DHAQH.6.19.B08.1.454.CMB.1.raw
  modified_base (348)..(348): a, c, t, g, unknown or other
  misc_feature (348)..(348): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctattaaattggtatcaggagaatccgagggaaagcccctaaaatcctagatctatgatgctatccattttgctaaagtgggtccagtcaaggttcagtggcagtgatctggganagtatttcatctcacatcagcagtctgcaacctgaagtattttcgactaacttactactgttacaacagtaacgttacaggttcgaccccgtacgggaacgttccggaccgaaacgggaaccgtaagggtacggaaaacgttaccgaaacggtaaacgttcgtacgggtacctacggaccgaacctacttcgttacg

SEQ ID NO: 287374 - DNA, 503 bp, Homo sapiens
  misc_feature: GYAE6OF01C0KHV.6.19.B08.1.454.CMB.1.raw
  modified_base (223)..(223): a, c, t, g, unknown or other
  misc_feature (223)..(223): n is a, c, g, or t
  modified_base (254)..(254): a, c, t, g, unknown or other
  misc_feature (254)..(254): n is a, c, g, or t
  modified_base (497)..(497): a, c, t, g, unknown or other
  misc_feature (497)..(497): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagngcattagcacctatttaaatggtatcagganaatccaggaaagcccctaaaactcctgatctatgatgcatccactttgcaaagtgggtcccatcaagttcagtgcagtggatctgggacagtatttcactctcaccatcagcagtctgcaacctgaagtatttgactaacttactactgttacaactagtattacagtcgcccctggacgttccggaccagggacaacggtggaaatacgtaaacgaacgttgtacggcttagccaactcgtnttaccg

SEQ ID NO: 287375 - DNA, 592 bp, Homo sapiens
  misc_feature: GYAE6OF01ENY82.6.19.B08.1.454.CMB.1.raw
  modified_base (257)..(257): a, c, t, g, unknown or other
  misc_feature (257)..(257): n is a, c, g, or t
  modified_base (367)..(367): a, c, t, g, unknown or other
  misc_feature (367)..(367): n is a, c, g, or t
  modified_base (389)..(389): a, c, t, g, unknown or other
  misc_feature (389)..(389): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttcgccgggcaagtcagagcattagctacctatttaaattggtatcagganaataccgagggaaacgcccctaaactccgtagtatctatgatgctactcctactttgacgtaaaggtcgggtacccatcgtaaaggttcaggtgcgagtggatcgtgganagtattcactctcacatcagcngtctgacaccgtatagtatttcgacttaacttactactagtacaacgtacgacgttaccacgttccgtacccgttacggtaccggttaccggaacccggtaaacgggtaaaccgtaagggtaacggtaaaacgtaaccgtaaaacggtaaccgttagggtacgggtaccgttaccgtaacctaacccttagttctttacccgg

SEQ ID NO: 287376 - DNA, 629 bp, Homo sapiens
  misc_feature: GYAE6OF01BWRMJ.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaaccatcacttgccgggcaagtcagagcattagctaactatttaaatggtatcgaaggagaatccgaagggaaacgtaccccctaaacgtcctagattactatgatgactatcctatttgacgtaaaggtcgggtacccagttacgaaggtttcgaggtggacgaggtgagttcgtagggactagtactttcacttcgtacacctatacgacgcgtaagttcctagaaccaaccgttgtaaagttacgtttttacgaaccttaaactttaccgtacttacggtaacctaacgtagtaacgtttaaccacggttcccgtacccccgtaggtaccggttaccgaaccggtaacgggaaccgttaagggaacgaaacgtaaccgaaaaccgtacgttcggtacggtacgtacgaacctaaccctgttccgtacg

SEQ ID NO: 287377 - DNA, 605 bp, Homo sapiens
  misc_feature: GYAE6OF01B7KSQ.6.19.B08.1.454.CMB.1.raw
  modified_base (223)..(223): a, c, t, g, unknown or other
  misc_feature (223)..(223): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctcctgtctgcatctgtaggacacagagtcaccatcacttgccgggcaagtcagngcattagctacttatttaaattggtatcgaggagaataccgaagggaaacacccctaaactcctagatctatgatgcatcctatttgactaaacggtcgggtaccatcgaaggttcagtggcagtggatcgtaggcagtattcactctacacatcagctagtctagacctaaccgtgtaaagttacttttacgaccttaaactttacgtaaccttagtaaccaaacgtacgtaagtttaaccgacggttacccgaccccgttacgggtaaccgttccgggaacccgtaaacgggaaacccgtaaaggggtaacggtaaaacgtaaccgtaaaaaccgtaacgttaggtacggtacgtacgacctaaccgtagttccgttacg

SEQ ID NO: 287378 - DNA, 521 bp, Homo sapiens
  misc_feature: GYAE6OF01DNA9H.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggcaagtcagagcattagcacctatttaaattggtatcagagaatccagggaacgcccctaaactcctgatctatgatgcatccactttgcaaagtgggtcccatcaaggttcagtggcagtggatcgtgggacagtatttcactctcaccatcagtcgcctgcagttctagtaacgtactttgactaacttattactgttacaactagttattattacgttttccctttactacttttacggcctaacggggacctaaacgtaggtaagtaatacaaacgaactggtacgtctacgcaccatcgttacg

SEQ ID NO: 287379 - DNA, 688 bp, Homo sapiens
  misc_feature: GYAE6OF01BW3BX.6.19.B08.1.454.CMB.1.raw
tcagatatcgcgagcacgaccggtgctcgatttagtgagtcagtaaggggaggtcagtcgtcagtcaggacacagcatggacattgagggtccccgctcagctcctggggctccctgctactctggctccgaggtgccagatgtgtacatccagattgacccagtctccatcctcctgtctgcatctgtaggacacagagtcaccagtcacttgccgggcaagtcagagcattagcaccttatttaaattggtatcaggagaactccgagggaaacgcccctaaacgtccgtcgactactagtgatggactagtaccgtacgttttgacgtaaaagggttcggggttaccccaagttaccgtaaagggtttcgaaggttggtacgtaaggttggtaagttcgtagggtaacgtagtacttttccgaacgttaccgtaccgaaccctactccgtacgtaccgtacgtaccgtacgaccctaacccgtaggtaaagtaacttttacgacctttaaactttacgttacgtacgtaacctaacgtaagtaacgtttaccgacgttccggaccccgttaccgggtaacggttccggaaccgtaacgggtaaccggtaaacgggtaacggtaaacgtaaccggaaacgaacgttcggtacgtacgtaccgaccgtaaccctgttccgttaccgg

SEQ ID NO: 287380 - DNA, 608 bp, Homo sapiens
  misc_feature: GYAE6OF01B14EE.6.19.B08.1.454.CMB.1.raw
  modified_base (257)..(257): a, c, t, g, unknown or other
  misc_feature (257)..(257): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccggaggtgccagatgtgacatccagatgacccagtctccatccctccctgtctgcatctgtaggacacagatcaccatcacttggccggcaagtcagagcattagctactatttaaattggtatcagganaatccgaaggaaacgacccctaaactcctagactctatgatgctatcctatttagactaaaggtcgggtaccagtacgaaggttcagtggcaggtgatcgtagggactagtatttcacttctacactatacgagctagtcctacgactaaccctaggtaaacgttacgttttacgacctttaaacgttacttacgttagtaaccaaacgttacggtaacgtttaaccacggttccgtaacccccggtacggtaaccgttaccggaaccgtaacgggtaaccgtaacggtaacggtaaactaaccgaaacgtaacgttggtacgtacgtacgaaccctaactgttcgttacg

SEQ ID NO: 287381 - DNA, 564 bp, Homo sapiens
  misc_feature: GYAE6OF01EX0CP.6.19.B08.1.454.CMB.1.raw
  modified_base (256)..(256): a, c, t, g, unknown or other
  misc_feature (256)..(256): n is a, c, g, or t
  modified_base (421)..(421): a, c, t, g, unknown or other
  misc_feature (421)..(421): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcacctatttaaattggtatcagganaatccgaagggaaacgcccctaaactcctagatctatgatgctatcctacttttgactaaaagggttcggggtaccctagtacgtaaagggttcaaggtggctaggtggatcgtgggacagtatttcacttctacaccatcagcagtctagtaacctgtaagttntttgactaactttactactgtacaatagtagttacagtccgtccccgtcggtacgttccggacgaaacgggtacctaagggtaggtaaactaacgaaacggtaacgttggacggtactcgacctaacctacttccgtgttacc

SEQ ID NO: 287382 - DNA, 573 bp, Homo sapiens
  misc_feature: GYAE6OF01EAHAG.6.19.B08.1.454.CMB.1.raw
  modified_base (213)..(213): a, c, t, g, unknown or other
  misc_feature (213)..(213): n is a, c, g, or t
  modified_base (335)..(335): a, c, t, g, unknown or other
  misc_feature (335)..(335): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctcctgtctgcatctgtaggacacagatcaccatcacttgccggnaagtcagagcattagcacctatttaaattggtatcaggagaatccgaaggaaacgacccctaaactcctgatctatgatgctatcctacttgacgtaaggtcgggtaccagtacgaaggttnacggtggctaggtggatcgtagggactagtatttcactctactaccatacagctagtctgacctaacctagtaacgttattttcgacttaacttactactacgtaacaacgtagtacgttaactacggtccgtacccgtaccggtacgttccggaccgtaaacgggaaccgtaacgggtaacggtaaacgtaacgaaacgtaacgtaggtacggtactacgaccacctagtcgttacg

SEQ ID NO: 287383 - DNA, 541 bp, Homo sapiens
  misc_feature: GYAE6OF01DGRDU.6.19.B08.1.454.CMB.1.raw
  modified_base (215)..(215): a, c, t, g, unknown or other
  misc_feature (215)..(215): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggnaagtcagagcattagcacctatttaaatggtatcaggagaatccgaagggaacgcccctaaactcctgatctatgatgcatcctactttgacaaaggtcggggtacccagtcgaaaggttcagtggcgaggtggatcgtgggacagtatttcacttctacaccatcagcagtctgccaacgtgaagtattttagactaactttactacttgtacaacagtacgttacagtcgtccccgtacggtaccgttccggaccgaacgggacccaaagggtacggaaattcgaaaacggaacgtggtacggtctagaccaccgattcttacg

SEQ ID NO: 287384 - DNA, 594 bp, Homo sapiens
  misc_feature: GYAE6OF01DDNHF.6.19.B08.1.454.CMB.1.raw
  modified_base (583)..(583): a, c, t, g, unknown or other
  misc_feature (583)..(583): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcaattagcaccttattaaattggtatcaggagaatccagggaacgacccctaaactcctgatctatgatgctactcctactttgacgtaaaggtcgggtaccctagtacgtaaagggtttcacggtgggcaggtggagtcgtagggactagtactttcgactctaccacctactcaacgctagtctacgacctaaccgtagtaacgttagttttcgaccttaaactttactactcgtaacaacgtagtacgttacacggttcgccccgtacgggtaccgttaccggaccggaaacgggaaccgtaagggtaacggaaacgtacgaaacggaacgtggtacggtacgtacgcctaaccngttccgttacg

SEQ ID NO: 287385 - DNA, 500 bp, Homo sapiens
  misc_feature: GYAE6OF01CGJPF.6.19.B08.1.454.CMB.1.raw
  modified_base (383)..(383): a, c, t, g, unknown or other
  misc_feature (383)..(383): n is a, c, g, or t
  modified_base (494)..(494): a, c, t, g, unknown or other
  misc_feature (494)..(494): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaatcctgatctatgatgcatccactttgcaaagtgggtcccatcaaggttcagtgcagtgatctgggacagatttcactctcaccatcagcagtctgcaacctgaagtnttttgactaacttactactgtacaacagtaagttacagttcgcccctcggtaccgttcggaccgaagggaccaaggtggaaatacgaaacgaactgtacggtctagacacntctacg

SEQ ID NO: 287386 - DNA, 637 bp, Homo sapiens
  misc_feature: GYAE6OF01BPTK8.6.19.B08.1.454.CMB.1.raw
  modified_base (456)..(456): a, c, t, g, unknown or other
  misc_feature (456)..(456): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatcgacccagtctccatcctccctgtctgcatctgtaggacacagagtcacatcacttcggccgggacaagtcagagctattagactaacttaattttaaaattgggtaatcgaagggaagtaactaccgaaggggaaaacaccccctaaaactcctagtattactatgatgctatccatttcgacgtaaaggtcgggtaccaagtacgaaggttacaggtcggacgtaggtacggagtacgtagggaactagtatttcgacttctacacctaatccaagtcattcacgactaactaggaacttntttacgacttaaacttactaacgtcgttaacaaagtacggtaacgttaccgaacggtcccgtaccccgttaggaaccggtttaccgggaaccggaaacggggtaaccgtaaaggggtaacggtaaaacaacggtaaaaccggtagtaacggttcggaacgttcgaaccactactcgttacg

SEQ ID NO: 287387 - DNA, 499 bp, Homo sapiens
  misc_feature: GYAE6OF01B4ARL.6.19.B08.1.454.CMB.1.raw
  modified_base (388)..(388): a, c, t, g, unknown or other
  misc_feature (388)..(388): n is a, c, g, or t
  modified_base (493)..(493): a, c, t, g, unknown or other
  misc_feature (493)..(493): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcacctatttaaattggtatcaggagaatccgagggaaacgcccctaaactcctgatctatgatgcatccactttgcaaagtgggtccatcaaggtcagtggcagtgatcgtgggacagtatttcactctcaccatcagcagtctgacaactgaagtnttttgactaacttactactgtacaacagtagttacagtcgcccgtcggacgttcggaccgaaggaccgaaggtaggaatacgaaacgacgtgtaggctgacaccntcgtcg

SEQ ID NO: 287388 - DNA, 530 bp, Homo sapiens
  misc_feature: GYAE6OF01C3L9Z.6.19.B08.1.454.CMB.1.raw
  modified_base (270)..(270): a, c, t, g, unknown or other
  misc_feature (270)..(270): n is a, c, g, or t
  modified_base (385)..(385): a, c, t, g, unknown or other
  misc_feature (385)..(385): n is a, c, g, or t
  modified_base (395)..(395): a, c, t, g, unknown or other
  misc_feature (395)..(395): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcacatcacttgccgggcaagtcagagcattagctacttatttaaattggtatcaggagaatccgaagggaacnccctaaactcctgactctatgatgacatccatttgacaaaggtgggtacccagtacgaaggttcaggtggcaggtgatcgtagggactagtattcactctacacatcagctatcnacactgaatntttcgactaacttactacttacgtacaaacgtagtacgttacacgtccgtaccccgtcggtaaccgttcggaaccgaacgggaaccggtaaggtacggaaatacgaaacgacgtgcgtacacgacacatcgtacg

SEQ ID NO: 287389 - DNA, 554 bp, Homo sapiens
  misc_feature: GYAE6OF01B2CTD.6.19.B08.1.454.CMB.1.raw
  modified_base (269)..(269): a, c, t, g, unknown or other
  misc_feature (269)..(269): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacncccctaaactcctgatctatgatgcatccatttgcaaaggtcgggtcccatcaaggttcagtggcagtggatcgtgggacagatttcactctcaccatcagcagtctgacctaacctagtaagtattttacgactaaactttactacctgtaccaaacagtaacgttaacaggtccgccccgtacggtaccgttcgggaccgtaaacggggaccgtaaagggtacggaaatacgaaaaccggtaacgtaggttacgggacttacggaccaccctagttcgttacg

SEQ ID NO: 287390 - DNA, 567 bp, Homo sapiens
  misc_feature: GYAE6OF01BZ5IE.6.19.B08.1.454.CMB.1.raw
  modified_base (214)..(214): a, c, t, g, unknown or other
  misc_feature (214)..(214): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggnaagtcagagcattagcacctatttaaattggtatcaggagaatccaagggaaacgcccctaaaatcctagatctatgatgcatccactttgactaaaggtcgggtaccatacgaaggttcagtggcaagtggatcgtgggacagtatttcactctcacatcagcagtctgacaacctagaagtattttgactaacttactactgtacaactagtacgttacacgtccgaccccgttacgggtaccgttaccgggaccgaaacgggtacccgtaaaggggtaacggtaaaacgtaccggtaaaaccggaacgttaggtacgggaccttcggaacccacccgtaatccgtttacg

SEQ ID NO: 287391 - DNA, 747 bp, Homo sapiens
  misc_feature: GYAE6OF01D0O3H.6.19.B08.1.454.CMB.1.raw
  modified_base (216)..(216): a, c, t, g, unknown or other
  misc_feature (216)..(216): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcacatcacgttgccgggnaagtcagagctattagctaccttaatttaatggtatcgaggagaatccgaagggaaactacccctaaatcctagatctatgatgactatccctacgtttacgaacgtaaacggtcgggttacccaagttaccggtaaaggttacgtaaggtcgggtacgtaagggttacggtaacgttaccggtacggggtaactaaggtttaccttttaccgaacctttccgtaccctaaacctaacgttccgaacggttaccgtaacggttacccgtacggtaacccgttaaaccgttaaggttaaacgtttacgtttttaaaccgaacctttaaacgttttaacctaaccgttacgtaaccgtaaacgtaggttaacgttaaaccgtcgggttacccgaccccggttacgggtaaccgttaccgggaacccggtaaaacggggtaaccgtaaaacggggtacgtaaaacgtaaccgtaaaaccgggtacgtagggtaccggtacgtaccggaacctaaccttaccgttcgttaacccg

SEQ ID NO: 287392 - DNA, 594 bp, Homo sapiens
  misc_feature: GYAE6OF01D14MR.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtagacacagagtcaccatcacttgccgggcaagtcagagcattagctacctaatttaaattggtatcgaggagaactaccgaagggaaacgacccctaaactcctagtactctatgatcgactactcctactttgacgtaaacggttcggggtacccagtacgtaaggttcaggtcggacgtaggtggatcgtagggactagtactttcaccgttcctaccacctatacacgtacgtacgtctcgacctaacctaggtaagttacttttacgaccttaactttacttacgtacgtacaacgtagtacgttactacgtcgtcccgtacggtaccgttcggaccgtaacggacgtaaggtacggaaatacgaaacgtacgtagtacggtactacgacctacctgtcgttacg

SEQ ID NO: 287393 - DNA, 533 bp, Homo sapiens
  misc_feature: GYAE6OF01CBTWT.6.19.B08.1.454.CMB.1.raw
  modified_base (269)..(269): a, c, t, g, unknown or other
  misc_feature (269)..(269): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccgagggaaacncccctaaactcctgatctatgatgcatccactttgactaaaggtcgggtaccctagtacgtaaggttcaggtggctaggtggatcgtagggacagtatttcactctacaccatcagcagtctagacctaacctgtaatatttacgactaacttactactgtacaacagtagttacacgttcgccccgtcggaccgttcggaccgaacgggaccgtaagggtacggaaacaacggaacgtagtagcgtcgacaccactgtcgttc

SEQ ID NO: 287394 - DNA, 677 bp, Homo sapiens
  misc_feature: GYAE6OF01EU3CP.6.19.B08.1.454.CMB.1.raw
  modified_base (216)..(216): a, c, t, g, unknown or other
  misc_feature (216)..(216): n is a, c, g, or t
  modified_base (275)..(275): a, c, t, g, unknown or other
  misc_feature (275)..(275): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggnaagtcagagctattagctaccttatttaaattggtatcaggagaatccgaagggaaacncccctaaactcctgtactctatgatgcatcctactttgacctaaaggtcgggtacccagtacgtaaggttcaaggtggactaggtggatcgtagggaactagtacttttcacttcctaccacctatcagctacgtctacgacctaaccgtaggtaaacgttacttttacgaaccttaaactttaacctacgttacgtaaccaaacgtaacggttaacgttaaccgtacggttacccgtaccccggttaccgggtaaccggtttaccgggaaaccccggtaaacggggaaacccggttaaacggggtaacgggtaaaaacgttaacccggaaaaaccggttaaccgttagggtacgggtaccgttaaccggaacccgtaacccggtattccggtttaacccgg

SEQ ID NO: 287395 - DNA, 560 bp, Homo sapiens
  misc_feature: GYAE6OF01CG7Y7.6.19.B08.1.454.CMB.1.raw
  modified_base (214)..(214): a, c, t, g, unknown or other
  misc_feature (214)..(214): n is a, c, g, or t
  modified_base (250)..(250): a, c, t, g, unknown or other
  misc_feature (250)..(250): n is a, c, g, or t
  modified_base (264)..(264): a, c, t, g, unknown or other
  misc_feature (264)..(264): n is a, c, g, or t
  modified_base (407)..(407): a, c, t, g, unknown or other
  misc_feature (407)..(407): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcacatcacttgccgggnaagtcagagcattagcactattaatggtatcagganaatccagggaaacncccctaaatcctagatctatgatgactatcctatttgacgtaaaggtcgggtacccagtacgaaaggttcaggtggctaggtggatcgtagggactagtattcactctacactatcagctagtctagacaaccgtgtaagttnttttacgactaactttatacttacgtacaaacgtagtaacgttacacggttccgtaccccgtcgggtaaccgttcggaccgaaagggtaccgtaaagggtacgaaactacgaaaacgtacgttaggtacggctagaccacctagttcgttacg

SEQ ID NO: 287396 - DNA, 541 bp, Homo sapiens
  misc_feature: GYAE6OF01BTD55.6.19.B08.1.454.CMB.1.raw
  modified_base (389)..(389): a, c, t, g, unknown or other
  misc_feature (389)..(389): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgacaaagtgggtcccatcgaaggttcagtgcagtggatcgtgggacagtatttcactctcaccatcagcagtctgcaacctgaagtnttttacgactaactttactactgtacaacgtagtacgttacacgttcgcccccgttacgggtaccgttccggaccgaaacggggacccaaagggtacggaaataccgaaaccgtaacgtggtacggtacctacgaccaccgtattcgttacg

SEQ ID NO: 287397 - DNA, 645 bp, Homo sapiens
  misc_feature: GYAE6OF01DBFM2.6.19.B08.1.454.CMB.1.raw
  modified_base (267)..(267): a, c, t, g, unknown or other
  misc_feature (267)..(267): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagacgtcaccatcacttcggccgggacaagtcaggagctaattagctaacttatttaaagttggtatcgagganaataccgaagggaaactacccctaaactcctagatctatgatcgctactacctacgtttagaacgtaaacgggttcgggtcctaagttacgtaaagggttcaggttcggacgtaggtaggtattcggtacgggaactaggttacttttccacgttacctaccaactaactcgaagtcgtacgtcgtacgactaaccgtaggtaagttacttttacgacttaaactttactacgtacgtaaccaaacgtacggttaacgttacgacgttccgtaccccgttagggtaccggttaccggaacgaaaccggggtaacgaagggtaacgaaacgtaacgaaacgtacgtgggtacgtacgtacgacctaactgtccgttacg

SEQ ID NO: 287398 - DNA, 571 bp, Homo sapiens
  misc_feature: GYAE6OF01A5RGJ.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacgccctaaactcctgatctatgatgcactcctactttgactaaaggtcgggtaccatcaaggttcaagtggcgagtggatcgtagggactagtatttcactctacaccatcagctagtctcgacctaacctagtaaagtattttcgactaactttactaacttacgtacaaactagtaacgttacgtacgttcgtaccccgtaccggtaccggttccggaccgaaacgggtaaccgtaagggtacggtaaacgtaacgaaacgtaaccgtaggtacggtactacgacctacctagttcgttacg

SEQ ID NO: 287399 - DNA, 542 bp, Homo sapiens
  misc_feature: GYAE6OF01AXOXN.6.19.B08.1.454.CMB.1.raw
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (415)..(415): a, c, t, g, unknown or other
  misc_feature (415)..(415): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctcctgtctgcatctgtaggacacagagtcaccatcacttgccggcaagtcagagcattagcacctaatttaaatgtatcagganaatccgaagggaaacncccctaaactcctagatactatgatgcactcctactttgacgtaaaggtcggggtaccctagtaccgtaaggttcaaggtggacgtaggtggatcgtagggactagtactttcactctacacatcagcagtctgacaacctgtaatntttacgactaacttactactgtacaacgagtagttacagtcgaccctaggtacgtcggacgaacgggaccgtaaagggtacgtaaagtacgaaacgacgtagtacggtactacgacactagtctacg

SEQ ID NO: 287400 - DNA, 563 bp, Homo sapiens
  misc_feature: GYAE6OF01ACVU0.6.19.B08.1.454.CMB.1.raw
  modified_base (272)..(272): a, c, t, g, unknown or other
  misc_feature (272)..(272): n is a, c, g, or t
  modified_base (401)..(401): a, c, t, g, unknown or other
  misc_feature (401)..(401): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgaccccagtctccatcctccctgtctgcatctgtaggacacagagtcaccatcacttgccgggcaagtcagagcattagcaccttatttaaattggtatcaggagaatccaagggaaacncccctaaactcctgatctatgatgcatccactttgacaaggtcgggtccatcgaaggttcaggtgacgagtggatcgtgggacagtatttacactctcaccatcacgcagtctgacctaactgtaagtntttacgactaacttactactcgtacaactagtaagttacacggttctccccggtacggtaccggttaccggacccgtaaacgggtaccgaaacgggttacggaaattaaccgaaacggtaccgttaggtacgggtcctacggacaacccgtattcgttaccg

SEQ ID NO: 287401 - DNA, 629 bp, Homo sapiens
  misc_feature: GYAE6OF01AI68H.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttggccgggcaagtcagagcattagctaccttatttaaattggtatcgaggagaactaccgaagggaaacgcccctaaactcctgactctatgatgctatcctactttgactaaggtcggttacccatacgtaaggttcaggtggacgtaggtggtatcgtagggactagtactttcactctacaccatcagctagtctcgacctaacgtagtaagttacttttacgacttaacttactacgttcgtaacctaaacgtagtaacgttacgaccgttccgacccccggttacgggtaacccggttccgggaacccggtaaacgggtaacccggtaaaggggtaaccggtaaaacgtaaccggaaaaccggtaacgttacgggtacggtaacccgtacggtaacccaaccgttcgttccgttccg

SEQ ID NO: 287402 - DNA, 571 bp, Homo sapiens
  misc_feature: GYAE6OF01BTNBE.6.19.B08.1.454.CMB.1.raw
  modified_base (215)..(215): a, c, t, g, unknown or other
  misc_feature (215)..(215): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggnaagtcagagcattagcacctatttaaattggtatcaggagaatccgaagggaaacgcccctaaactcctagatctatgatgcatccactttgactaaaggtcgggtacccagtacgtaaggttcaggtggacaggtggatcgtgggactagtatttcactctcaccatcagctagtctagccaacctagtaaatattttacgaccttaaactttacctacttcgtaactaaacgtagtagttaacacgttcgtaccccgtacggtacgttaccggaccgtaaacgggaccgaaagggtacggtaaataccgaaaacggtaacgttaggtacggtctacgaccaacctgtcgttacg

SEQ ID NO: 287403 - DNA, 687 bp, Homo sapiens
  misc_feature: GYAE6OF01BJI9X.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtctccatcctcctgtctgcatctgtaggacacagagtcaccatcacgttggccggacaagtcagagactatttacgctaacctttaattttaaaagttggtaactcgaaggaagtaactccgaaggggaaacgtacccccttaaaatccgtagacttacgtaagtgaactggtacctagttacctacgttttgaacgttaaaggtcgggtaccctaagttaccgtaaggttcgaggtggacgtaaggtcggactcggtacgggactagtactttaccacgttcctaaccaacctagtacctaacggtacctaggttcctacggtaaccttaacccgttaggtaaacgtttacgttttacgaacctttaaacgtttacctacgttagtaacccaagttaacggtacgtttaaccgtagttacccggccccgttagggaaccgtcggaccggaaacgggtacgaacgggttagtaaaccgtacggtaaacgtagttcggaggtacctacggaacctctaaggttctcgg

SEQ ID NO: 287404 - DNA, 507 bp, Homo sapiens
  misc_feature: GYAE6OF01AOXOD.6.19.B08.1.454.CMB.1.raw
  modified_base (424)..(424): a, c, t, g, unknown or other
  misc_feature (424)..(424): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaactcctgatctatgatgcatccactttgcaaagtgggtccatcaaggttcagtgcagtggatcgtgggacagatttcactctcaccatcagcagtctgcaacctgaagtatttgactaacttactactgtcaacagtagttacagtcnccccgtcggaccgttcggccgaaagggaccgaagggtcggaaatacgaaacggaactggtacggactggacaccattcgtacg

SEQ ID NO: 287405 - DNA, 519 bp, Homo sapiens
  misc_feature: GYAE6OF01C18RQ.6.19.B08.1.454.CMB.1.raw
  modified_base (223)..(223): a, c, t, g, unknown or other
  misc_feature (223)..(223): n is a, c, g, or t
  modified_base (514)..(514): a, c, t, g, unknown or other
  misc_feature (514)..(514): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagngcattagcactatttaaattggtatcaggagaatccagggaaacgcccctaaactcctagatctatgatgcatccatttgacaaagtgggtacccatcaaggttcagtggcagtggatcgtagggactagtatttcactctcaccatcaagcagtctgactaactgaagtatttgactaacttactactgtacaactagtacgttacagttccgaccccgttggtaccgttccggaccgaaagggaccgaagggtacgaaataccgaaacgtacgtgtgactagacacctntctcg

SEQ ID NO: 287406 - DNA, 555 bp, Homo sapiens
  misc_feature: GYAE6OF01E5HNH.6.19.B08.1.454.CMB.1.raw
  modified_base (268)..(268): a, c, t, g, unknown or other
  misc_feature (268)..(268): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaaacncccctaaactcctgatctatgatgcatccactttgactaaaggtcgggtcccatcgaaaggttcagtggcaggtggatcgtgggacagtatttcactctcaccatcagcagtctgacaacctgaagtattttagactaaactttactactagtaccaaactagtacgtttacgtacgtcgtcccccgttacgggtaccgttcgggacccgtaaagggacccgtaaagggtacggaaaactacgtaaaacgtaacgtggtaggtcctaggacctaccacgttcttacg

SEQ ID NO: 287407 - DNA, 711 bp, Homo sapiens
  misc_feature: GYAE6OF01EVK3Q.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagctattagcacctaatttaaattggtatcaggagaataccgaagggaaacgcccaaactcctagactcgtaatcgaatgacataccctacttttcgactaaacggtcgggtacccaagttaccgaaaggtttccaaggttggacgtaggtcggtattccgtaggggaactaggtaacttttaccgaactttcctacctaacccattaccgaacggtcctaacggttcctacgaaacccttaaccgttaggaaacgtttagttttacggaacctttaaacccgtttaacctaaccgttacgtaacctaaacgtacggtaaacgtttaaaccgaggtttacccgtacccccgttacgggtaacccgtttaccgggaacccgtaaaacggggaaccccgaaagggtttacggaaaaacgttaccggaaaaaccggttaacgtaacgggttacggtaccgttacgggacctaacccgtaagtaccgttacgg

SEQ ID NO: 287408 - DNA, 562 bp, Homo sapiens
  misc_feature: GYAE6OF01EXXYE.6.19.B08.1.454.CMB.1.raw
  modified_base (256)..(256): a, c, t, g, unknown or other
  misc_feature (256)..(256): n is a, c, g, or t
  modified_base (271)..(271): a, c, t, g, unknown or other
  misc_feature (271)..(271): n is a, c, g, or t
  modified_base (359)..(359): a, c, t, g, unknown or other
  misc_feature (359)..(359): n is a, c, g, or t
  modified_base (415)..(415): a, c, t, g, unknown or other
  misc_feature (415)..(415): n is a, c, g, or t
  modified_base (553)..(553): a, c, t, g, unknown or other
  misc_feature (553)..(553): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcaccttatttaaatggtatcagganaatccgagggaaacncccctaaatcctgatctatgatgacatcctatttgacgtaaaggttcgggtaccctaatcgaaggttcaggtggctaggtggattcgngggaacagtatttcactctacaccatcagtcagtctagacctaaccgtgaaagttnttttagacctaaactttactacttgtaccaaagtagtagttacacgttccgccccgttagggaccgttcggacccgaaagggaccgtaagggtacgaaactacgaaaaccggtacgtggtacggtctacgaccacctntccgttacg

SEQ ID NO: 287409 - DNA, 635 bp, Homo sapiens
  misc_feature: GYAE6OF01C3R7X.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctggtaggacacagagtcaccatcacttcggccgggcaagtcagagctattagctacttatttaaattggtaatcaggagaatccgaagggaaacacccctaaacgtcctagatctatgatgcactccactttgacgtaaaggtcggggtacccagttacgaaagggttcaggttggacgtaggtggattcgtagggtacagttactttaccgtactccttaccaacctatactacgtctacggtcttacggacctaaccgttaggtaaattacgtttttacgaccttaaacgtttactactacgttaacctaacgtaacgtaagttaccgacgttccgtaccccgtacgggtaccgttcggaccgaacgggtaaccgaagggtaacggaaacgtaacgtaaaccggtaacgttacggtcggtacgttacgacctaacgtacgtcgtttaccg

SEQ ID NO: 287410 - DNA, 518 bp, Homo sapiens
  misc_feature: GYAE6OF01EKR6S.6.19.B08.1.454.CMB.1.raw
  modified_base (264)..(264): a, c, t, g, unknown or other
  misc_feature (264)..(264): n is a, c, g, or t
  modified_base (344)..(344): a, c, t, g, unknown or other
  misc_feature (344)..(344): n is a, c, g, or t
  modified_base (510)..(510): a, c, t, g, unknown or other
  misc_feature (510)..(510): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctcctgtctgcatctgtaggacacagagtcaccatcacttgccgggcaagtcagagcattagcacctatttaaatggtatcaggagaatccaggaanccctaaactcctgatctatgatgcatccactttgcaaagtcgggtccatcaaggttcagtgcagtgatcgtgggacagtnttcactctacaccatcagcagtctgaccactagtaagtcttttagactaacttactactgtacaacgtagtagttactagtcgtccctacgggtacgttcggaccgaacgggacctaagggtacgaaagtacgaaacgacgtacggtggtacgtcgacctaccgtntcgttacg

SEQ ID NO: 287411 - DNA, 863 bp, Homo sapiens
  misc_feature: GYAE6OF01DAJHM.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacgttgccgggcaagtcagagcattagcacctatttaatggtatacaggagaatccgaaggaacgtacccctaaacgtcctagtactactatacgtatcgactatccctacttttcggaaccgtaaaagggttccgggggttacccctaaagttaccggtaaaacgggtttcccgtaaaggttggggtaccgtaagggtagggtaacttaccgggttagggggaaccttaaggttaacgttttacccgtaacctttccttacccaaaccctaacgttacccaacgggtacccgttaacggttaccgtaccgtaacccgtaaacccgttaaggtaaaacggtttaacctttttttaacggaaccctttaaaacccttttaaccgttaaccgtttaacggtttaaacccgtaaaaccgtaacggtttaaaccggtttaaacccgtaacgggttacccccgggttacccccgttaccgggggttaaacccgggttttaccccgggaaaccccgggaaaacccgggggtaaaccccggttaaaagggggttaaaccggtaaaaacggttaaacccggaaaaacccggtaaaccgggtttagggttaccggtacccggtttacggaacccgtaaaccccgttacgttcccgttttaacccggg

SEQ ID NO: 287412 - DNA, 590 bp, Homo sapiens
  misc_feature: GYAE6OF01CUYI4.6.19.B08.1.454.CMB.1.raw
  modified_base (421)..(421): a, c, t, g, unknown or other
  misc_feature (421)..(421): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagctaaccttatttaaattggtatcaggagaataccgaagggaaacgcccctaaaactcctagatctatgatgctactcctactttgacgtaaaggtcgggtacccagtacgaaggttcaggtggctaggtggtatcgtagggactagtactttcacttctacaccatcagcagtctgactactagaagttntttgacctaacttactactgtaaccaacgtagtacgttacacggttccgaccccgtcgggtaccggttaccggacccgtaaacggggtaccgtaaaggggtaacgaaactaaccggaaaacgtacgttacggtcggtacgttaccgacctaacccgtgttccgttaccg

SEQ ID NO: 287413 - DNA, 655 bp, Homo sapiens
  misc_feature: GYAE6OF01D9N7X.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatcgacccagtctccatccctccctgtctgcatcgtgtaggacacagagtccaccatcacttcggccggacaagtcaggagactagtacgacctaacttaatttaaagttggtatacgaaggaagaacgtaccgaacggaaaccgtacccctaaactccgtagacttcatgatacgacctatacctagttacgaacgtaacgggtcggtacctagtacgtacggtacgtaggtcggagtaggtcgtagttcggtacggatagttacttacacgttcaccacctagtcgagtacgtacgctacgaaccgtacgtaagttaacgttatttaccgaactttaacttactaacgttacgtaacaaagtacgttaacgttacccgtacggttccccggtacccggtacggtaccgtaccgggaacggtaaaccgggtaacgtaaggtaaaccgaaagtaaccgtaaacgtacggtagacgtcaccgtacctacgttagttcgttaaccg

SEQ ID NO: 287414 - DNA, 653 bp, Homo sapiens
  misc_feature: GYAE6OF01CUYU2.6.19.B08.1.454.CMB.1.raw
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggnaagtcagngcattagcaaccttaatttaaattggtatcaaggagaataccgaagggaaacacccctaaaactcctgatctatagatgactactcctactttagacgtaaaggtcgggtacccatacgaaggttcaggtggcgagtggtactcgtagggactagtactttcacttactacacctatcagctagtctacgacctaaccgtgtaaagttacttttacgaaccttaaactttaccttaacttacgttaacctaaacgtaaggttaacgttaccgtaacggttcccgtacccccgttacgggtaacccggttaccggaaccgggtaaaccggggtacccgtaaaggggttaaacggaaaacgttaacccggaaaaaccggtaacggttacggtacgggtaaccgtcggaccctaaccgtagttccgttaccgg

SEQ ID NO: 287415 - DNA, 565 bp, Homo sapiens
  misc_feature: GYAE6OF01CSCCT.6.19.B08.1.454.CMB.1.raw
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctcctgtctgcatctgtaggacacagagtcaccatcacttgccggganaagtcagngcattagcactattaaattggtatcagganaatccgagggaaacncccctaaaactcctagatctatgatgcatccctactttcgacgtaaaggtcggggtacccagtacgtaaaggtttcaaggttggctaggtggtatcgtagggactagtatttcactctcacatcagcagtctgaccaacgtagtaagtattttcgactaacttactactagtacaactagtacgttacacgttccgccccgtacggtacggttccggaccggaaacgggtaccgaagggtaacggaaactaacgtaaacgtaacgttggtacggtactacgacctactgtcgttacg

SEQ ID NO: 287416 - DNA, 546 bp, Homo sapiens
  misc_feature: GYAE6OF01DLMZG.6.19.B08.1.454.CMB.1.raw
  modified_base (255)..(255): a, c, t, g, unknown or other
  misc_feature (255)..(255): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcagganaatccagggaagccctaaactcctgatctatgatgcatccactttgcaaagtgggtccatcaagttcagtggcaggtggatctgggacagtatttcgactctcaccatcaagctagtctagccaacctgaagtattttgacctaaacttactactgtacaactagtagttacagtcgtacccccgtggtaccggttccggtacgaaacgggtaaccaaacggggtaaggaaacgttacgaaaccggtaaacgttgtacgggtaccttaggacctaaccctagttcttaccg

SEQ ID NO: 287417 - DNA, 549 bp, Homo sapiens
  misc_feature: GYAE6OF01EVKT1.6.19.B08.1.454.CMB.1.raw
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
tcagatatcgcgagcacgaccggtgctcgatttagtgagtcagtaagggggagtcagtctcagtcaggacacagcatggacatgagggtccccgctcagctcctggggcctcctgctactctggctccgaggtgccagatgtgacatccagatgacccagtctccatcctcctgtctgcatctgtaggacacagagtcaccatcacttgccggcaagtcagagcattagcactatttaatgtatnagganaatcaggaaacgccctaactcctagatctatgatgctatccactttgactaaaggtcgggtaccagtcgaaggttcagtggcagtggatcgtaggacagtacttcactctacaccatcagctagtctacgaccaaccgtagaagtattttagacctaaactttactactagtacaacgagtacgttactaggtccgtaccccgtacggtaccgttcggaaccgtaaacgggaaccgtaaacgggtaggaaaagtaccgaaacggaacgtcggtacggtactagaccacctagtcttacg

SEQ ID NO: 287418 - DNA, 525 bp, Homo sapiens
  misc_feature: GYAE6OF01BCDFU.6.19.B08.1.454.CMB.1.raw
  modified_base (253)..(253): a, c, t, g, unknown or other
  misc_feature (253)..(253): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcactatttaaatggtatcagganaatccagggaaacgcccctaaatcctgatctatgatgcatcctactttgacaaagtcgggtccatcaaggttcagtggcagtgatcgtgggacagtatttcactctcaccatcagcagtctgacaacctgaagtattttacgactaacttactactgtacaacagtagttacagtcgccccgtcggtaccgttcggaccgaaacgggaccgtaaagggtacggaaatacgaaaacgtaacgtggtacggtctacgaccacctagtcgttacg

SEQ ID NO: 287419 - DNA, 704 bp, Homo sapiens
  misc_feature: GYAE6OF01D819D.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagacgtccaaccatcacgttcggccgggacaagtcagagcattagctaaccttaattttaaattggtactacgaaggaagaactaccgaagggaaacgtacccctaaactccgtagactctatagatcgctactcctactttacgactaaggtcgggtacctaagtacgtaaggttcaggtggacaggggtgatcgtaggactagtacttcacttctaccaacctatcgacgtctacgtcgtacgacctaaccgttaggtaaacgtttcttttacgaacctttaaaccgtttaacttaaccgtaggtaaccctaaacgttaacggtaacgtttaaccgtacggtttaccccggtacccccgttaccggggtaaccggtttaccccgggaaccgggtaaaaccgggggaacgtaaacgggggttaaacggtaaaaccgttaacccgtaaaaacgggtaaccgttagggaccggtccgttaacgcccgtaaacccgttagttcccgtttaaccgg

SEQ ID NO: 287420 - DNA, 576 bp, Homo sapiens
  misc_feature: GYAE6OF01CTD73.6.19.B08.1.454.CMB.1.raw
  modified_base (215)..(215): a, c, t, g, unknown or other
  misc_feature (215)..(215): n is a, c, g, or t
  modified_base (566)..(566): a, c, t, g, unknown or other
  misc_feature (566)..(566): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggnaagtcagagcattagcactatttaaattggtatcaggagaataccagggaaacgcccctaaactcctagatctatgatgctactcctaactttgacgaaaggtcggggtaccatacgaaaggttcaaggtggctaggtggatcgtgggaactagtatttacacttctacaccatacagctagtctagacctaaccgtagtaacgttattttacgactaaactttactaactgtaacaacagtaacgttacacgtccgtaccccgtggtaccggttcggaccgtaacgggaccgtaagggtacggtaaataacgaaaaccggtaacgtggtacgtacgtacgacctaacctnttcgttaccg

SEQ ID NO: 287421 - DNA, 671 bp, Homo sapiens
  misc_feature: GYAE6OF01BWUXY.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatcgacccagtcctccatccctccctgtctgcatctgtacggacacagatccaccatccacttcggccgggcaagtcagagcattacgactaacctttaatttaaagttggtactacgaaggaagtaactaccggaaacgggtaaaccgtaccccctaaaacttcctacgtaactaccttaagttggtactcgactacttacccttacgtttacgaaccgtaaacggttcgggtaccctagtacgtaacggttactaggtggactaggtggtacgttcgtacgggaactagtactttaccgacttacctacctaaccctaatacgaacgtacgtaacgttctacgaacctaacgtaggtaacgttatttaccgaacctttaactttactacttagtaacctaaacgtagtaacgttacgacggtccctacccggtaggtaccggtcgaaccggaacggtaacgtaaggtaacgaataaccgaaacgacgttggacgttcacgaacccacgtcgttctacg

SEQ ID NO: 287422 - DNA, 646 bp, Homo sapiens
  misc_feature: GYAE6OF01C6UG4.6.19.B08.1.454.CMB.1.raw
  modified_base (215)..(215): a, c, t, g, unknown or other
  misc_feature (215)..(215): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccggaggtgccagatgtgacatccagatcgacccagtctccatccctcctgtctgcatctgagacacagatcacatcacgttgccgganaagtcagagactattagactaacttaatttaaaagttggtaatacgaaggaagtaaacgtacccggaaaggggaaaaccgaacccccttaaaactcctagtaactactaagtagactacgactaactccgtactttacgacgtaaaacgggtcgggtacccaagtacgtaaaggttcgaaggttggactaggtaggtacttcggtagggaactagttactttacacctctaccaacctatacgaacgtactaacgtctacgtaacaaccgtagtaaacgttattttacgaaccttaaacgttactaacgtagtaacaacgtagtaacgttaccgacgtccgtaccccgtacggtacggtaccgacggaaaccggaacgtaaggtaacggtaaacaagaaacgacgtagtacgactagcacctagtgttacg

SEQ ID NO: 287423 - DNA, 575 bp, Homo sapiens
  misc_feature: GYAE6OF01BRFHJ.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagctattagctacttaatttaaatggtatcaggagaatccgaagggaaacgcccctaaactcctagactctatgatgctatcctacgtttgactaaacggtcgggtacccagtacgtaaggttcaggtggacgaggtggattcggaggaactagtactttcgacttctacacctatcagcagtctgacaactgaagtatttacgactaacttactactgtaactaacgagtaacgttaccagttaccgtccccgtagggtaccgttacggaccgaaacgggtaaccgtaagggtaacggaaactacgaaacggtaacgttggtacgtactacgacctacctagttccgtacg

SEQ ID NO: 287424 - DNA, 673 bp, Homo sapiens
  misc_feature: GYAE6OF01EMAOB.6.19.B08.1.454.CMB.1.raw
  modified_base (505)..(505): a, c, t, g, unknown or other
  misc_feature (505)..(505): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccggaggtgccagatgtgacatccagatcgacccagtctccatccctcctgtctgcatctggtaggacacagacgtccacctatccaacgttcggcccggggacaaaggtcaaggacgtactaattaacgtaaaccttaattttaaaagtttggttaatacgaagggaacgtaactaccggaaacggggaaaaccgtacccctaaaacctcctagacttacctagtgtatcgactacttcctacttcgaacgtaaacggtcgggtaccctagtaccgtaaggttcaggtcggacgtaggtgtagtcgtaggactagtactttccgacttctacgaacctagtcacgtctaacgtctacggactaacgtagtaacgtttnttacgaacttaactttacgtacttcgtaacaagtaacgtacgttaccgtacggttcccgtccccggttacggtaccggtaccggaaccggtaaacggtacccgtaaaggacggtaaactaacggaaacgacggtacgtacggactacgacctactacgtctgttaccc

SEQ ID NO: 287425 - DNA, 709 bp, Homo sapiens
  misc_feature: GYAE6OF01DEMNH.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtcctccatccctccctgtctgcatcgtgtagacacagacgtacaccatcacttcggccgggacaagtcagagctagttacgctaaccttaatttaaacttggtaactacgaaggaagaactaccggaagggaaccgacccctaaactcctgtactctatagtatgactactcctaacgtttacgacgtaaggtcgggtaccagtacgtaaggttcaggttggacgtaggtagtacgtacggttacgggactaaggttactttaccgaccttaccgtacctaaccctacttacgaacggtactacgttaccgtacgtacccgttaaccgtaagttaaacgtttacgttttacgtaacccgttaaactttaaccttacgttacgtaaacctaaccggtaacgttaacgttaccgaccggttaccggtacccccgttacggggtaccggttacccggaacggtaaaccggggaccgtaaacggggtaacgtaaacgttaccggaaaacgttacgtacggtacggtactacgacctacctcgttccgttaccg

SEQ ID NO: 287426 - DNA, 500 bp, Homo sapiens
  misc_feature: GYAE6OF01A51Y1.6.19.B08.1.454.CMB.1.raw
  modified_base (255)..(255): a, c, t, g, unknown or other
  misc_feature (255)..(255): n is a, c, g, or t
  modified_base (392)..(392): a, c, t, g, unknown or other
  misc_feature (392)..(392): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (494)..(494): a, c, t, g, unknown or other
  misc_feature (494)..(494): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcagganaatccaggaaacgcccctaaactcctgatctatgatgcatccactttgacaaagtcgggtccagtcaaggttcagtggcagtggatcgtgggactagatttcactctcaccatcagcagtctgacaaccgtgaagtnttttgactaacttactactgtacaacagacttanagtcnccccgtagacgttcgaccgaggaccaaggtagaaatacgaaacgactgtacgctacgaccacntcttcg

SEQ ID NO: 287427 - DNA, 505 bp, Homo sapiens
  misc_feature: GYAE6OF01EBD8G.6.19.B08.1.454.CMB.1.raw
  modified_base (498)..(498): a, c, t, g, unknown or other
  misc_feature (498)..(498): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccaggaagccctaaactcctgatctatgatgcatccatttgcaaagtggggtccatcaaggttcagtggcagtggatcgtggacagtatttcactctcaccatcagcagtctgcctaacctgaagtattttgactaacgtttactactgtactaacagtagttacagttcgcccctcgggacgttcggaccgaagggaccgaaggtgaaatacgaaacgaacgtaggtcgctacgacactntcgtacg

SEQ ID NO: 287428 - DNA, 515 bp, Homo sapiens
  misc_feature: GYAE6OF01BVRIE.6.19.B08.1.454.CMB.1.raw
  modified_base (483)..(483): a, c, t, g, unknown or other
  misc_feature (483)..(483): n is a, c, g, or t
  modified_base (509)..(509): a, c, t, g, unknown or other
  misc_feature (509)..(509): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatcccagatgacccagtctccatcctccctgtctgcatctgtaggacacagagtcaccatcacttgccgggcaagtcagagcattagcacctatttaaattggtatcaggagaatccagggaaacgcccctaaactcctgatctatgatgcatccactttgactaaggtcgggtcccatcaaggttcagtggcagtgatctagggacagtatttcactctcaccatcagctacgtctcgacaacctgtaagtacttttgactaactttactactagtcaactagagttacacgttcgcccgtcggaccgttcggaccgagggacctaagggtacgaaanacgaaacgactggtcgctgacacctntcgtcg

SEQ ID NO: 287429 - DNA, 545 bp, Homo sapiens
  misc_feature: GYAE6OF01D83FA.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaatcctgatctatgatgcatccactttgactaaagtcgggtcccatcaaggttcagtggcagtgatgtgggacagatttcactctcaccatcagcagtctgactacctgtaagtattttcgactaactttactacttagtacaactagagttacaggttccgaccccgttcgggtaccggttcggtacccgaacgggtaacccgaagggtaacgggtaaatacgaaaacggaaccgtggtacggtactacgtacaaccctagttcgtaccg

SEQ ID NO: 287430 - DNA, 569 bp, Homo sapiens
  misc_feature: GYAE6OF01CI195.6.19.B08.1.454.CMB.1.raw
  modified_base (251)..(251): a, c, t, g, unknown or other
  misc_feature (251)..(251): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcacatcacttgccggcaagtcagagcattagcactatttaattggtatcagganaatccaggaaagccctaaactcctgatctatgatgcatccatttgacaaacggtgggtacccaatcgtaaggttcagtggacaggtggatctgggacagtattcactctacacatcagcaacgtctagacaacctggtaacgtattttacgactaaacgtttactaacttcgtaacaacgagtaacgttacgaacgtcgtacccctacgggtaccgttaccggacccgtaaacggggaaccgtaaagggtaacggtaaactacgaaaaccgtaacgtacggttaggacctacggaccaacccgtagttccgttaccgg

SEQ ID NO: 287431 - DNA, 553 bp, Homo sapiens
  misc_feature: GYAE6OF01BDQPE.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccggcaagtcagagcattagctaccttatttaaattggtatcaggagaataccgaggaacgaccctaaactcctagatctatgatgcatccactttgactaaaggtcgggtcccatacgtaaggttcagtgacgagtagactcgtaggactagtatttacacttctcaccatcagcagtctgactaacgtagaagtatttacgacttaacctttactactgtacaactagtacgttactacgtccgcccgttacggaccgttaccggaccgtaaacgggtaccgaaaggtacgaaactaacgaaacgtaacgtcggtacgcgtacgtaccaacttcgtcgtaccg

SEQ ID NO: 287432 - DNA, 519 bp, Homo sapiens
  misc_feature: GYAE6OF01D3T8R.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaatggtatcagagatcaggaagcccctaaatcctgatctatgatgcatccactttgcaaagtgggtccatcaaggttcagtggcagtggatcgtggacagtatttcactctacacctatcagctagtcctgaccaacgtgtaagtactttgactaacttactactgtacaacagtacgttacagtccgccctcgggtaccgttcggaccgaacgggaaccgaacgggtaggaaatacgaaaacgacgtaggtacgtcgacgtaccacctagtcgttaccg

SEQ ID NO: 287433 - DNA, 657 bp, Homo sapiens
  misc_feature: GYAE6OF01CGVHA.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtcctccatcctccctgtctgcatctgtaggacacagagtcaccatcacttgccgggcaagtcagagcattacgctacttatttaattggtatcgaggagaatccagtacgaaacgtacccctaaactcctagatactatgatcgactactcctacttagacgtaaggtcgggtacccagtacgtaaggtcgtaggtggacgtaggtcggtacgtcgtagggaactaaggtacttttaccgaccttacctacctaaccgtacgtacgacgtactacgtacgtacgtaacctaaccgttagtaacgttaacttttcggaacctttaaactttacctaacgttacgtaacctaaacgtaacgtaacgttaccgtacggttcccgtaccccgttacggtaccggttaccggaaccggtaacgggaaccggtaagggtaaggaaaacgtaacggtaaaccgtaacgttacggtacggtacgtacgtaccctacgtcgttaccg

SEQ ID NO: 287434 - DNA, 568 bp, Homo sapiens
  misc_feature: GYAE6OF01AUMEG.6.19.B08.1.454.CMB.1.raw
  modified_base (474)..(474): a, c, t, g, unknown or other
  misc_feature (474)..(474): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccgaagggaaacgcccctaaaactcctagatctatgatgcatcctactttgacgtaaaggtcgggtaccccagtacgtaaggttcgaggttggcgtaggtggatcgtagggactagtacttttccacttctaccacctataccgagctacgtctacgaccaaccgtagaagtattttacgactaacttactacgtactacgaactagtacgttacncgttccgaccccgttacggaccgttccggaccgtaaagggaccgtaagggtacgaaatacgaaacgactggacgtctagaccactagtcgtacg

SEQ ID NO: 287435 - DNA, 542 bp, Homo sapiens
  misc_feature: GYAE6OF01A4F71.6.19.B08.1.454.CMB.1.raw
  modified_base (254)..(254): a, c, t, g, unknown or other
  misc_feature (254)..(254): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcagganaatccaggaacgcccctaaatcctgatctatgatgcatcctactttgacaaagtcgggtcccagtcaaggttcagtggcagtggatcgtgggacagtatttcactctacaccatcagcagtctgaccaactgaagtattttgactaactttactactgtacaactagtacgttacagttccgaccccgtaggaccgttccggaccgaaacgggaccgaaagggttacgaaaacttaccgaaaacgtaacgtagggtacggtacctaggacctaacctagttccgttcg

SEQ ID NO: 287436 - DNA, 569 bp, Homo sapiens
  misc_feature: GYAE6OF01A42LU.6.19.B08.1.454.CMB.1.raw
  modified_base (269)..(269): a, c, t, g, unknown or other
  misc_feature (269)..(269): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcactatttaaatggtatcaggagaatccgaagggaaacncccctaaaactcctagactctatgatgcatccatttgactaaaggtcgggtccagtactaaggttcaggtggcaggtggatcgtagggacagtactttcactctacacctatcagcagtctagaccaacctagaagttattttacgactaacttactaactgtactaacgtagtagttacacgttccgtaccccgtacgggtacgttccgggaaccgtaaacggggaaccgtaagggtacggtaaactacgaaaacggtaacgttggtacggtactacggacctaccgtagttcgttacg

SEQ ID NO: 287437 - DNA, 682 bp, Homo sapiens
  misc_feature: GYAE6OF01DO3CD.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattacgctaaccttaatttaaagttggtaatacgaaggaagaacgtaccgaacggggaaaccgtacccctaaaactcctagactctagtagatcgctactcctactttgaacgtaacggtcgggtacctagtacgtaaggttcaggtggacgtaggtggagtcgtaggactagtactttacactcctactacctactacgacgtactacgtactagtacccccccccccctaagtaacgtaagttacgttttacgtaccttaaactttaaccttaaccgttacgtaaccgtaacgtaaggttaacgttacgtaccgttaccgtaccccggtaccgggtaccggttacccgggtaccggaaaccgggtaaaccggtaaacgggtaacggtaaacgtaaccggtaaaaccgtaacggtacggtacggtaccgtacgacctaacctacgttcgttaccg

SEQ ID NO: 287438 - DNA, 525 bp, Homo sapiens
  misc_feature: GYAE6OF01E2N7L.6.19.B08.1.454.CMB.1.raw
  modified_base (360)..(360): a, c, t, g, unknown or other
  misc_feature (360)..(360): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattgtatcagagaatccagggaaagcccctaaactcctgatctatgatgcatccactttgcaaagtcggggtcccatcaaggttcagtggcagtggatcgtgggacagtatttcactcncaccatcagcagtctgacaactgaagtattttcgactaacttacttactgtacaaacgagtacgttacacgtcgccccgttggaccgttcgggacccgtaaagggacccgaaagggtcggaaagtacgaaaacgaacgtagtaggctaggaccaccgattcttcg

SEQ ID NO: 287439 - DNA, 537 bp, Homo sapiens
  misc_feature: GYAE6OF01EFCK1.6.19.B08.1.454.CMB.1.raw
  modified_base (457)..(457): a, c, t, g, unknown or other
  misc_feature (457)..(457): n is a, c, g, or t
  modified_base (528)..(528): a, c, t, g, unknown or other
  misc_feature (528)..(528): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcattctgtaggacacagagtcaccatcacttgcccgggcaagtcagagcattagctacctatttaattggtatcaggagaataccaagggaaacgacccctaactcctgtatctaatgatgtacactaccttacgttacgctaaaaaggttgggggtaccccaagttccaaaagggtttccaaggttgggaccagttggaattctggggacaaggattttcactctcaccatcagcaagtctgacaacctgaactattttgctattactactgtcaacngagttacagtcgcccctacggacgttcggccaaagggaccaaggtggaaattcaaacgactgtagctgacnccagtctcg

SEQ ID NO: 287440 - DNA, 590 bp, Homo sapiens
  misc_feature: GYAE6OF01EITBJ.6.19.B08.1.454.CMB.1.raw
  modified_base (214)..(214): a, c, t, g, unknown or other
  misc_feature (214)..(214): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggnaagtcagagcattagctacctaatttaaatggtatcaaggagaatccgaagggaaacgacccctaaactcctagatctatgatgcatcctatttgacgtaaaggtcgggtaccatacgtaaggttcagtggcaggtggatcgtagggacagtatttcactctacacatcagctagtctcgacctaacctgaagttatttacgacttaactttactactcgtaacaacgtagtacgttacacggttcccgtaccccgtacgggtaaccggttccggaccggtaaacggggtaaaccgtaaacggggtaacggaaaacgttaaccgaaaacggtaacgttacgggtacggtctacggacctaccgtagttccgttacg

SEQ ID NO: 287441 - DNA, 681 bp, Homo sapiens
  misc_feature: GYAE6OF01CADP5.6.19.B08.1.454.CMB.1.raw
  modified_base (232)..(232): a, c, t, g, unknown or other
  misc_feature (232)..(232): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtcctccatccctccctgtctgcatctgtaggacacagacgtccaccatcacgttcggccgggacaagtcagngcattagctaacttatttaaattggtatcgagagaactacgaaggaacgtacccctaaactcctagatactatgatcgctactcctacgtttcgacgtaaacggtcgggtacctagtacgtaaggttcaggtggacgtaggtggatcgtagggactagttacttccactcctaccacacttacacgtactacgttctacgaacctaacgttaggtaaacgtttacgttttacgaacctttaaaccgtttaaccttaaccgtacggtaacctaaacgtacggtaacgtttaccgtaccgggtacccgttacccccggtacgggtacccggttaccggaaccgggtaaaccgggtaaacccgtaaggggtaaccggtaaacgtaaaccggtaaacggtaccggttagggtaccgggtaccttaccgaccttaacccgtgttccgttacccg

SEQ ID NO: 287442 - DNA, 780 bp, Homo sapiens
  misc_feature: GYAE6OF01A42HX.6.19.B08.1.454.CMB.1.raw
  modified_base (266)..(266): a, c, t, g, unknown or other
  misc_feature (266)..(266): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctcctgtctgcatctgtaggacacagagtcaccatcacttcggccgggcaagtcagagcattagcactatttaatggtatcagagaatcgaaggaacncccctaactcctgactctatgatgcatcctacgtttgacgtaaaggtcgggtaccctaagtacgtaaacgggtttcgaaggttgggaccgtaggttcggtaagttccggtaggggtaacctaaggttactttttaccaacccgtttcccttacccgaaaccctacttaccgaacggtcccgtaaacggttcccttacggaacccttaaaccccgttaagggtaaacgtttaacgttttttacggaaccctttaaaccttttaaccgttaaccgtttacgttaaccctaaaccgtaaggttaaccggtttaaccgtaaccgggttcccgttaccccccgggttaccgggttaacccgggtttacccggggtaaccccgggtaaaaccggggtaaaccccggtaaacggggttaacgggtaaaacccgttaaaccggtaaaaacccggttaaaccggtttacgggttacgggtaccgttaccggaaccctaacccgttaagttacccggtttaccg

SEQ ID NO: 287443 - DNA, 708 bp, Homo sapiens
  misc_feature: GYAE6OF01A1F4V.6.19.B08.1.454.CMB.1.raw
  modified_base (696)..(696): a, c, t, g, unknown or other
  misc_feature (696)..(696): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatgacccagtcctccactcctccctgtctgcatctgtaggacacagagtcaccatccacttcggccgggacaagtcagacgctaattagcctaaccttaattttaaagttaggtattacgaagggaagaaacgttcccgaaggggaaaaccgtaccccctaaaacttcccgtaggaacttacctaagtcggaacttggacctaacgttccctaacgttttacggaaccgtaaacgggtccgggggtaccctaagttaccgtaaaggttcgaaggtgggtacctaggttcggagttccgtagggaacgtaggttacttttaccgacttacctacctaacctactaccgaactactacggttccgtacgtacccaaaccgttgttaaagttacgtttttcgaaccttaaccgtttaacttaacgttcgttaaccaaacgtagtaacggttactacggttcccgtacccgttaccgggtaccgttacggaccgtacgggtaaccgtaagggtacgaaatacgaaacgtacgtggtacgtactacgacnctagtcgttacg

SEQ ID NO: 287444 - DNA, 561 bp, Homo sapiens
  misc_feature: GYAE6OF01BLBA3.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccgaaggggaaacgccccctaaaactcctagatctatgatgcatccactttgactaaaggtcggggtcccatcgaaggttcagtggcaggtggatcgtagggacagtatttcactctaccacctatcagctagtctgacctaaccgtagtaacgtatttttacgaccttaaactttactactgtaccaacagtacgttacacgttcgccccgtacgggtaccgttccggaccgaaacgggaacccgtaagggtacggaaatacgaaaacgacgtaggtacggtctacgaccactatcgttacg

SEQ ID NO: 287445 - DNA, 560 bp, Homo sapiens
  misc_feature: GYAE6OF01DPFYV.6.19.B08.1.454.CMB.1.raw
  modified_base (415)..(415): a, c, t, g, unknown or other
  misc_feature (415)..(415): n is a, c, g, or t
  modified_base (552)..(552): a, c, t, g, unknown or other
  misc_feature (552)..(552): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatcaagggaacgacccctaaactcctagatctatgatgcatccactttgactaaaggtcgggtacccatacgtaaggttcaggtggacaggtggatcgtagggactagtatttacactctaccacctatcagctagtctacgacctaaccgtgaaagttnttttacgaccttaaactttactaacttcgtaacaacgtaagtagttaccagtccgaccccgtcggtacgtaccggacgaacgggaccgtaagggtacgaaacgtacgaaaacgacgtggacgtacacgaccaacctnttcgtacg

SEQ ID NO: 287446 - DNA, 614 bp, Homo sapiens
  misc_feature: GYAE6OF01AXRPJ.6.19.B08.1.454.CMB.1.raw
  modified_base (218)..(218): a, c, t, g, unknown or other
  misc_feature (218)..(218): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagatcaccatccacttggcccggganaagtcagagctaattagactaccttaatttaaattggtatcgaggagaatccgaagggaaacgacccctaaactcctagtatctatgatgcatcctaacgtttcgacgtaaacggttcggggtaccctaagtacgtaaaggtttcgaggttgggacgtaggtacggacgttcggtagggtaactaaggtactttaccaccttctaccacctactacgacgcgtacgtactgacctaacgtagtaagttacgttttacgaaccttaactttactacgtacgtactaagacgtagttacgacgtccgacccgtacggtacggtccggaccgtaacgggaccgaagggtacgaaagtaacggaaacgtaacgtagacggtcacgaccactcgttctacg

SEQ ID NO: 287447 - DNA, 549 bp, Homo sapiens
  misc_feature: GYAE6OF01A54GL.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaaagcccctaaactcctgatctatgatgcatccactttgcaaagtgggtccatcaaggttcagtggcagtggatctggtacagtatttcactctcaccatcagcagtctgcaacctgaagtattttgactaacttactactgtacaactagtaagttacagttcgccccgtacgggtaccgttccgggacccgtaaaggggacccgaaagggttacggaaaacttaccggaaaacggtaacctaggttacggtaccgttacggaccaacccgtagttccgttacgg

SEQ ID NO: 287448 - DNA, 667 bp, Homo sapiens
  misc_feature: GYAE6OF01D9UW4.6.19.B08.1.454.CMB.1.raw
  modified_base (217)..(217): a, c, t, g, unknown or other
  misc_feature (217)..(217): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtctccatccctccctgtctgcatctgtaggacacagagtccaccatcacttgccggnaagtcagagcattagctaaccttaatttaaatggtatacgaggaagaactaccgaagggaaaccgacccctaaaactcctagacttactatgatcgactactcctacgtttgacgtaaggtcgggtaccagtacgtaaggttcaggtggactaggtggatcgtagggtactagtacttcactcctacacctatcagtactacgtctacgacctaacctagtaacgttagttttacgacctttaaactttaccttacgttacgtaactaacgtaacgttaacgttaccgtacggttaccgtacccccgttacgggtacccggttaccgggaacccggtaaaccggggtaaccgttaaagggggtaaacgtaaaaccgttaaccgtaaaaaccgggtaacgttacggtaccggtaccgtaacggaccctaacccgtaacgttccgttacccg

SEQ ID NO: 287449 - DNA, 537 bp, Homo sapiens
  misc_feature: GYAE6OF01BBBDG.6.19.B08.1.454.CMB.1.raw
  modified_base (394)..(394): a, c, t, g, unknown or other
  misc_feature (394)..(394): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccgaagggaaacgcccctaaactcctgatctatgatgcatccactttgacaaagtcgggtacccatcaaggttcagtgctagtgatcgtgggacagtatttcactctcaccatcagcagtctgacaacctgaagtntttagacctaatttacctatgtacaacgtagtaagttacgagttcgaccccctgggtaccgttccggaccgaaagggaccgtaaagggtacggtaaaactacgaaaacgaacgtggtacggtcacgaccacctagtcttaccg

SEQ ID NO: 287450 - DNA, 529 bp, Homo sapiens
  misc_feature: GYAE6OF01D2OF4.6.19.B08.1.454.CMB.1.raw
  modified_base (375)..(375): a, c, t, g, unknown or other
  misc_feature (375)..(375): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggcaagtcagagcattagcacctatttaaattggtatcagagaatcaggaacgccctaactcctgatctatgatgcactcctactttgacgtaagtcggggtcccatcgaaggttcagtgcagtgatcgtggacagtatttcacttctcaccatcagcagtctnacaacctgtaagtattttgactaacttactactgtactaacagtaagttacagtcgtccccgtacggtaccgttccggacgaaacgggaccgtaagggtagtaaacgtaccaaaacggtaactggtacgtacgtacgaccacctgttcttaccg

SEQ ID NO: 287451 - DNA, 530 bp, Homo sapiens
  misc_feature: GYAE6OF01CNG1H.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcactatttaaattggtatcaggagaatccaggaaagcccctaaaactcctgatctatgatgcatccactttgacaaagtgggtccatcaaggttcagtgcagtggatctgggacagatttcactctcaccatcagcagtctgcaacctgaagattttgctaacttatactgtacaaacagaagttacaggttcgcccctacgggtaccgttccggaccgtaaacgggaccaaacgggtagggaaaattaccgaaaaacgaaacttaggtcggtaccgttagaccaacccgaatcgttacg

SEQ ID NO: 287452 - DNA, 648 bp, Homo sapiens
  misc_feature: GYAE6OF01DC1O9.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagctaccttatttaaattggtatcaggagaatccgaagggaacgcccctaaactcctagatctatgatgcactcctactttgacgtaaaggtcgggtacctagtcgaaggttcaggtggacaggtgatcgtgggactagtatttcactctaccaccatcagtctagtctagaccaaccgtagtaacgttatttacgaccttaaactttaccttacgttacgtaacctaacgtaaggttaacgtttaaccgacggtttcccggtaaccccccggttcgggttaacccgggtttacccgggaacccgggtaaaaccgggggtaaccctaaaacgggggttaaacggtaaaaccgttaaaccggaaaaccggtaaacggttgggtacggtaccttacgaccctaaccctgttcccgttaccgg

SEQ ID NO: 287453 - DNA, 622 bp, Homo sapiens
  misc_feature: GYAE6OF01A0BLL.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctcctgtctgcatctgtaggacacagatcaccatcacttgccgggacaagtcagagctattagctaaccttaattttaaagtggtatcgaggagaactccgaagggaaacgacccctaaactccgtagatctatgtatgctactcctacgtttgaacgtaaaggtcgggtaccagtacgtaaggttcaggtggcgtaggtggtatcggtagggtaactagtactttacacttactcctaaccatcacgtactacgttctacgacctaaccgtaggtaattacttttacgacctttaacttactactagtacctaagtacgtaacgttacacggttacccgtaccccggtacggtaccggttaccgggaaccgtaacgggaaccgtaagggtacggtaaaacgttaccaaaccgggtattcgggtacgacgttaccgacctacctgttccgttcg

SEQ ID NO: 287454 - DNA, 618 bp, Homo sapiens
  misc_feature: GYAE6OF01B3THG.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagatcaccatcacttgccgggcaagtcagagcattagctaaccttaattttaaattggtaatcaggagaactccgaagggaaacacccctaaactcctagatctatgatgactactcctaacttttgacgtaaaaggttcggggtaccctagtacgtaaaggttcgaaggtggacgtaaggtggtaatcgtaggggaactaggtactttcacctctacacccatacacgctagtctagtaccaactagtaattattttacgaccttaaacttaactactactaactaaacagtaacgttacacggttccgaccccggtcggtaccggttaccggaccggaaacgggtaaccgaaacggggttaacggtaaaataccgtaaaacgtacgtaggttacggactacggaaccacctaacgtgttaccg

SEQ ID NO: 287455 - DNA, 539 bp, Homo sapiens
  misc_feature: GYAE6OF01DQ889.6.19.B08.1.454.CMB.1.raw
  modified_base (534)..(534): a, c, t, g, unknown or other
  misc_feature (534)..(534): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcacttatttaaattggtatcaggagaatccgaagggaacacccctaaactcctgatctatgatgctactcctactttgacgtaaaggtcgggtacccatacgaaggttcaggtggctaggtggatcgtgggactagtattcactctaccactatcagctagtctgacctacctgtaattatttcgacttaacttactactagtacaactaggtaacttacgacgtccgtacccgtcgggtaccgttccggacgaacgggtaccgaaggtacgaactacgaaacgtagtgtacgctcaccactntctcg

SEQ ID NO: 287456 - DNA, 526 bp, Homo sapiens
  misc_feature: GYAE6OF01A0YE3.6.19.B08.1.454.CMB.1.raw
  modified_base (268)..(268): a, c, t, g, unknown or other
  misc_feature (268)..(268): n is a, c, g, or t
  modified_base (327)..(327): a, c, t, g, unknown or other
  misc_feature (327)..(327): n is a, c, g, or t
  modified_base (393)..(393): a, c, t, g, unknown or other
  misc_feature (393)..(393): n is a, c, g, or t
  modified_base (416)..(416): a, c, t, g, unknown or other
  misc_feature (416)..(416): n is a, c, g, or t
  modified_base (437)..(437): a, c, t, g, unknown or other
  misc_feature (437)..(437): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaancccctaaactcctgatctatgatgcatccactttgacaaagtgggtcccatcaaggttnaggtggcagtggaatcgtgggacagtatttcactctcaccatcagcagtctgaccaacctgaagtnttttagactaacgtttacacttntacaacagtagttaacagtcnccccgttcggaccgttcggacccgaaagggaccgtaagggtacggaaattacaaaacggatacggaggtcctagaccacctagtctacg

SEQ ID NO: 287457 - DNA, 657 bp, Homo sapiens
  misc_feature: GYAE6OF01BVLGC.6.19.B08.1.454.CMB.1.raw
  modified_base (217)..(217): a, c, t, g, unknown or other
  misc_feature (217)..(217): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctcctgtctgcatctgtaggacacagagtcaccatcacttcgccggganaagtcagagcattagcaaccttatttaaattggtatacgaggagaactaccgaagggaaacacccctaaactccgtagtactctatgaatgactatcctactttagactaaaggtcgggtaccagtacgtaaggttcaggtggacgaggtggacgtcggtagggtactagtacgtttacacttcctacaacctactacacgtcagtcctagacctaaccgtagtaacgttacgtttacgaccttaaacgtttaccttaacgtacgtaaccgtaactacggtaacgtttaaccgacggtttacccggtacccccggttacgggtaacccggttcggggaacccggtaaacggggtaacccgtaaacgggtacgggtaaaactacccggtaaaaccgtacggtacggtacgggtacctacggaccctactcgttccgttacg

SEQ ID NO: 287458 - DNA, 523 bp, Homo sapiens
  misc_feature: GYAE6OF01B3QRV.6.19.B08.1.454.CMB.1.raw
  modified_base (268)..(268): a, c, t, g, unknown or other
  misc_feature (268)..(268): n is a, c, g, or t
  modified_base (405)..(405): a, c, t, g, unknown or other
  misc_feature (405)..(405): n is a, c, g, or t
  modified_base (433)..(433): a, c, t, g, unknown or other
  misc_feature (433)..(433): n is a, c, g, or t
  modified_base (447)..(447): a, c, t, g, unknown or other
  misc_feature (447)..(447): n is a, c, g, or t
  modified_base (515)..(515): a, c, t, g, unknown or other
  misc_feature (515)..(515): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcaccttatttaaattggtatcagagaatccagggaaanccctaaatcctgatctatgatgcatccattttgactaaaggtcgggtaccctatacgtaaaggttcaaggttgacgagtggatcgtagggacagtattcactctcactatcagtcagtctagactaacctgaacgtnttttagacctaacttactactgtacaanagtagttacagtcnccccgtggtaccgtccgacgacggaaccgaggtagaaatacgaaacacgtagtacgctacgaccaacntcgttacg

SEQ ID NO: 287459 - DNA, 669 bp, Homo sapiens
  misc_feature: GYAE6OF01C8BMO.6.19.B08.1.454.CMB.1.raw
  modified_base (215)..(215): a, c, t, g, unknown or other
  misc_feature (215)..(215): n is a, c, g, or t
  modified_base (392)..(392): a, c, t, g, unknown or other
  misc_feature (392)..(392): n is a, c, g, or t
  modified_base (656)..(656): a, c, t, g, unknown or other
  misc_feature (656)..(656): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtccaccatcacttgccgganaagtcagagctagttagctaccttaatttaaattggtaatacgaaggaagaactaccgaaggggaaaccgtaccccctaaaaccgttccctagacttacctataggatggactactcctaactttgaccgtaaaggtcgggtacccagtacgtaaggttcagtggactaggtagtancgtaggactagtactttcacttactaccaaccgtatacgacgactaacggttctaacgcctaaaccgtggtaaagttactttttacgaaccctttaaaccgtttactaacctttcgtaaccgtaaacgaacggttaacgttacgttaccgggtcccgtacccccgttaggtaccccggtttaccggaaccgtaaaccggggtaccaaagggtacggtaaaactaaccggaaaccgtaagtcggtcggacctcggaacctaaccngttccgttaaccg

SEQ ID NO: 287460 - DNA, 546 bp, Homo sapiens
  misc_feature: GYAE6OF01A13M9.6.19.B08.1.454.CMB.1.raw
  modified_base (95)..(95): a, c, t, g, unknown or other
  misc_feature (95)..(95): n is a, c, g, or t
  modified_base (370)..(370): a, c, t, g, unknown or other
  misc_feature (370)..(370): n is a, c, g, or t
  modified_base (389)..(389): a, c, t, g, unknown or other
  misc_feature (389)..(389): n is a, c, g, or t
tcagatatcgcgagcacgaccggtgctcgatttagtgagtcagtaagggggagtcagtctcagtcaggacacagcatggacatgagggtccccgntcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacgcccctaaactcctgatctatgatgcatccactttgcaaagtgggtcccatcaaggttcagtggctaggtgatcgtgggacagatttcactctcaccatcancagtctgcaacctgaagtnttttgactaacttactactacgtcaacagtacgttacaggttcgcccctacgggtaccgttccggaccgaaacgggacccgaaagggttacggaaaatacccggtaaaaacgaaccgttaggtacgggtacttacggacctaccaagttccgttacg

SEQ ID NO: 287461 - DNA, 606 bp, Homo sapiens
  misc_feature: GYAE6OF01BQ0VW.6.19.B08.1.454.CMB.1.raw
  modified_base (224)..(224): a, c, t, g, unknown or other
  misc_feature (224)..(224): n is a, c, g, or t
  modified_base (274)..(274): a, c, t, g, unknown or other
  misc_feature (274)..(274): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagancattagctaccttaatttaaattggtatcaggagaatccgaagggaaacncccctaaactcctagactactatgatgctactcctactttgactaaaggtcggggtccccaatcgaacggttcgagtggcgaggtggactcgtgggaactaggtactttcacttctacaccctatcagtctaacgtctacgacctaaccgtgtaacgttattttacgaaccttaactttaaccgtacttagtaaccaacgtagtaacgttacgacgttaccgcccccgttaggtaccggttccgggaaccgaaacgggtaaccgtaagggtaacggtaaactaacggaaaaccggtacgtacggtacgtctacgacctaacctgttacttcg

SEQ ID NO: 287462 - DNA, 704 bp, Homo sapiens
  misc_feature: GYAE6OF01CUKT7.6.19.B08.1.454.CMB.1.raw
tcagatatcgcgagcacgaccggtgctcgatttagtgagtcagtaagggggagtcagtctcagtcaggacacagcatggacatgagggtcccccgctcagctcctggggctcctgctactctggctccgaggtgccagatgtgacatccagatgacccagtcctccatccctccctgtctgcatctgtaggacacagatccaccatcacgttcggccgggacaagtcagagctaattacgacctaacctttaatttaaagttggtaacttacgaaggacgaaacgtaccgaaacggggaaactacccccgtaaaaccttcctagtactccttaagtagtacttcgactacttacctacgtttacgacgtaaaggttcgggtaccctagtacgtaacggttacgacggtcggacgtaggttaggacttacgtacgggtaactaaggttacttacgtaccttacctacctaacctagttaccgacgtactacgttctacgacctaaccgttaggtaaacgtttacgttttacgtaacctttaactttaacctacgttacgtaactaaacgtagttaacgttaccgtacgttaccgtacccgtcgggtaaccgttaccggaacggaaccgggtaaaccgtagggtaaaccgtaaagaaccgtaaacgtacggtacgcggtaccgtacaacgtacctcgttgttaccg

SEQ ID NO: 287463 - DNA, 728 bp, Homo sapiens
  misc_feature: GYAE6OF01AEZ38.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttggccgggcaagtcagagcattacgctaaccttaattttaaattggtatcgaggagaactccgaacgggaaacacccctaaactcctgatctatgatgcactcctactttcgacgtaaacggtcgggtaccagtaccgtaaggttcgaggttcggacgtaggtacgggtactccggtagggtaacgtaggttaactttaccctaaccttccgttacccaaacctacgttaccgaacgtcccgttaacggttccgtaaccgtaaccgtaaacccttaggtaaacgtttactttttacgaacccttttaacctttacttaaccttacgtaaccctaaagtaacgtttacgttaaccgtaccgttcccggtacccccgtttacgggtaacccggttaccggggaacccggtaaacggggtaacccggtaaaggggttaacggaaaaaccgttaaccggaaaccggttaaccggttcgggtaacggtcccggtacgaacccgtaaccttcgtcccgttttaccgg

SEQ ID NO: 287464 - DNA, 557 bp, Homo sapiens
  misc_feature: GYAE6OF01BY0ZU.6.19.B08.1.454.CMB.1.raw
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
  modified_base (399)..(399): a, c, t, g, unknown or other
  misc_feature (399)..(399): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcagganaatcagggaaacncccctaaatcctgatctatgatgcatccactttgactaaaggtcgggtccaagtacgaaggttcaggtggcaggtggatcgagggacagtatttcactctcaccatcacgcagtctagaccaacctgtaatntttacgactaactttactactcgtacaacagtaacgttacacgttccgaccccgtacggtaccggttccgggaccgaaacgggtaaccgtaagggtacggaaacttaacggaaaacgtacgtaggtacggtccgtacgaccaccctaagtccgttacg

SEQ ID NO: 287465 - DNA, 555 bp, Homo sapiens
  misc_feature: GYAE6OF01C3HHC.6.19.B08.1.454.CMB.1.raw
  modified_base (271)..(271): a, c, t, g, unknown or other
  misc_feature (271)..(271): n is a, c, g, or t
  modified_base (547)..(547): a, c, t, g, unknown or other
  misc_feature (547)..(547): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcactatttaaattggtatcaggagaactaccgagggaaacncccctaaactcctagatctatgatgcactcctactttgacgtaaaggtcgggtaccagtacgaaggttcaggtggactaggtggatcgtaggactagtattcactctcaccatcagctagtctacgacctaaccgtagtaacgtattttcgacttaacttactacttagtaacaacgtagtacgttacacgtccgaccccgtggtaccgttccggaccgaacgggaccgtaaggtacgtaaactacgaaacgtacgtggtacgtctacgacacctntcgttacg

SEQ ID NO: 287466 - DNA, 542 bp, Homo sapiens
  misc_feature: GYAE6OF01CNOUR.6.19.B08.1.454.CMB.1.raw
  modified_base (95)..(95): a, c, t, g, unknown or other
  misc_feature (95)..(95): n is a, c, g, or t
  modified_base (214)..(214): a, c, t, g, unknown or other
  misc_feature (214)..(214): n is a, c, g, or t
  modified_base (370)..(370): a, c, t, g, unknown or other
  misc_feature (370)..(370): n is a, c, g, or t
  modified_base (382)..(382): a, c, t, g, unknown or other
  misc_feature (382)..(382): n is a, c, g, or t
  modified_base (399)..(399): a, c, t, g, unknown or other
  misc_feature (399)..(399): n is a, c, g, or t
tcagatatcgcgagcacgaccggtgctcgatttagtgagtcagtaagggggagtcagtctcagtcaggacacagcatggacatgagggtccccgntcagctcctgggctcctgctactctggctccgaggtgccagatgtgacatccagatgacccagtctccatccctccctgtctgcatctgtaggacacagagtcaccatcacttgccggnaagtcagagcattagctacctattttaaatggtatcgaggagaataccgagggaaacacccctaaactcctagatctatgatgacatccatttgactaaggtcgggtaccatcgaagttcagtgcagtgatcgtaggacagtattcgactctcacntacagcagtacngacctaactgtaaattnttcgacctaacttactaactcgtaacaacgtagtacgttacacgttccgaccccgtacggaccgttcggaccgtaaggacccgtaaagggtcgaaagtaccgaaacgtacgtaggtacggactcgaccaacctgtccgttacg

SEQ ID NO: 287467 - DNA, 540 bp, Homo sapiens
  misc_feature: GYAE6OF01BGLFW.6.19.B08.1.454.CMB.1.raw
  modified_base (271)..(271): a, c, t, g, unknown or other
  misc_feature (271)..(271): n is a, c, g, or t
  modified_base (377)..(377): a, c, t, g, unknown or other
  misc_feature (377)..(377): n is a, c, g, or t
  modified_base (382)..(382): a, c, t, g, unknown or other
  misc_feature (382)..(382): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttggccgggcaagtcagagcattagcacctatttaaatggtatcaggagaatccgaagggaaacncccctaaactcctagatctatgatgctatcccacttttgacaaaggtcgggtcccaagtctaaggttcagtggcgaggtggtatcgtgggacagtatttcacttcncaccntacagctagtctgacctaaccgtgtaacgttattttcgactaaactttactacttctaacaactagtaagttacacgttcgccccgtggtaccgtcggccgaaagggaccgaaggtacgaaactacgaaacgactggacgctacgacctactgtctcg

SEQ ID NO: 287468 - DNA, 623 bp, Homo sapiens
  misc_feature: GYAE6OF01ER7B6.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcaaccttatttaaattggtatcaggagaatccaagggaaacgcccctaaactcctgatctatgatgcatcctactttgacgaaaggtcgggtacccagtctaaggttcagtggcaggtggactcgtgggaaccagtactttcacttctacaccattcagtcagtcctgaccaaccgttgtaacgtacttttacgacttaaaccgttactacgtacgtaaccaacgtacgtacgtttacgacgttccggtacccccgttacgggtaacccggttcgggtaaccccggaaacggggtaaacccggtaaaggggtacggtaaaaacgttccgaaaaaccggttaaccgttagggttaccggaccgttacgaccctaacccgtattccgttaaccg

SEQ ID NO: 287469 - DNA, 764 bp, Homo sapiens
  misc_feature: GYAE6OF01BJ8IS.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatccacttggccgggacaagtcagacgcattacgctaaccttaattttaaattggtatcgaggagaactaccgaagggaacgtacccctaaactccgtagactctagtagactcgacactcctacgtttagacgtaaacgggttcgggtaccctaagtacgtaaagggttcgaaggtggtacgtaggtcggtaagttccgaggggaactaaggttactttccgaaccttcctacctaacccgattaccgaacgtaccgtaaacgttccgtaaccgtacccttaaacccgtaaggttaaaccggttaagttttttaaccggaaccctttaaaccgttttaacccgttaaaccgttacgttaaaccgtaaacgtaacggttaacgtttaaccggtaacgttaccccggtaccccggtttaaccgggtaaccggttacccgggaaccgggtaaaccgggtaaacccgggtaaacggtaaccgggtaaaacgtaacccggtaaaaccgggtaaccgttggggtaccggtacgtacgaaccctaaccgtaccgtttccgttacccgg

SEQ ID NO: 287470 - DNA, 585 bp, Homo sapiens
  misc_feature: GYAE6OF01BZZPY.6.19.B08.1.454.CMB.1.raw
  modified_base (215)..(215): a, c, t, g, unknown or other
  misc_feature (215)..(215): n is a, c, g, or t
  modified_base (272)..(272): a, c, t, g, unknown or other
  misc_feature (272)..(272): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggnaagtcagagcattagcaccttatttaaattggtatcaggagaatccgaagggaaacncccctaaactcctgatctatgatgctatcctactttgacaaaggttcgggtaccatcaaggttcaggtgcagtggatcgtgggacagtatttcactctaccaccatcagctagtctgaccaactgaagtattttacgactaacgtttactacttagtaccaacgtaggtaacgttacacggttccggacccccgttacgggtaccggttacccgggaccgtaaacgggaacccgtaaagggtacggtaaaagtaccgaaaaccggtaacgttcggtacggtaccttacgacccgtaacctagttcccgttacg

SEQ ID NO: 287471 - DNA, 550 bp, Homo sapiens
  misc_feature: GYAE6OF01DNRCN.6.19.B08.1.454.CMB.1.raw
  modified_base (261)..(261): a, c, t, g, unknown or other
  misc_feature (261)..(261): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggcaagtcagagcattagcactattaaatgtatcagagaatcgaggaacnccctaaactcctgatctatgatgcatcctactttgactaaaggtcgggtacccatcgtaaggtttcaaggttcggactaggtcggatcgtaggggactagtatttaccgactctaccaccattcagcagtctgccaacctgaagttatttgactaactttctactgtaacaacgagtacgttacacggttccgccccgttggaaccggttccggaccgaaacgggaccgtaaaggttaggaaacttacgaaaaccgtaactggtacgtctacgacaccagtccgttacg

SEQ ID NO: 287472 - DNA, 728 bp, Homo sapiens
  misc_feature: GYAE6OF01CJDH6.6.19.B08.1.454.CMB.1.raw
  modified_base (213)..(213): a, c, t, g, unknown or other
  misc_feature (213)..(213): n is a, c, g, or t
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
  modified_base (267)..(267): a, c, t, g, unknown or other
  misc_feature (267)..(267): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctcctgtctgcatctgtagacacagagtcaccatcacttgccgggnaagtcagngctattagcacctatttaaattgtatcagganaatccagggaaacnccctaaactcctgatctatgatgcatcctactttgacgtaaaggtcggggtaccctagtaccgtaaagggtttccaaggttcgggacgtaggtacggtaagttccgtacggggaactaggtaacttttccgaaccttacctaccgtacctaacgttaccgaacggtacctaacggttacctacggaacccgttaaacccgttacggttaaagttaacgttttttacggaacctttaaaacccgtttttaacctaaccgtttaacggttaacctaaaccgtaacggttaaaccgtttaaccgtaaccgggttacccgtacccccggttaccgggtaaccgggtttccggaacccggtaaaacgggtaacccgtaaacgggtaacggtaaaacttaaccggtaaaacggtaaccgttggtaacgggtacgttacgaacctaacccgttaagttccgttaccgg

SEQ ID NO: 287473 - DNA, 552 bp, Homo sapiens
  misc_feature: GYAE6OF01EYO5X.6.19.B08.1.454.CMB.1.raw
  modified_base (214)..(214): a, c, t, g, unknown or other
  misc_feature (214)..(214): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggnaagtcagagcattagcacctatttaaatggtatcagagaatccgaggaaacgcccctaaactccgtgatctatgatgcatccactttgactaaagtcgggtcccatcgaaggttcgagtggcaggtggatcgtagggacaggtatttacaccttctccacctatctacgactagtctacgacaaccgtgaagtattttgacctaactttactacttagtacaacgtagtagttacacgttcgcccgtacggtacgttccggaccgtaacgggaaccgtaagggtacgaaacgtacgaaaacgtacgtaggtacgtccgtacacaccgtactcgttacg

SEQ ID NO: 287474 - DNA, 610 bp, Homo sapiens
  misc_feature: GYAE6OF01AKZW2.6.19.B08.1.454.CMB.1.raw
  modified_base (218)..(218): a, c, t, g, unknown or other
  misc_feature (218)..(218): n is a, c, g, or t
tcagatatcgcgagcacgaccggtgctcgatttagtgagtcagtaagggggaggtcgagtctcagtcaggacacagcatggacatgagggtccccgctcagctcctggggctcctgctactctggctccgaggtgccagatgtgacatccagatgacccagtctccatcctcctgtctgcatctgtaggacacagagtcaccatcacttcgccggggnaagtcagagctagttagcaccttatttaaattggtatcgaggagatccgaagggaagacccctaaacgtcctgatctatgatgcatccactttgactaaagtcgggtccattcgaagttcaagtgcagtggatcgtagggactaggtatttcactctcactatcagtcagttcacgacctaccgtagtacgtacttttcgaccttaaccgtttacttacgttacgtacaaacgtaggtaagtttaaccgattacccgggccccttaccggggacccgttttaccgggacccggtaaaacgggtaacccgaaaggggtttaccggaaactttaacccgaaaacggttaacgttcggagggtccttacggacccaacccgttgttaacgttccg

SEQ ID NO: 287475 - DNA, 661 bp, Homo sapiens
  misc_feature: GYAE6OF01DE1I1.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtccaccatcacgttcggccgggcaagtcagagctattacgctaacttatttaaattggtatcgaggagaactccgaagggaacacccctaaactcctagacttctagtgatcgactacttccctagtttacgaacgtaagggttcgggtacctaagttacgtaaggttcgaggttggacgtaggtggtactcggtgggtaactagttactttccgaccttcctacaacctatccgaagtcctaagtcctacgaccctaaccgttaggtaacttacgttttacgaacctttaaaccttacgttacttacgtaactaaacggtacgttaacgttaccgtaccggtcccgttaccccggttagggtaccggttacccggacggtaaacgggtaccgtaaaggggtaacgtaaacgtaccgtaaaacggtacgttggacgtcgtaccgactaccgttattccggttacg

SEQ ID NO: 287476 - DNA, 725 bp, Homo sapiens
  misc_feature: GYAE6OF01DLCP8.6.19.B08.1.454.CMB.1.raw
tcagatatcgcgagcacgaccggtgctcgatttagtgagtcagtaagggggagtcagtctcagtcaggacacagcatggacatggacgggtccccgctcagctccgtggggctcctgctactctggctccggaggtgaccagatggtgacatccagatcgacccagttcctccacttccctccctgtctgctatcgtaggtacggacacgagacgtaccacctatctacgttcgggaccgggacaagtcgaagacgtactaattacgaccttaactttaattttaaagttggtaatacggaaggtaagaaccgtaccggaaacgggaaaccctaccccttaaacgttccgtagtacttactagtcgatcgactacttacctacgtttacgacggtaacggtcgggtaccctaagttacgtaacgggttacgaggttcggacgtagggtacggtacgttacgggtagggtaacttaggttactttaccctaccttccgacctaacgtactacgtacgtacgttaacgtccacgtaacgtaacgttaagttatttacgtttactaacctttaacgttacttaacgtacgtacgtaaacgtagtacgtaccgacggttacccgtacccggtcggtaccggtcccggtaacgaaaccgggtaggaaaggtaaccgtaagaaaccgtacggtacgtaggtccgtacgtacctactacttacgtcttacgg

SEQ ID NO: 287477 - DNA, 569 bp, Homo sapiens
  misc_feature: GYAE6OF01CG72J.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcacatcacttggccgggcaagtcagagcattagcactattaatggtatcaggagatcgaggaacgcccctaaactcctgatctaatgatgcatcctatttgactaaaggtgggtaccctagtacaagggttcaggttcggacaggtgagtcgtgggaacagtattcactctacacatcagtcagtctgacaacctgtaattactttagtcctaaacgttactaaccttgaacctaaacgtagtaacgtttacacgtccgtcccccgttacgggaccgttccggacccgtaaacgggtaccgtaaacgggtagtaaactaccggtaaaacgaacggttgtacggtctacgacctaacctacgttcgttaccg

SEQ ID NO: 287478 - DNA, 695 bp, Homo sapiens
  misc_feature: GYAE6OF01BVYG0.6.19.B08.1.454.CMB.1.raw
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcagganaatccgagggaaacncccctaaactcctgatctatgatgcactccatttcgacgtaaaggttcggggtacccaagttacgaaaggtttcaaggttggactaggtggtatcgtagggacaagtatttccaccttctacacccatacagtacctagttccgtagacctaaccgtaggtaaagttacgtttttacggaaccttaaaccgttttaaccgttaaccgttacgttaacccgaaaacgtaacggttaacggttttaaccgaacgggttaccccgtaccccccgttaccggggttaacccggttaccgggaacccggtaaaccggggtaaacccgtaaagggggttaacgggtaaaaccttaaccggtaaaaaccgggtaacccgttaggttacgggtacctaccggtacctaaccccttaacgttccgtttacccgg

SEQ ID NO: 287479 - DNA, 743 bp, Homo sapiens
  misc_feature: GYAE6OF01ER7LF.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcattctgtaggacacagagtcaccatcacgttggcccgggcaaggtcaaggagctattagctaacttaatttaaattggtatacaggagaataccgaagggaaactcccctaaactcctagactctatgatgcacttacctactttagacgtaaacgggttccgggtccctaagtacgtaaacgggttcaaggtcgggtactagggttacggacgtttccggtaggggaacctaggttaacttttaccgacctttccgtaccctaaccgtactaccgacggtaccctaagttccgtacgaaccccgttaaccgttgggtaaaacgttttacgttttacgaacctttaaacccttttaacgtaaccttacggttaaaccaaacgtaacggttaacgttaaccgacggttacccgtacccccggttacggggtaacccggttccgggaaacccgggtaaaacgggtacccggtaaaggggtaacggtaaaacttaacccggtaaaaccgtaaacggtttggtaacgggtaccgtaccgaacctaacccgttaacgttccgtttaacg

SEQ ID NO: 287480 - DNA, 529 bp, Homo sapiens
  misc_feature: GYAE6OF01CLQPY.6.19.B08.1.454.CMB.1.raw
  modified_base (521)..(521): a, c, t, g, unknown or other
  misc_feature (521)..(521): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcaactatttaaatggtatcaggagaatccagggaaacgcccctaaactcctgatctatgatgcatccactttgacaaagtcgggtcccatacgaagttcgagtggacaaggtggatcgtagggacagtactttcactctcaccatcagcagtctacgactaacgtgtaagtattttgacctaacttactactagtcaaacagtagttactagtccgcccgtcggacgttcggaccgaaggaccgaagggtacgaaatacgaaacgtaacgtgtacggacacgaccaacctntcgttacg

SEQ ID NO: 287481 - DNA, 595 bp, Homo sapiens
  misc_feature: GYAE6OF01AV68V.6.19.B08.1.454.CMB.1.raw
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagacgtcaccatcacttggccggnaagtcaganctattacgctaccttaatttaagtggtatcaggagaataccgagggaactcccctaaactcctagactctagtgatgactactcctactttcgacgtaaacggtcgggtacccaagtcgtaaaggttcaggtgacgtagtggatcgtagggactacgtattcacttctactaccctatacagtactacgtcgtacgactaaccgtaggtaacttacgttttacgacttaactttctaactgtaaccaagtagtacgtactacgtccgtacccgttaggtaccgtacggaccgaaacggggtaacctaagggtacgtaaagaccggtaaacgacggttggtaccgtctacgaccgtacctagttacgtccg

SEQ ID NO: 287482 - DNA, 676 bp, Homo sapiens
  misc_feature: GYAE6OF01DW6XO.6.19.B08.1.454.CMB.1.raw
  modified_base (215)..(215): a, c, t, g, unknown or other
  misc_feature (215)..(215): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccggnaagtcagagcattagctaccttaatttaaattggtatcgaggagaataccgaaggaaacgacccctaaactcctagatctatgatcgactactcctactttacgacgtaaacggtcggggtaccaagtacgtaaggttcaaggtggacgtaggtggacgttcgtagggactagtactttacgaccttctaccacacttacagtcacgtctacgacctaaccgtagtaacgttattttacgacttaactttactacgtacgtactaaactacggtacgttaaccgacgttacccgtaccccgttacgggtaacccggtttaccgggaacccggtaaaaccggggtaaacccggtaaacggggttaaacgggtaaaacgttaaccggtaaaaacccggtaaacggttacgggtacgggttaccgtaccggtaaccctaacccgtaacgttccgtttaacccgg

SEQ ID NO: 287483 - DNA, 796 bp, Homo sapiens
  misc_feature: GYAE6OF01CZ3AJ.6.19.B08.1.454.CMB.1.raw
  modified_base (213)..(213): a, c, t, g, unknown or other
  misc_feature (213)..(213): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccggaggtgccagatgtgacatccagatgacccagtctccatcctcctgtctgcatctgaggacacagatcaccatcacttgccgggnaagtcagagcattagctacttatttaaatggtatcgaaggagaatccgaaggggaaactccccctaaaatcctagatctaatgatgactactccacgtttgactaaaagggtcgggtacccaagtccgtaaaggtttccagtagggtacaagggttggaacgtcgtggggaacctaaggttacttttcgaaccttcctacgtaacctacttcgaaacgtcgtaaggttacccttacggtaacctaaaacccgtttgggtaaaaacgtttacgttttttacggaacccttaaaacccggtttttactaaacccgtttacggttaaaccctaaaaaccggttaggttaaaaccgttttaaccggtaacgggttaccccgtcccccccgttaaaggggggttaacccccggttttaccgggaaacccgggtaaaaaccgggggtaaaccccgggtaaaaagggggtttaaaccgggtaaaaaacggttaacccggtaaaaaacccggttaaacccgggttacggggtaaaccggtaccggtttaacaaccccccggtaaaccgtaacgtttcccgtttaacccggg

SEQ ID NO: 287484 - DNA, 571 bp, Homo sapiens
  misc_feature: GYAE6OF01AFO0L.6.19.B08.1.454.CMB.1.raw
  modified_base (275)..(275): a, c, t, g, unknown or other
  misc_feature (275)..(275): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcaccttaatttaaattggtatcgaggagaatccgaagggaaacncccctaaaactcctagatctaatgatgcatcctactttgactaaagtcgggtaccagtctaaaggttcaaggtggacaggtggagtcgtagggacagtatttcactcacaccatcagcagtctgacctaactagtaagtatttcgactaacttactactagtacaacgtagtacgttactcggtaccgtccccgtaggtaccgttccgggaccgaaacggggacctaaacgggtacggtaaactaaccgaaaaccgtacgtaggtacggtcgtacgacctacccgtatccgttacg

SEQ ID NO: 287485 - DNA, 773 bp, Homo sapiens
  misc_feature: GYAE6OF01BVHRA.6.19.B08.1.454.CMB.1.raw
  modified_base (268)..(268): a, c, t, g, unknown or other
  misc_feature (268)..(268): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaatggtatcaggagaatccgagggaaacncccctaaactcctagatctatgatcgacatcctactttgacgtaaaggtcggggtaccctaagtaccgtaaaggtttcgaaggttgggacgtaggttgggtaacttcggtacggggaactaacggttaactttttaccgaaccgtttccttaccctaaccctaacgtttacccgaacggtacccgtaacggttcccgtttaacggaaccccgttaaacccgtttaagggtaaaacgtttacttttttacggaaccctttaaaccttttaaccttaaccgtttacgttaaccgtaaacgtaacggttaacggtttaaccgtaacggttaccccggtacccccggttaccggggtaacccggtttcccggggaaaccccggtaaaccgggggtaaacccggtaaacggggtaacgggttaaaaaccgtaaccggtaaaaacccgggtaacccgttacgggttaacggtccgttacggaacccgtaaccctacgttccgtttaaccgg

SEQ ID NO: 287486 - DNA, 713 bp, Homo sapiens
  misc_feature: GYAE6OF01D3E6E.6.19.B08.1.454.CMB.1.raw
  modified_base (272)..(272): a, c, t, g, unknown or other
  misc_feature (272)..(272): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtcctccactccctccctgtctgcatctgtaggacacagacgtcaccatcacttggccgggacaagtcagagctattagctaaccttaattttaaattggtatacgaaggaanaacgtaccgaagggaaacgtacccctaaaactcctagacttactatgatgactactcctactttagacgtaaacggtcgggtaccaagtacgtaaggttcaggtacggcgtaggtggtacgttacgtacgggtaactaggtactttacctaccttcctacccaactactacgacggtacctaggtacctaccggtaacctaaccgttaggtaaacgttttaccgttttacgaacccttaaacttttaccgtaaccgttaaccgttaaccgaaaaccgttagggttaaaccgttaaccgtaacgggttcccggtacccccgtacgggttacccgttaccgggacccgtaaaccggggaccgtaaacggggtaacgaaaacttaacccggtaaaacggaaccgttaggcggtaccttacggaacccttaacgcttccgttacg

SEQ ID NO: 287487 - DNA, 634 bp, Homo sapiens
  misc_feature: GYAE6OF01B2EYF.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatccctccctgtctgcatctgtaggacacagagtcaccatcacttgccggcaagtcgagagcattagctaaccttaatttaaattggtatcgaggagaataccgaagggaacgacccctaaactcctagatctatgatgctaaaaactcctacttgacgtaacggtcgggtacctagtacgtaaggttacgaggtggacgaggtaggtagtacgtagggacgtagtactttactacttcctaccacctatacacgtacgtacgtctacgtacctaaccgtaggtaacgttagttttacgtaaccttaactttaactaaccttacgtaactaacgtagtaacgttacgacgttaccgtaccccggttacggtaccggttaccggaccggtaaaccgggaaccgtaaggtaacggtaaagtaaccgtaaaccgtaacgtacggtacgtacgtacgaccactacgttcgttacg

SEQ ID NO: 287488 - DNA, 591 bp, Homo sapiens
  misc_feature: GYAE6OF01EYVI5.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttcgccgggcaagtcagacgctaattagctaaccttaatttaaattggtaatcgaaggagaatccgaagggaaacgacccctaaatcctgactctatgatgactactcctatttgacgtaaaggtcgggtacctaatcgtaaggttcagtgcaggtggatcgtggactagtattcactctcactatcagctagtctgacctaactgtaacttatttacgaccttaactttactactacgtacaaactagtaacgttacgtacgttccgtaccccgttacggtaaccggttccggaaccgtaaacgggaaccgtaaagggttacggaaaactacggaaaaccggtaacgtcgtacggtaccgttacgaccaccgtagtccgttacg

SEQ ID NO: 287489 - DNA, 550 bp, Homo sapiens
  misc_feature: GYAE6OF01AYXTK.6.19.B08.1.454.CMB.1.raw
  modified_base (372)..(372): a, c, t, g, unknown or other
  misc_feature (372)..(372): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacgcccctaaactcctgatctatgatgcatccatttgctaaagtcgggtcccaatcaaggttcagtggcagtggatcgtgggacagtatttcactctcaccatcancagtctgccaacctgaatattttacgctaaacttactaccttgtaaccaactacgtagttaccgagttccgccccgtacgggtaccgttccgggaccgaaacgggtaccgtaaagggtacggtaaataccgaaaacggaccgttaggacggtactacggactaacccgtattcgtacg

SEQ ID NO: 287490 - DNA, 571 bp, Homo sapiens
  misc_feature: GYAE6OF01EOL99.6.19.B08.1.454.CMB.1.raw
  modified_base (413)..(413): a, c, t, g, unknown or other
  misc_feature (413)..(413): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcaccttaatttaaattggtatcaggagaataccgaagggaaacgcccctaaactcctgatctatgatgctatcctatttgactaaaggtcgggtacccagtacgtaaggttcaggtggcaggtggatcgtgggacagtatttcactctacaccatcagtcagtctgaccaaccgtagtaagtntttagactaactttactactagtactaacgtagtacgttacacggttccgtccccgtacgggtaccggttacccggaccgaaacggggaaccgtaaagggtacggtaaataaccgaaacgtaacgtggtaccgtcgtacgacctaccgtctcgttacg

SEQ ID NO: 287491 - DNA, 659 bp, Homo sapiens
  misc_feature: GYAE6OF01DF5AA.6.19.B08.1.454.CMB.1.raw
  modified_base (229)..(229): a, c, t, g, unknown or other
  misc_feature (229)..(229): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtcctccatccctccctgtctgcatctgtaggacacagagtccaccatcacttggccgggacaagtcaganctattagcaacttatttaaattggtatcgaggagaatccgaagggaacctaccccttaaactcctagactcttagtagtatgactactcctaactttgacgtaaaggtccgggtacctatacgtaaggttcaggtcggacgtaggtaggactcggtagggtactaagttactttaccaccttctaccacctatcgagtctagtctcgacctaacgttagtaagttacgtttacgaccttaactttactacgttacgtaaccgtaactaaggttacgttaccgtacggtcccgtaccccgttacgggtacccggttaccgggaaccggtaaaccggggaaccgtaaacggggttaacggaaaattacccggaaaacggtaaacgttgggtaacggtacctacgggacccttaacgtaacgttcgttaaccg

SEQ ID NO: 287492 - DNA, 728 bp, Homo sapiens
  misc_feature: GYAE6OF01CX1BL.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctcctgtctgcatctggtaggacacagagtcaccatcacttgccggacaagtcagagcaattagctaacttaatttaaagttggtaatacgaaggaagaactaccgaaggggaaaaccaccccgttaaaactccctagtaacttactagtagactcggacctaacttcccctaacgttttcggaaccggtaaaacggttcggggtacccctaagtaccgtaaagggtttccgaaggttcgggctaaggtcgggtaactcggtaggggaactaaggttactttaccacccttcgtacccaaccctaacgtaccgaagtacctaggtaccttcgaacccgtaaccgtaggtaaagttacttttacgaacttaaaccgttactaacgttacgtaccaaagtacggtaacgttacgacggtccgtacccccgttacggggtaccgttacccgggaaccgtaaaccggggtaacgaaacgggttaaacggaaacgttaaccgtaaaaccggtaacggttacgacggtaccgttaacggacccgttaacccgtgttcccgttaacg

SEQ ID NO: 287493 - DNA, 591 bp, Homo sapiens
  misc_feature: GYAE6OF01CENBZ.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggacaagtcagagcattagcaccttatttaaattggtatcaggagaatccgaagggaaacacccctaaactcctagatctatgatgcatcctactttgacgtaaaggtcggggtacccagtacgtaaggttcgaggtggactaggtggtagtcgtagggactagtactttcacttctacacctatcgagactagtctcgacctaacgtagtaacgtattttacgaccttaaactttactaacttgtaacctaacgtagtaacgtttaccgacgttaccgtccccgttacggtaccggttaccggaccgtaaacgggaaccgaaggtacggtaaatacggaaacgtacgtaggtacggtactacgacacctacgtcttacg

SEQ ID NO: 287494 - DNA, 690 bp, Homo sapiens
  misc_feature: GYAE6OF01DOXW1.6.19.B08.1.454.CMB.1.raw
  modified_base (95)..(95): a, c, t, g, unknown or other
  misc_feature (95)..(95): n is a, c, g, or t
  modified_base (674)..(674): a, c, t, g, unknown or other
  misc_feature (674)..(674): n is a, c, g, or t
tcagatatcgcgagcacgaccggtgctcgatttagtgagtcagtaagggggagtcagtctcagtcaggacacagcatggacatgagggtccccgntcagctcctggggctcctgctactctggctccgaggtgccagatgtgacatccagatcgacccagtctccatccctcctgtctgctatcgtggtacggacacgagacgtaccaaccatcacgtttcggaccgggacaagtcaaggacgctaagttacgacctaaccttaattttaaacgttggtaatacgaggtaagaacgttaccggaagggaaaccgtacccctaaacgtccgtagtacttactatgtatcgactacttacctacgtttcgaacgtaaacggtcgggtaccctagtacgtaaggttcgaggttggacgtaggtggtacgtgtacgggactaggtactttcgacttctaccgactacacgacgtactacgtctaacgtaccgtaacgtagttaacgttactttacgaaccttaacttacgtaccttactaccaaacgtaggtaacgttaacgtccgtacccgtaccccgttagggtaccggttaccgaaaccgggtaaccggtaacggtaaacgggttaacgaaacgttaacggaaaccggttacgtcggtacggtccaggtaacccncgttaagtcgttaccg

SEQ ID NO: 287495 - DNA, 576 bp, Homo sapiens
  misc_feature: GYAE6OF01CD7H1.6.19.B08.1.454.CMB.1.raw
  modified_base (406)..(406): a, c, t, g, unknown or other
  misc_feature (406)..(406): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatccctccctgtctgcatctgtaggacacagagtcaccatcacttgccgggcaagtcagagcattagcaccttatttaaattggtatcagagaatcagggaaacgcccctaaactcctgatctatgatgcatccactttgactaaaggtcgggtacccagtcgaaaggttcaggtggctaggtggactcgtgggactagtactttcacctctcaccatcagcagtctgactaacctgaaattntttacgacctaaaccgtttactacgttacgtaacctaacgagttaacgttacacggttccgtaccccgttaccggaaccggttccggaaccgaaccgggtaaccgaaagggtacgaaagtaaccgtaaacgaacgttggtacggcgtacgaccaaccctagtcgttaccg

SEQ ID NO: 287496 - DNA, 747 bp, Homo sapiens
  misc_feature: GYAE6OF01BBY80.6.19.B08.1.454.CMB.1.raw
tcagatatcgcgagcacgaccggtgctcgatttagtgagtcagtaaagggggagtcagtctcagtcaggacacagcatggacatgagggtccccgctcagctcctggggctcctgctactctggctccggaggtgccagatgtgacatccagatgacccagtctccatccctccctgtctgcatctgtaggacacagagtcaccatccacttcggccgggacaagtcagagactattacgactaaccttaatttaaagttgtatacgaggagaactaccgaagggaaacctcccctaaactccgtagtatactagtagatcgtactacgttacctacgtttacgacgtaaacgggtcgggtacccctaagtacgtaaggttcgtaggtcggtacgtaggtggtacttacggtagggaactagtaccttttacacgttacctacctaaccctagtaccgaacgtcgtaaccggtttccgtaaccgaacccgttaaacccgttaagggttaaaaccttttacgtttttaccggaaaccctttaaacttttaacccgttaacgtttaacgtaacccgtaacgtaaacggttacgttaaccgtaccgggtccccgttacccccggttacgggtaaccccggttaccgggaaccgggtaaaccgggtaaccggtaaacgggttaacggtaaacgtaaacccgtaaacggtaacgttcggacggtcgtacgaccctaacgtccgtagttaccg

SEQ ID NO: 287497 - DNA, 637 bp, Homo sapiens
  misc_feature: GYAE6OF01D4R27.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttcggccgggacaagtcagagctattacgactaaccttaattttaaattggtaatcgaaggaagaataccgaaggggaaaccgtaccccctaaaactcctagtactctatgatcgactactcctactttagacgtaaggtcgggtacccagtacgaaggttcagtggctaggtggatcggtagggactagtactttcactctacaccatcagactagtctagacctaactagtaagttattttacgaccttaactttactacttacgtaacctaaacgtagtaacgttacacgttcccggtaccccgtacgggtaccggttacccggaaccggtaaacgggaacccggtaaagggtaccggtaaacgtaacgtaaaaccggtacggttcggtacggtacgtacgtacccgtaacccttgttccgttaccg

SEQ ID NO: 287498 - DNA, 896 bp, Homo sapiens
  misc_feature: GYAE6OF01EL4EU.6.19.B08.1.454.CMB.1.raw
  modified_base (219)..(219): a, c, t, g, unknown or other
  misc_feature (219)..(219): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatccattcggccggganaagtcagacgctaattacgacctaacctttaattttaaaagttgggtaattaccgaagggtaagtaaacgttacccggaaagggggtaaaacccgtacccccccttaaaaacgttccccgttaggtaacttaccgttaagttacgtaagttcggtacctaacttaccccgttaacgttttacggaaccgtaaaacgggttcggggttaacccctaagttaccggtaaaacgggtttccgagggttacgggtacctaagggttcgggtaacttcgggtaggggtaacctaaggttacttttacccgaacctttacccgtaaccctaacccgtaattaccgaacggtaccgttaaacggttcccgtaacgggtacccctaaaacccgggtttaggtaaaaccggttttactttttaccggaaaccctttaaaccttttaaccttaacggttacgttaaccctaaacgtaccggtttaaacggttaaccgtaccggtttacccgggtaccccccggttacggggttaaacccggttcccgggaaacccgggtaaaccggggtaaacccggttaaaggggtaaaccggtaaaacttaaacccgggaaaaaaccggttaaccggttcgggtaccggtaacccgttaggtaacccctaaccgttaaagttcccggtttaaccg

SEQ ID NO: 287499 - DNA, 585 bp, Homo sapiens
  misc_feature: GYAE6OF01BIN3J.6.19.B08.1.454.CMB.1.raw
  modified_base (274)..(274): a, c, t, g, unknown or other
  misc_feature (274)..(274): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagctaccttaatttaaatggtatcgaggagaatccgaagggaaacncccctaaactcctagatctatgatgcatcctactttgacgaaggtcgggtacccagtactaaggttcaggtggactaggtggattcggtaggactagtacttcactctcacatcagctagtctagacctaaccgtagtaacgttattttacgacttaacctttactacttagtacaactagtacgttacacggttccgtccccgtacggtaccgttaccggaccgtaaagggaacccgtaaagggtacggtaaacgtaccggaaaacggtacgtggtacggtactacggaccctaccgtacttcgttaccg

SEQ ID NO: 287500 - DNA, 609 bp, Homo sapiens
  misc_feature: GYAE6OF01DSPYX.6.19.B08.1.454.CMB.1.raw
  modified_base (603)..(603): a, c, t, g, unknown or other
  misc_feature (603)..(603): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtccaccatcacttcggccgggacaagtcagagcaattagctaaccttaatttaaattggtatcaaggaagaactccgaagggaaacgtacccctaaaactcctagtatactatgatgcattacctattttcgacgtaacggtcgggtccatacgtaaggttcaggtggacaggtggactgtacgggatacgtatttccgactctacactatcaagcctaagtcctgtactaaccgtagtaagttacgtttacgaacttaacctttaactacttaacgtaactaacgaaggttacgttaacgacgttccgacccccgttgggtacccggttacggacccggaagggaccgaaaggttacgaaataccggaaagtaccgttaggtacgaccgtagacctacgtcgttnttaccg

SEQ ID NO: 287501 - DNA, 619 bp, Homo sapiens
  misc_feature: GYAE6OF01D9WFE.6.19.B08.1.454.CMB.1.raw
  modified_base (611)..(611): a, c, t, g, unknown or other
  misc_feature (611)..(611): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagctacctatttaaatggtatcaggagaactccgaagggaaacgtcccctaaactcctgactctatgatgctactcctactttgacgtaaaggtcgggtacccatacgtaagggttcaggtgcgtaggtggatcgtagggtaactaggtactttaccacgttcctacctacccaatccgaacgtctaggttcctagaccctaaccgtgtaaacgttacttttacggaaccttaaactttacctacttacgtaacctaacgtaggttaacgttacgacggttccgtaccccggtacgggtaccgttcccggaaccggtaacggggaaccgtaaagggtacgtaaaacgtacgaaaacgtacgtggtacggtctacgacctactntcgttacg

SEQ ID NO: 287502 - DNA, 761 bp, Homo sapiens
  misc_feature: GYAE6OF01AEMYV.6.19.B08.1.454.CMB.1.raw
  modified_base (95)..(95): a, c, t, g, unknown or other
  misc_feature (95)..(95): n is a, c, g, or t
  modified_base (218)..(218): a, c, t, g, unknown or other
  misc_feature (218)..(218): n is a, c, g, or t
tcagatatcgcgagcacgaccggtgctcgatttagtgagtcagtaagggggagtcagtctcagtcaggacacagcatggacatgagggtccccgntcagctcctggggctcctgctactctggctccgaggtgccagatgtgacatccagatgacccagtcctccatccctcctgtctgcatctgtagacacagacgtcaccatcacgttggccgggnaaggtcaggagctaattacgctaccttaatttaaattggtaatcaggagaatccgaagggaaacgcccctaaactcctagatctatgatcgacactcctaactttgaacgtaaaggttccggggtaccctaagtacgtaacgggtttacaggtaggcgtaggtgggtactcggtaggggaactaggtacttttccacgttccttaccaaccctagttacacgtacctacgttccgtacgtaccctaaccgttaggtaaacgttacgtttttacgaacctttaaaccgtttaaccttaaccgttaggtaaccctaaaccgtacggttaacggtttaaccgtacggttcccgtaccccccggttacggggttaaccccgggttacccgggaacccgggtaaaacggggttaccccggtaaaaggggttaacccgggtaaaaagttaaccccgggtaaaaaacggtaacccgtttaggggtaacccggttacccggttaacggtaaaccccgtaaccccgttaaacgttttcccggtttaacccgg

SEQ ID NO: 287503 - DNA, 583 bp, Homo sapiens
  misc_feature: GYAE6OF01D4YUN.6.19.B08.1.454.CMB.1.raw
  modified_base (252)..(252): a, c, t, g, unknown or other
  misc_feature (252)..(252): n is a, c, g, or t
  modified_base (263)..(263): a, c, t, g, unknown or other
  misc_feature (263)..(263): n is a, c, g, or t
  modified_base (412)..(412): a, c, t, g, unknown or other
  misc_feature (412)..(412): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctcctgtctgcatctgtaggacacagagtcaccatcacttgccgggcaagtcagagcattagcacttatttaaatgtatacaganaatcaggaacnccctaactcctgatctatgatgctatcctactttgactaaaggtcgggtaccatacgtaaacggttcgagtggctaggtggatcgtagggactagtactttacacttctacacctatcagctaggtctacgacctaacgtgaaacgttnttttacgaccgttaacttactacttagtaacaacgtaggtaacgttaccaggttaccgtaccccgtacgggtaccgttccgggaaccggtaaccgggaaacggtaacgggtaaggtaaacttaacgaaaacggtaacgtaggacggtacaccgtacaacctacttcgtacg

SEQ ID NO: 287504 - DNA, 594 bp, Homo sapiens
  misc_feature: GYAE6OF01BU82N.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccaagggaaacgcccctaaactcctgatctatgatgcatccactttgactaaaggtcgggtccatcgaaggttcagtggcagtggatcgtgggacagtatttcactctacaccatcgagcgtagtctcgactaaccgtgtaaagttattttacgaccttaaactttacctaacgttacgtaactaacgtaacgtagttaaccgtacgttcccgtacccccgttacgggtaccgttacccgggacccgtaaacggggaaccgtaacgggtaacggtaaacgttaaccgaaaacggtaaccgtggttacggtcctacggtaccaacccgtgtcgttccg

SEQ ID NO: 287505 - DNA, 596 bp, Homo sapiens
  misc_feature: GYAE6OF01BRDRL.6.19.B08.1.454.CMB.1.raw
  modified_base (359)..(359): a, c, t, g, unknown or other
  misc_feature (359)..(359): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcaccttgcccgggcaagtcagagcattagctacctatttaaattggtatcaggagaatcgaaggaacaccctaactcctagatctatgatgcatctactttgacaaaggtcgggtaccagtcgtaaaggttcaggtggacaggtgatcgtaggganacgtatttcactctacaccatcagtcagttctagtaccaacgtagtaagttattttacgacctaaacgtttactaccgttagtactaagtaacgtacgttaacgacgttccggtaccccgtacgggacccgttacgggaccgtaaaggggaacccgtaagggttaccggaaagtaaccggtaaaacggtaacgttacgggtacgtacggtacgtaaccgaaccttcgtacgttaccg

SEQ ID NO: 287506 - DNA, 536 bp, Homo sapiens
  misc_feature: GYAE6OF01A63K7.6.19.B08.1.454.CMB.1.raw
  modified_base (270)..(270): a, c, t, g, unknown or other
  misc_feature (270)..(270): n is a, c, g, or t
  modified_base (530)..(530): a, c, t, g, unknown or other
  misc_feature (530)..(530): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccaagggaaacncccctaaactcctagatctatgatgcatcctactttgactaaaggtcgggtaccagtcgaaggttcagtggctagtggatcgtgggacagtatttcactctcaccatcagcagtctgacctaacctagaagtattttcgactaacttactactcgtacaacgtagtacgttacacgtccgtccccgtacggtaccgttccggacgaaacgggaccgaaggtacggaaatacgaaacgacgtggacggtctacgaccactntcgtcg

SEQ ID NO: 287507 - DNA, 565 bp, Homo sapiens
  misc_feature: GYAE6OF01BT4AK.6.19.B08.1.454.CMB.1.raw
  modified_base (270)..(270): a, c, t, g, unknown or other
  misc_feature (270)..(270): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccgagggaaacncccctaaatcctgatctatgatgctatccactttgactaaaggtggggtcccagtcgaaaggttcagtggcaggtggactcgtgggacaggtatttcactctacaccatcagcagtctgactaacctgaagtattttcgactaacttactactgtacaacgtagtaagttacagtccgtaccccgtacgggaccgttaccgggaccgtaaacgggaaccgtaacgggtacggaaaataccggaaaacgtaaccgttaggtacggtacttacggacctaacccgtattccgttacg

SEQ ID NO: 287508 - DNA, 557 bp, Homo sapiens
  misc_feature: GYAE6OF01EWZL6.6.19.B08.1.454.CMB.1.raw
  modified_base (285)..(285): a, c, t, g, unknown or other
  misc_feature (285)..(285): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcacctatttaaatggtatcaggagaatccgaggaaacgcccctaaactcctganctatgatgcatcctactttgacaaaggtcgggtccatcaaggttcagtggcagtggatcgngggacngtatttcactctcaccatcagcaagtctgaccaacctgaagtatttgcctaaactttacctacgtacgtaccaactagtattaacgacgtaccgtcccccgtacgggtaaccggttccggaccgtaaacgggaacccgtaaaggtacgggaaaacttacgaaaaccggtacgttaggtcggtacgtcgaccaacctagtcttacg

SEQ ID NO: 287509 - DNA, 726 bp, Homo sapiens
  misc_feature: GYAE6OF01C3L70.6.19.B08.1.454.CMB.1.raw
  modified_base (265)..(265): a, c, t, g, unknown or other
  misc_feature (265)..(265): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatcgacccagtctccatccctccctgtctgcatctgtaggacacagagtcaccatcacttcggccggataagtcagagctatacgctaactatttaaattggtatcgaaggaanaacgtaccgaaggggtaaacaccccctaaaatccctagtactactagtgatcgactactcctagtttagacgtaaacggtcgggtaccctagttacgaaaggttcagtacggcgtagtaggtacgttacggtcgggtaaactaggttatttaccaaccttcttaaccgaacctacgttaccgaaacgttcgaacgtttaccgaacgtaaccgtaacccgttagtaacggtttatttaccgacttaacctttactaacgtagttaccaagtacgtaacggttaccacggttacccgtccccggttaggtaaccggttcccggtaaaccggtaaaccggggtaaaccggtaaacgggttaaaaccggtaaaaccgtaaaccggtaaaaaccccgtaagggtttaccggttacccgggaaccttaccgtaaaccccgacccgttaaaggtttcctttaccccgg

SEQ ID NO: 287510 - DNA, 848 bp, Homo sapiens
  misc_feature: GYAE6OF01BL8QM.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctcctgtctgcatctgtaggacacagagtcaccatcacttcggccgggacaagtcagacgctattacgactaccttaattttaaattggtaatacgaagggaagaacgtaccgaagggaaaccgtaccccctaaaacttccgtacgtacttactaagtggaactcggtacacttccctacgtttacgacgtaaaacgggtcgggtacccctaacgttaccgtaaacggtttaccgaagggttacggacggtaaggtacggtaacgttaccggtacggggtaaccttaacggttacttttaccctaaccttacccgttaccgaaccctacgtaccgtaacgtaccgtaacggttaccttaccggtaacccgtaaaccgtttaacgggttaaacgttacgttttttaccggaacctttaaaaccgttttaacccgtttaaccgtttaaccggttaacctaaacccggttaaacggttaaaccgggttttaaccgtaaccgggttaccccggttacccccggttaccgggttaaccccgggttacccgggaacccgggtaaaaccggggtaaccccggttaaaacggggttaaccgggtaaaacgttacccggtaaaaaccggtaaccgttacgggtaccggtaccggtacgtaacccgtaacccgttacgttcgttaacccg

SEQ ID NO: 287511 - DNA, 551 bp, Homo sapiens
  misc_feature: GYAE6OF01D2K7X.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcactatttaaatgtatcaggagaatccgagggaaacgcccctaaactcctgatctatgatgcatcctatttgacgtaaaggtcgggtccagtacgaaggttcagttggcaggtgatcgtgggacagtatttcactctcacctatcagtcagtctcgacaacctgaagtattttgacctaaacttactacgttagtaccaaacgtagtagttacagttccgtacccccgtagggtaccggttccggacccggaaagggtaacccgagggtaacggaaactacgaaaccgtaacgttggacggtcacgccaacctgtcttcg

SEQ ID NO: 287512 - DNA, 743 bp, Homo sapiens
  misc_feature: GYAE6OF01BPDWY.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtgggctcctgctactctggctccgaggtgccagatgtgacatccagatcgacccagtctccatccctccctgtctgcatctgtaggacacagagtcaccatcacttcgccgggacaagtcgagagctattacgactaaccttaattttaaagttaggtacttacgaaggaacgaagtaccgaagggtaaaccgtaccccttaaaacgtcctagtactacgtatgatcgactactacctacgtttagaccgtaaaggtcgggtaccctaagtacgtaaacgggtttcgaggttacggacgtagggtacggtacgttaccggtagggtaaccttaaggttacctttaccgtaaccttcccgtaccgtaaccctaacgttaccgaacggtcgtaacgtctaaccgaccttaacccgtaggttaaacgtttacgttttacgaaccctttaaactttaacgtaccgttacgtaaaccgtaaacgttacggttaaaccgtttaacgtaccggttacccggtaccccgttacgggtaacccgtttaccgggaacccgtaaacgggtaacccgtaagggtaacgaaacttaacccggaaacggtaccgtaggtacggaccgtacgaaccgacctacgtccgttaccg

SEQ ID NO: 287513 - DNA, 549 bp, Homo sapiens
  misc_feature: GYAE6OF01DO3FH.6.19.B08.1.454.CMB.1.raw
  modified_base (95)..(95): a, c, t, g, unknown or other
  misc_feature (95)..(95): n is a, c, g, or t
  modified_base (336)..(336): a, c, t, g, unknown or other
  misc_feature (336)..(336): n is a, c, g, or t
tcagatatcgcgagcacgaccggtgctcgatttagtgagtcagtaagggggagtcagtctcagtcaggacacagcatggacatgagggtccccgntcagctcctggggctcctgctactctggctccgaggtgccagatgtgacatccagatgacccagtctccatcctccctgtctgcatctgtaggacacagagtcaccatcacttgccggcaagtcagagcattagcactattaatgtatcaggagaatccgaggaacgccctaaactccagatctatgatgcatcctactttgacaagtcgggtaccatctaaggttcagtgcagtgatcgngggactagtatttacactctacaccatcagcagtctagacctaaccgtgtaaacgttattttagaccttaacgtttactacttcgtaactaacgtagtaagttacgacgttcgccccgttacggtacgttaccggacgaagggaccgtaagggtacggaaaacttacgaaaacggtaacgtggtacgtacgtacaccgtaaccagttcgtacg

SEQ ID NO: 287514 - DNA, 504 bp, Homo sapiens
  misc_feature: GYAE6OF01BQCBX.6.19.B08.1.454.CMB.1.raw
  modified_base (268)..(268): a, c, t, g, unknown or other
  misc_feature (268)..(268): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaancccctaaactcctgatctatgatgcatccactttgctaaaggtcgggtaccatcgaaggttcagtggcagtggatcgtgggacagtatttcactctcaccatcagcagtctgacaaccgtgaagtattttcgactaactttactactgtacaacgagtagttacagtcgccctcggacgtcggaccgaaggaccgaaggtcgaatcgaaacgactagcgtctcgacactgtcgtcg

SEQ ID NO: 287515 - DNA, 685 bp, Homo sapiens
  misc_feature: GYAE6OF01C74US.6.19.B08.1.454.CMB.1.raw
  modified_base (217)..(217): a, c, t, g, unknown or other
  misc_feature (217)..(217): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatgacccagtctccatcctccctgtctgcatctgtaggacacagagtccaccatcacttggccggnaagtcagagcattagcaacttatttaattggtatcgagagaataccgaggaaacgcccctaaactcctgatctatagatgctactacctactttgaacgtaaggtcgggtaccagtacgtaaggttcaggtggacgtaggtggactcggtagggactagtactttacgacttacctaccaccctaattcaacggtcctaacgttccttaacggaccctaaccgttagtaaacggtttacttttacggaacccttaaacgtttacctaacgttcgtaacctaaacgtaaggtaaacgttttaccgaacggttaccgtacccccgttacggggtacccggtttacccgggtaacccggaaaccggggtaaccgtaaacggggttaaacggtaaaacgtaacccgtaaaacggttaaacccgttgggtacgggtaccttacgggtaccctaacccggtattcccgttaccg

SEQ ID NO: 287516 - DNA, 564 bp, Homo sapiens
  misc_feature: GYAE6OF01DO86I.6.19.B08.1.454.CMB.1.raw
  modified_base (224)..(224): a, c, t, g, unknown or other
  misc_feature (224)..(224): n is a, c, g, or t
  modified_base (409)..(409): a, c, t, g, unknown or other
  misc_feature (409)..(409): n is a, c, g, or t
tcagatatcgcgagcacgaccggtgctcgatttagtgagtcagtaagggggagtcagtctcagtcaggacacagcatggacatgagggtccccgctcagctccgtgggctcctgctactctggctccgaggtgccagatgtgacatccagatgacccagtcctccatccctccctgtctgcatctgtagacacagagtcaccatcacttgccggcaagtcagancattagcacttattaatgtatcaggagaatcaggaacgccctaaactcctgatctatgatgctatcctactttcgacgtaaaggtcgggtcccatacgaaggttcaggttggctaggtgatcgtaggactagtatttcactcctacacctatcgaagtcagtctagacctaaccgtgtaaagttntttagaccttaaactttacttaacgtagtaacaacgtagtacgttacgacgttccgtccccgttcgggaccgtttaccggaccgaaacgggaccgtaaggtacggaaatacgaaaacctaacggtgtacggctacaccgtaacctgttcgttacg

SEQ ID NO: 287517 - DNA, 656 bp, Homo sapiens
  misc_feature: GYAE6OF01EFA70.6.19.B08.1.454.CMB.1.raw
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtctccactccctcctgtctgcatctgtaggacacagactcaccatcactgccggnaagtcagnctagtagcacttaatttaagttgtatcgagagatccgaaggaacgaccctaactccgtagatactatgatcgactactcctactttgacgtaaaggtccgggtaccagtacgtaaggttcgagtggctaaggtcgactcgtaggactagtacttcgactcacacctatcgacgctacggttactacgaccctaacgtagtaaagtttacttttacgaacctttaaacgtttaacccgttacttacgtaacgtaaagtaacgtacgtttaaccgacgggttccgaccccccgggttaagggtcccggttaaccggaccccgggtaaacgggtaaacccggttaaacggggtaacgtaaaacttaaccggaaaaccggtacgttaaacggtccgggtacctaccgggtacctaacggttcttccgtttaacccgg

SEQ ID NO: 287518 - DNA, 604 bp, Homo sapiens
  misc_feature: GYAE6OF01D14AH.6.19.B08.1.454.CMB.1.raw
  modified_base (234)..(234): a, c, t, g, unknown or other
  misc_feature (234)..(234): n is a, c, g, or t
  modified_base (454)..(454): a, c, t, g, unknown or other
  misc_feature (454)..(454): n is a, c, g, or t
  modified_base (598)..(598): a, c, t, g, unknown or other
  misc_feature (598)..(598): n is a, c, g, or t
tcagatatcgcgagcacgaccggtgctcgatttagtgagtcagtaagggggagtcagtctcagtcaggacacagcatggacatgagggtcccccgctcagctccgtggggctcctgctactctggctccgaggtgccagatgtgacatccagatcgacccagtcctccactccctccctgtctgctatcgtggtaggacacgagacgtaccaaccatcctacgttcggccgganaacgtcagagcagttacgactaacttaatttaaagtgtaatacgaaggaataacgtaccgaaacgggaaacctacccctaaactcctagtactactaagtgatcgactacttcctaacgttcgaacgtaacgggtccggtacctagtacgtaacgttcgaggtgacgtaggtggtacgtacggacgggatagttacttaccacgttacctaccgacctancgtacgtacgtacgtcgtacacctaacgtataggttacttcgaacttacttatactagaactagagtacgtacgactccgccctaggacgtacgacggacgaacgagtaacgaatacgaacgacgtgtacgctaggacctagtntcgtac

SEQ ID NO: 287519 - DNA, 829 bp, Homo sapiens
  misc_feature: GYAE6OF01BURS4.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatgacccagtcctccatccctcctgtctgcatctgtaggacacagacgtcaccatcacgttgccgggacaagtcagagcattagctaacttaatttaaattggtatcgaaggagtaactaccgaaggggaaaccacccccttaaaactccgtagtacttcctaagtcgtactcgacctacttcccttaacgttttacggaaccgttaaaacgggttccggggtacccctaagttaccggtaaacgggtttcgaagggttcgggacgtaagggttacggtacgttcgggtacgggtaactaacggttaccttttaccgacctttaccgtaccctaaccgtaattcccggaaggtacccgtaacgttaccgtacggaacccttaaaccgttagggttaaaccgttttacgttttaccgaaccctttaaacgttttacccgtaacttacggttaaccgtaaaacgtacggttaacgtttaaccgaccggttaccccggtacccccgggttacgggtaacccggtttaccggggaaaacccggttaaccggggaaaaccccggttaaaggggtaaaccggtaaaccgttaaaacccggtaaaacggttaccgggttaaccggttaccgggtacccttaaccgggtaaccccgttaacccgttacgtttccgtttaacccggg

SEQ ID NO: 287520 - DNA, 613 bp, Homo sapiens
  misc_feature: GYAE6OF01AMW0A.6.19.B08.1.454.CMB.1.raw
  modified_base (256)..(256): a, c, t, g, unknown or other
  misc_feature (256)..(256): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcaccttatttaaattggtatcagganaatccgaagggaaacacccctaaactcctagactctatgatgctactcctactttggacgtaaacggtcggggtacccaagttccgtaaaggttcaaggttggacgtaggtggatcgtagggactagtactttcacttctacacctatcacgtcagttctcgaccaaccgttagtaagttattttacgacttaactttactaacttagtaaccaacgtacggtaacgttaaccgacgttcccgtacccccgtacgggtaacccggttccgggaccgtaaacggggtaaccgtaaagggtacggtaaactaaccgaaacggtacgtaggtacggtacctagacctactcgttcgttcg

SEQ ID NO: 287521 - DNA, 746 bp, Homo sapiens
  misc_feature: GYAE6OF01D84ZN.6.19.B08.1.454.CMB.1.raw
tcagatatcgcgagcacgaccggtgctcgatttagtgagtcagtaagggggagtcagtctcagtcaggacacagcatggacatgacgggtccccgctcagctccgtggggctcctgctactctggctccgaggtgccagatgtgacatccagatcgaccccagtcctccactccctccctgtctgcatcgtggtaggacacagacgtccacctatcctacgttcggacccgggactaagtcaaggacgactaagttacgaccttaacctttaagttttaaagttggtaatacgaaggaagaacgtaccggaacggggtaaacctacccctaaactccgtagattctatgatcgactactacctagtttacgaacggtaacgggtccgggtaccctaagttaccggtaaggttcgaggtggaccgttagggtcggtacgttacgggtagggtaactacggtttactttacccgaccttaccgtaccctaaccgtaataccgtaccgtacgtacgtctaccggtaaccgtaaccgttaaggttaaacgtttcgttttaacgaaccctttaaacctttacgttaccggtacggttaacccgtaacgggttaaccgttaccgtaccgggttccccgtacccggttacgggtaccggttacccggaaccggtaacgggtaacgtaacgggtaacgaaaccgttacgaaacggtgtacggtcgacggtccacgtacctcgttcgtcgttacc

SEQ ID NO: 287522 - DNA, 623 bp, Homo sapiens
  misc_feature: GYAE6OF01CMMC7.6.19.B08.1.454.CMB.1.raw
  modified_base (214)..(214): a, c, t, g, unknown or other
  misc_feature (214)..(214): n is a, c, g, or t
  modified_base (222)..(222): a, c, t, g, unknown or other
  misc_feature (222)..(222): n is a, c, g, or t
  modified_base (249)..(249): a, c, t, g, unknown or other
  misc_feature (249)..(249): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggnaagtcagngcattagcactatttaatgtatcaganaatcgaggaacgccctaaactcctagatctatgatgcatcctactttgacgtaaaggtcgggtacccagtacgtaaggttcaggtggactaggtggatcgtagggactagtactttcactctacaccatcacgctagtctacgacctaaccgtagtaacgttacttttacgacctttaaactttaaccttaaccgttacgttaacctaaacgtaacggttaacgtttaaccgtacggttacccgtacccccggttacgggtaacccgggtttaccgggaacccggtaaacggggtaaacccgaaagggttaacggaaactaaccggaaaacggtaaccgtggtacggtaccgtacgacctacctagttcgttcg

SEQ ID NO: 287523 - DNA, 530 bp, Homo sapiens
  misc_feature: GYAE6OF01B9P6N.6.19.B08.1.454.CMB.1.raw
  modified_base (215)..(215): a, c, t, g, unknown or other
  misc_feature (215)..(215): n is a, c, g, or t
  modified_base (254)..(254): a, c, t, g, unknown or other
  misc_feature (254)..(254): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggnaagtcagagcattagcacctatttaaatggtatcagganaatccagggaagcccctaaatcctagatctatgatgcatccacttttgactaaaaggtcggggtcccatcgaaggtttcagtggctaggtggatcgtgggacagtatttcactctcaccatcagcagtctagcaacctgaagtattttagactaactttactactagtacaacagtaagttacagtcgtcccctcggaccgttcggaccgaacgggaaccgaaggtacggaaactacgaaacgaactaggtacggtactagaccacagtcgttacg

SEQ ID NO: 287524 - DNA, 592 bp, Homo sapiens
  misc_feature: GYAE6OF01B98SD.6.19.B08.1.454.CMB.1.raw
  modified_base (95)..(95): a, c, t, g, unknown or other
  misc_feature (95)..(95): n is a, c, g, or t
  modified_base (217)..(217): a, c, t, g, unknown or other
  misc_feature (217)..(217): n is a, c, g, or t
  modified_base (278)..(278): a, c, t, g, unknown or other
  misc_feature (278)..(278): n is a, c, g, or t
  modified_base (436)..(436): a, c, t, g, unknown or other
  misc_feature (436)..(436): n is a, c, g, or t
tcagatatcgcgagcacgaccggtgctcgatttagtgagtcagtaagggggagtcagtctcagtcaggacacagcatggacatgagggtccccgntcagctcctggggctcctgctactctggctccgaggtgccagatgtgacatccagatgacccagtctccatcctccctgtctgcatctgtaggacacagagtccaccatcacttggccgggnaagtcagagctattagcaccttaatttaaattggtatcgaggaagaatccgaagggaaacnccccgtaaactcctagatactatgatgacacttccctacgtttgacgtaaagggttcgggtacccagtacgtaaggttcaggttcggcgtaggtggactcggtagggactagtacttcactctaccaccatcagctagtcagaccaactaggtaattntttacgactaactttacactagtaccaagtagtacgttacacggttccgaccccgtaggtaccgttaccggaccggtaacgggaaaccggaagggtaacggtaaacgtaacgaaaccggtatacggtacggctacgaccacgtacgttcgttaccg

SEQ ID NO: 287525 - DNA, 754 bp, Homo sapiens
  misc_feature: GYAE6OF01A6RWN.6.19.B08.1.454.CMB.1.raw
  modified_base (603)..(603): a, c, t, g, unknown or other
  misc_feature (603)..(603): n is a, c, g, or t
  modified_base (661)..(661): a, c, t, g, unknown or other
  misc_feature (661)..(661): n is a, c, g, or t
tcagatatcgcgagcacgaccggtgctcgatttagtgagtcagtaagggggagtcagtctcagtcaggacacagcatggacatgagggtccccgctcagctccgtgggctcctgctactctggctccgaggtgccagatgtgacatccagatcgacccagtcctccactccctccctgtcctgctatctgtagacacagagtccaccatcctacgttcggccgggactaaacggtcaaggacgtactaatttacgacctaaccgtttaattttaaagtttaggttaacttcgaacgggaacgtaaacgtacccggtaaacggggtaaaaccgtaacccccctttaaaaacctcccgttaacggtaacttaccgttaagttcgtaaagtcggtacctaacgttaaccccttacgtttttacggaaccgttaaaacgggtttccggggtacccctaaaggttaccgtaaacggtttaccgtaaggtccgggtacgtaagggttacggtacttacggtaccgggtaactaacggtttactttacgtaccctccttacgacctactacgacgtactacgtacgtcgaacctaacgtacgtaaagttntttcgaaccttacttacgtacctacggtaaccaatacggtaacttacgaccggttacnccccggtagtacccgtaggtaacccgacggtaaccgagggtaaccaagttaccggaaactacggtcgtacgcgttacacctcaacgttgtacc

SEQ ID NO: 287526 - DNA, 704 bp, Homo sapiens
  misc_feature: GYAE6OF01DAHS9.6.19.B08.1.454.CMB.1.raw
  modified_base (542)..(542): a, c, t, g, unknown or other
  misc_feature (542)..(542): n is a, c, g, or t
tcagatatcgcgagcacgaccggtgctcgatttagtgagtcagtaagggggagtcagtctcagtcaggacacagcatggacatgagggtccccgctcagctccgtgggctcctgctactctggctccgaggtgccagatgtgacatccagatcgacccagtctccatccctccctgtctgcatctgaggacacagagtccaccatctacgttcggccgggacaagtcaagagactattacgactaacctttaattttaaaagttggtaatacgaaggtagaactaccgaaaggggaaacctaccccgtaaactcctagtactctatgatcgactacttacctacgtttcgaacgtaaggtcgggtacctagtacgtaaggtttcgaggtggacgtagggtggtactcgtagggaactagttacttccacttccgtacactatcgacgtcgtagtctagaccctaacttaggaaactttcgttttacgaacctttaaccttaaccgttacttagtaacctaaacgtaacggttaactttaccnccgggttacccggtacccccgttacggggttaacccgttacccggggaaccgggtaaacggggtaaccggtaaaggggttaaaaccgggtaaaacttaaccggaaaaacgttaccgggttggtaacggtacctaacggtacccaaccttgtttcccttacgg

SEQ ID NO: 287527 - DNA, 595 bp, Homo sapiens
  misc_feature: GYAE6OF01CL4OQ.6.19.B08.1.454.CMB.1.raw
  modified_base (143)..(143): a, c, t, g, unknown or other
  misc_feature (143)..(143): n is a, c, g, or t
  modified_base (165)..(165): a, c, t, g, unknown or other
  misc_feature (165)..(165): n is a, c, g, or t
  modified_base (258)..(258): a, c, t, g, unknown or other
  misc_feature (258)..(258): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccggaggtcgccagatgngacatccagatcgacccagtcnccatccctccctgtctgcatctgaggacacagatcaccatcacttggccggacaagtcagagcattagcacgttattaaagtggtatcagganaagtccgaagggaacacccctaaactcctagactctatgactgactatcctacttagacgtaaaggtcgggtacccagtaccgtaaaggttcaaggtcggacgtaaggtcgtaacgttcgagggaactagtactttaccaacttcctacaacctataccgagtacgtaacgttcgtaacgactaaccgtaggtaaattccgttttacactaaaccttatactacgtaacaacgtagtaacgtacgtacgtccgacccgtaggtaccgtcgaaccgacgggtacaaacggtgtaaacacgaaacgacttaggctacgtacaccacctattccgttacg

SEQ ID NO: 287528 - DNA, 571 bp, Homo sapiens
  misc_feature: GYAE6OF01EWFK4.6.19.B08.1.454.CMB.1.raw
  modified_base (275)..(275): a, c, t, g, unknown or other
  misc_feature (275)..(275): n is a, c, g, or t
  modified_base (564)..(564): a, c, t, g, unknown or other
  misc_feature (564)..(564): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttggccgggcaagtcagagcattagctaaccttaatttaaattggtatcaaggagaatccgaggaaacncccctaaatcctgatctatagatgacactcctactttcgactaaaggtcgggtccaagtcgtaaggttcaggtgcaggtgatcgtagggactagtacttcactctcaccatcagcagtctagacctaactgaattatttacgaccttaacttactactagtaccaaacgtagtacgttaccgacggttcccgtaccccgttacggggtaccgttaccgggacccgtaaaggggacccaaagggtacggaaactacgaaaaccgtacgtggtacgtctacgacctacctnttcgtcg

SEQ ID NO: 287529 - DNA, 564 bp, Homo sapiens
  misc_feature: GYAE6OF01E43P7.6.19.B08.1.454.CMB.1.raw
  modified_base (250)..(250): a, c, t, g, unknown or other
  misc_feature (250)..(250): n is a, c, g, or t
  modified_base (264)..(264): a, c, t, g, unknown or other
  misc_feature (264)..(264): n is a, c, g, or t
  modified_base (365)..(365): a, c, t, g, unknown or other
  misc_feature (365)..(365): n is a, c, g, or t
  modified_base (396)..(396): a, c, t, g, unknown or other
  misc_feature (396)..(396): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcactatttaatgtatcaganaatccagggaaacncccctaaactcctagatctatgatgcatccactttgactaaaggtcgggtccaatcgaaggttcagtggctaggtggatcgtagggacagtacttcactcncacatcagcagtctgactaacctgtaacgtntttacgactaactttactactgtacaacagtacgttacagttccgaccccgtacgggtaccgttacggaccgtaaacggggtacccgaaagggttaacggtaaaataacccggtaaaaccggaacgttacggtacgggtacctacgacccgtaactacgtcgttaccg

SEQ ID NO: 287530 - DNA, 518 bp, Homo sapiens
  misc_feature: GYAE6OF01EBWF5.6.19.B08.1.454.CMB.1.raw
  modified_base (253)..(253): a, c, t, g, unknown or other
  misc_feature (253)..(253): n is a, c, g, or t
  modified_base (483)..(483): a, c, t, g, unknown or other
  misc_feature (483)..(483): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcagtcagagcattagcacctatttaaatggtatcagganaatccagggaaagcccctaaactcctgatctatgatgcatccactttgacgaaaagtcggggtacccagtcaaaggttcagtggcagtggatctgggacagtatttcacctctcaaccatcagctagtctacgaccaactgaagtattttgactaacttactactagtacaacagagttacagttccgcccgtacggtaccgtccgacgaacgggaacaaggtaggaaanacgaaacgtactgtcggctagacacctatcgttcg

SEQ ID NO: 287531 - DNA, 569 bp, Homo sapiens
  misc_feature: GYAE6OF01CRSAH.6.19.B08.1.454.CMB.1.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (559)..(559): a, c, t, g, unknown or other
  misc_feature (559)..(559): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagatcaccatcacttgccgggnaagtcagagcattagcacctatttaatggtatcagganaatccagggaacgcccctaaatcctagatctatgatgctatcctactttgactaaaggtgggtcccagtcgaaggttcaggtggacagtggatcgtgggactagtatttcactcgtaccaccatcagtcagtctagactaaccgtagaacgttattttacgactaaaccgtttactaactgtaactaactagtaacgtttacacgtcgtacccgtacggtaccggttaccgaccggtaaacgggaccgtaaagggtacgtaaagtacgaaaacggtaaccttggtacggtacgtacgcctaaccgtnttccgttacg

SEQ ID NO: 287532 - DNA, 627 bp, Homo sapiens
  misc_feature: GYAE6OF01DUO4L.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtgggctcctgctactctggctccgaggtgccagatgtgacatccagatgacccagtctccatccctccctgtctgcatctgtaggacacagacgtcaccatcacgttggccggcaagtcagagcattagcctaaccttaatttaaattggtatcgaaggagaactccgaagggaacctcccctaaatcctagactctatgatgctatcctactttgacgtaaggtcgggcctagtcgtaaggttcaaggtggctaggtgtatcgtaggacagtacttcactctcacctatcacgctaacggtctagtaccaaccgttagtaacgttcgtttacaccttaacttactacttacgtaactaacgtaaggtacgttaacacggttacccgccccgttacgggtaaccgttaccggaaccgtaaacggggtaaccgtaaagggtaaacggtaaaccgttaacgaaaacccggttaacgttgggtaccgtacggtaacctaccgaacccttacgtccgtttaaacccg

SEQ ID NO: 287533 - DNA, 611 bp, Homo sapiens
  misc_feature: GYAE6OF01DU01E.6.19.B08.1.454.CMB.1.raw
  modified_base (451)..(451): a, c, t, g, unknown or other
  misc_feature (451)..(451): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtacaccatcacttggccgggacaagtcagagcattacgactaccttaattttaaattggtatacgaggagaactccgaagggaaacgcccctaaactcctagactactagtgatgctactcctactttcgacgtaaacggtcgggtacccaagttacgtaaaggttcaaggtcggactaggtggtactcgtagggaactagtactttacactctaccaacactacgagctagtctagaccaaccgtagtaacgtntttacgcttaaacttacgtaactacgtaacaagtaacgtagttaacgacgttaccgccccgtacggtaccggttaccggcggaaaaccgggacgtaaagggtaacgaaagtacgtaaaaccggacggttgacggtacctacggacctacccttgctttcg

SEQ ID NO: 287534 - DNA, 742 bp, Homo sapiens
  misc_feature: GYAE6OF01B2DEH.6.19.B08.1.454.CMB.1.raw
  modified_base (253)..(253): a, c, t, g, unknown or other
  misc_feature (253)..(253): n is a, c, g, or t
  modified_base (263)..(263): a, c, t, g, unknown or other
  misc_feature (263)..(263): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttggccgggcaagtcagagcattagcactatttaaatgtatcagganatcaggaacncccctaaactcctgactactatgatgctacttccctactttagaccgtaaaagggttcggggtacccctaagttacgtaaacgggtttacaacggttgggaccgtaggttaggacttcggtaggggaacctaaggttaacttttaccgaaccttctaccacctaacgtccaagctaacggttcctacgtaacccaacccgttaggtaaaacgtttacgtttttacgaacccgtttaaactttacctttaaccgttacgttaacccgaaaacccgttaaggttaaccgtttaaccgtaaccgggtttaccccggttaacccccccggttacggggtaacccgggttttacccggggaacccgggtaaaaaccggggtaacccggttaaaggggtaacgggtaaaacttaaccccggaaaaacggtacccgttagggttaccgggtccgtaacgtacccaaacccgtgtttcccgttacgg

SEQ ID NO: 287535 - DNA, 721 bp, Homo sapiens
  misc_feature: GYAE6OF01C2GUF.6.19.B08.1.454.CMB.1.raw
  modified_base (225)..(225): a, c, t, g, unknown or other
  misc_feature (225)..(225): n is a, c, g, or t
tcagatatcgcgagcacgaccggtgctcgatttagtgagtcagtaagggggagtcagtctcagtcaggacacagcatggacatgagggtccccgctcagctcgtggggctcctgctactctggctccgaggtgccagatgtgacatccagatcgacccagtcctccatccctcctgtctgcatcgtgtaggacacgagagtccaccatccacgttggcccggganaacgtcagagctattagctacttattaaattggtatcaggagtaataccgaagggaaactacccctaaactccgtagtactctagtacgatcgactactacctacgtttagacgtaaacggtcggggttacctaagtaccgtaagggttacgacggttggaccgtaggtacggtacgttcgtacgggaacgtaacgtatttaccgtacttcctaccaactacgttacgacgtcgtaacgttccgtaccgtacaaaccgttagtaaagttacgtttttacgtaacctttaaacccgtttaagtaacccgttaggttaaaccaaacgttacggtaaacggtttaaccgaccgggtttaccgacccccgtttacggggtaacccggtttaccgggaacccgggtaaaccgggtaaccggtaaacggtaaccgggtaaataaaccggtaaaccggtaacgtcgggtaacggttccacgaccctacgtagttaccgttacg

SEQ ID NO: 287536 - DNA, 597 bp, Homo sapiens
  misc_feature: GYAE6OF01D9F7N.6.19.B08.1.454.CMB.1.raw
  modified_base (95)..(95): a, c, t, g, unknown or other
  misc_feature (95)..(95): n is a, c, g, or t
  modified_base (256)..(256): a, c, t, g, unknown or other
  misc_feature (256)..(256): n is a, c, g, or t
tcagatatcgcgagcacgaccggtgctcgatttagtgagtcagtaagggggagtcagtctcagtcaggacacagcatggacatgagggtccccgntcagctcctgggctcctgctactctggctccgaggtgccagatgtgacatccagatgacccagtctccatcctccctgtctgcatctgtaggacacagagtcaccatcacttgccgggcaagtcagagcattagctaaccttatttaaatggtatcagganaatacgaggaaacacccctaactcctagatctatgatgctatacctacttgacgtaaggtcgggtaccagtacgtaaggtcaggtggacgtaggtgagtcgtagggactagtatttacacttcacctacatcgagctacgtctacgacaacctaggtaattaattttcgaacctaactttactaactcgtaactaagtagtaacgttaccgaggttccccgtaccccggtacggtaccgttaccgggtaccgaaacgggtaaaccgtaacgggtaacgtaaaacgttacccgaaaacggtaaccgttggaccggtacttacggaccactcgttccgttacg

SEQ ID NO: 287537 - DNA, 712 bp, Homo sapiens
  misc_feature: GYAE6OF01BQVSH.6.19.B08.1.454.CMB.1.raw
  modified_base (691)..(691): a, c, t, g, unknown or other
  misc_feature (691)..(691): n is a, c, g, or t
tcagatatcgcgagcacgaccggtgctcgatttagtgagtcagtaagggggagtcagtctcagtcaggacacagcatggacatgagggtcccccgctcagctccgtggggctcctgctactctggctccgaggtgccagatgtgacatccagatcgacccagtcctccactccctccctgtctgcatctgtaggacacgagagtccacctatcgtacttcggccgggtacaagtcgaagacgacctaattacgactaaccttaattttaaagttaggtaattaccgaaggaagtaactaccgaagggaaaccgtaccccgtaaaactccgtagtactacctaagtgtatacgactactacccttacgttacgacgtaaaacgggtcgggtaccctaagtacgtaaggttcgaaggtggacgtaggtgtagtcgtagggtaactagttactttccgactccgtaaccaccgtaagtccgagtacacgtactacggtacctaaccgttacgtaaagttcgttttaaccgaccttaaactttactacgtttactaacaacgttaacgttaaccgttacgtaaccggttcgtaccccccggtaggtaaccccgtacgggtaacccgtaaacgggtaaaccggtaaggtaaacggttaaccgaaaccggtaaaacggacgttacggacgccgttanacctacgtacgtcgttaaccg

SEQ ID NO: 287538 - DNA, 498 bp, Homo sapiens
  misc_feature: GYAE6OF01BV7K9.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctattaatggtatcaggagaatccaggaaacgcccctaaactcctgatctatgatgcatccactttgcaaagtcgggtccatcaaggttcagtggcagtggatctggacagatttcactctcaccatcagcagtctgccaactgaagtattttgctaacttactactgtacaacagagttacagttcgcccctcggacgttcggaccaacgggaccgaaaggtcggaaatacgaaacgaacgtgtacggctacgacacatctacg

SEQ ID NO: 287539 - DNA, 694 bp, Homo sapiens
  misc_feature: GYAE6OF01C1AOK.6.19.B08.1.454.CMB.1.raw
  modified_base (323)..(323): a, c, t, g, unknown or other
  misc_feature (323)..(323): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggcctccgaggtgccagatgtgacatccagatcgacccagtctccatcctcctgtctgcatctggtaggacacgaggacgtcaccatccacttgccgggcaaggtcagagcattagacaccttaatttaaagttggtactacgaaggagaactaccgaaggggaacctaccccttaaaacgtccctagtacttaccttaagngtatcggacctaacgttcccctactttcggaacctaaacgggttcggggtaccctaagtacggtaaacggttcgaaggtcgggacgtaggtggtactcgtaggggaactaggttacttttacctacgtacccttaccgaaccccgtacttaccgacggtacctacggtaccttacggaccctaaccgtaggtaacgttacgtttacgaccttaagttaacttacgtacgtaaccaacgtaacgtagttactcggtccgtacccgtcgggtaccgttacccggacggaaacgggtaccggtaagggttacgaaagtaaccgtaaacggtacgttcggtacggtcctacggtaccaacccgttgttcctacgg

SEQ ID NO: 287540 - DNA, 563 bp, Homo sapiens
  misc_feature: GYAE6OF01DF1J2.6.19.B08.1.454.CMB.1.raw
  modified_base (216)..(216): a, c, t, g, unknown or other
  misc_feature (216)..(216): n is a, c, g, or t
  modified_base (252)..(252): a, c, t, g, unknown or other
  misc_feature (252)..(252): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccggaggtgccagatgtgacatccagatgacccagtctccatcctccctgtctgcatctgtaggacacagagtcaccatcacttgccgggnaagtcagagcattagcactattaaattgtatcaganatcaggaacgccctaaactcctagatctatgatgcatccattgacaaagtgggtccagtacaagtcagtgcagtggatcgtggacagtatttacactctcacatcagcagtctgctaacctgaagtatttgactaacgttactactgtaactaacgtagtacgttactacgtccgtaccccgttacggtaaccggttccggaaccgaaacggggtaaccgtaaacggggttaacggtaaaacttaaccggtaaaacccgtaaacgttagggtacgggtaccgttacgaccctaaccgtagttccgttaccg

SEQ ID NO: 287541 - DNA, 618 bp, Homo sapiens
  misc_feature: GYAE6OF01BE6KG.6.19.B08.1.454.CMB.1.raw
  modified_base (285)..(285): a, c, t, g, unknown or other
  misc_feature (285)..(285): n is a, c, g, or t
  modified_base (511)..(511): a, c, t, g, unknown or other
  misc_feature (511)..(511): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccactccctccctgtctgcatctgtaggacacagacgtcaccatccacttggccgggacaagtcagagacattacgctaaccttaattttaaattggtatcaggagaatccgaagggaaaccncccctaaactcctgactctatgatcgctatcctagtttgacgtaaggtcgggtacccagtacgtaacggttcaggttggactaggtagtacgtcggtagggactagtactttcaccgttctactaaccagtacgagccgtagttcagaccctaacgtagtaacgtttacttttacgaccttaaacctttacctaacgttcgtaactaacgtacgtacggttaaccncgttacccgtcccgtacggtaccggtacggaccgtaaacgggtaccgtaagggtaacgtaactaacggtaaacgtacgtgtacggtcgacgaccacttagtcgtacg

SEQ ID NO: 287542 - DNA, 575 bp, Homo sapiens
  misc_feature: GYAE6OF01CPZZ3.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagctacttattaaatggtatcaggagaatccgaagggaaacgtcccctaaaactcctagtactctatgatgctatcctactttgacgtaaaggtcgggtccaagtcgaaacggttcaaggtggacaggtgatcgagggtactagtacttcactctacacctatcagtcagtctagacctaacgtgtaatatttcgactaactttactacttcgtaacaacgtagtaacgttacgacgtccgtaccccgtcgggtaccgttcggaccgaaacgggtaaccgaaagggtacggaaactaacgaaaaccgtacgtacggttacgactacgacccaccgtattcgttaccg

SEQ ID NO: 287543 - DNA, 570 bp, Homo sapiens
  misc_feature: GYAE6OF01BVW85.6.19.B08.1.454.CMB.1.raw
  modified_base (521)..(521): a, c, t, g, unknown or other
  misc_feature (521)..(521): n is a, c, g, or t
  modified_base (561)..(561): a, c, t, g, unknown or other
  misc_feature (561)..(561): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtcctccatcctcctgtcctgcatctgtaggacacagagtccaccatcacttggccgggcaagtcagagcattagctacctaatttaaatggtatcaggagaatccgaagggaaacgacccctaaactcctgactctatgatgctatcctactttgactaaacggtcgggtaccatacgtaagttacgaggtggcaggtgaagttcgtgggactagtactttcactctcaacactcagctagtctgacctaactagtaacgtatttcgacttaacgttactactcgtaaccaacgtagtacgttacacgttcgccccgtacggtccggtaccggaccgtaaggacccgaaaggtacggtaaanaaccgtaaacggtaacctggtacggactacgaccaacctnttcgttacg

SEQ ID NO: 287544 - DNA, 607 bp, Homo sapiens
  misc_feature: GYAE6OF01D4SWO.6.19.B08.1.454.CMB.1.raw
  modified_base (254)..(254): a, c, t, g, unknown or other
  misc_feature (254)..(254): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcagganaatcaggaacgcccctaaatcctagatctatgatgcactccactttgactaaagtcggggtacccatcgtaaaggtttcagtgggcagtggatcgtgggactagatttacactctacaccatcacgtcagtctgaccctaacctagtaaacgttagttttacgaaccgttaaactttaaccttacgtacttaaccgaaacttaacggtaacgttaacctaggttacccgtcccccgtacgggtacccggtttaccggacccggtaaacgggtaccggtaaacgggtaaggtaaacgtaaccgtaaaaccggaaacgttcggtacggtcgtacgacgaaccctagttcgttacg

SEQ ID NO: 287545 - DNA, 666 bp, Homo sapiens
  misc_feature: GYAE6OF01D64RZ.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgaccagtctccactccctccctgtctgcatctggtaggacacagactccaccatcacgttcggccggacaagtcagagctaattacgacctaacttaatttaaagttggtaactcgaaggaagaactaccgaagggaaacctacccctaaactcctagtactactatgtatcgactactcctacgtttgaacgtaacggtccgggtacctagtacgtaaggttcaggtcgacgtaggtcggtagtcggtaggtaactagttacttacctacttccgtacacctatacgacgtctacgtctacgaacctacgttagtaacgtttactttacgaacctttaacgtttacttacgtacgtaacgtaaacgttaggtaaccttaccgtacgtcccgtaccccgggtaggttacccggtaccggaaccggtaaccggtaaacggtaacgggtaacgaaacgttaaccggaaacgtaccgtggtaccgtacgtacgtacccaaccttgttcggttcccg

SEQ ID NO: 287546 - DNA, 659 bp, Homo sapiens
  misc_feature: GYAE6OF01CRSFL.6.19.B08.1.454.CMB.1.raw
  modified_base (94)..(94): a, c, t, g, unknown or other
  misc_feature (94)..(94): n is a, c, g, or t
  modified_base (222)..(222): a, c, t, g, unknown or other
  misc_feature (222)..(222): n is a, c, g, or t
  modified_base (247)..(247): a, c, t, g, unknown or other
  misc_feature (247)..(247): n is a, c, g, or t
  modified_base (276)..(276): a, c, t, g, unknown or other
  misc_feature (276)..(276): n is a, c, g, or t
tcagatatcgcgagcacgaccggtgctcgatttagtgagtcagtaagggggagtcagtctcagtcaggacacagcatggacatgagggtccccnctcagctccgtgggctcctgctactctggctccgaggtgccagatgtgacatccagatgacccagtctccatcctcctgtctgcatctgtaggacacagatcaccatcacgttcgccggcaagtcagncattagcactattaattgatcaganaatcaggaagccctaactcctgatctatnatgcatcctatttcgactaaaggtggggtacccagtactaaggttcagttggcaggtggatcgtaggactagtactttacaccttactaccacctatacacgactacgttactacggaccctaaaccgttggtaaacggttactttttacgaaccttaaactttaaccttaacgtttacggttaacctaaactaaccgggttaacgttttaacctaacgggttcccgtacccccccgggttcgggtaacccgggtttacccgggaaacccggtaaaccggggtaacccggtaaagggttaaaccgggtaaaactacggtaaaaaaccgtaacgttacgggttacgggtccttaacggccccgaaacctagttccgtttaaccg

SEQ ID NO: 287547 - DNA, 528 bp, Homo sapiens
  misc_feature: GYAE6OF01CK7QR.6.19.B08.1.454.CMB.1.raw
  modified_base (222)..(222): a, c, t, g, unknown or other
  misc_feature (222)..(222): n is a, c, g, or t
  modified_base (265)..(265): a, c, t, g, unknown or other
  misc_feature (265)..(265): n is a, c, g, or t
  modified_base (408)..(408): a, c, t, g, unknown or other
  misc_feature (408)..(408): n is a, c, g, or t
  modified_base (517)..(517): a, c, t, g, unknown or other
  misc_feature (517)..(517): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagngcattagcactatttaaattggtatcaggagaatccagggaancccctaaatcctgatctatgatgcatccactttgcaaagtcgggtccatcaaggttcagtggcagtggatcgtgggacagtatttcacttctcaccatcagcagtctgcaactgaagtatttgactaacttactactgtcaangtacttacacgttcgccccgtggtacgttccggaccgaaagggtaccgtaagggtacggtaaataccgtaaaacggtaccgttaggtaccggtacgtacgacctaaccngttccgttacg

SEQ ID NO: 287548 - DNA, 625 bp, Homo sapiens
  misc_feature: GYAE6OF01BSS0J.6.19.B08.1.454.CMB.1.raw
  modified_base (162)..(162): a, c, t, g, unknown or other
  misc_feature (162)..(162): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctcgaggtgccagatgtgacatccagatgacccagtcnccatccctcctgtctgcatctgtaggacacagagtcaccatcacgttggccgggacaagtcagagcattagcacttattaatggtatcgagagactcgaaggaacgcccctaaatctagactctatgatgctatccgactttgacgtaaggtcgggtcccaagtacgaaaggtcaaggtcggacaggtggtatccggtgggaactagtactttcaactccgtacaaccataccagctacggtctagaccaaccgtgtaagtagttttacgaaccttaactttaactaacttacgtaacctaaacgtaacggtacgttaacgacgttcccggtaccccgttacgggtaacccgttacggaaccgtaaacggggaacccgtaaagggtaccggaaaaagttaccgaaaaaccggtaccgttaggggtacgtaccgtacgtacccaaaccgtcgttacccgttcgg

SEQ ID NO: 287549 - DNA, 595 bp, Homo sapiens
  misc_feature: GYAE6OF01E477N.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagctacctaatttaaattggtatcaggagaatccgaagggaaacacccctaaactcctagatctatgatgctatcctacgtttgacgtaaacggtcgggtaccctaagtacgtaaggttcgaaggtggacgtaggtggacttcgtaggggaactaggtactttccacttcctaccaacctactaccagcctaagtcctagacctaacctagtaacgttatttacgactaaacttactactagtaccaactagtacgttacacgtccgtccccgtacggtaccgttacggaccgtaaacgggaaccgtaagggtacgtaaactaccgaaaacgtacgtaggtacgctacgacctacctatcgttacg

SEQ ID NO: 287550 - DNA, 634 bp, Homo sapiens
  misc_feature: GYAE6OF01C3GQV.6.19.B08.1.454.CMB.1.raw
  modified_base (277)..(277): a, c, t, g, unknown or other
  misc_feature (277)..(277): n is a, c, g, or t
  modified_base (516)..(516): a, c, t, g, unknown or other
  misc_feature (516)..(516): n is a, c, g, or t
  modified_base (624)..(624): a, c, t, g, unknown or other
  misc_feature (624)..(624): n is a, c, g, or t
tcagatatcgcgagcacgaccggtgctcgatttagtgagtcagtaagggggagtcagtcttttcagtcaggacacagcatggacatgagggtccccgctcagctccgtggggctcctgctactctggctccgaggtgccagatgtgacatccagatcgacccagtctccatccctccctgtctgcatctgtaggacacagacgtccaccatcacttcggccggacaaggtcagagcaattacgcctaacttaatttaaagttggtaatacgaagganaaactaccggaaagggaaacacccctaaaacgtcctagacttactaagtcgattcgctaacttcctaactttcggaacgtaacggtcgggtacctagtacgtaaggttcgaggttggactaggtgatcgtaggactagttactcactctaccacgtatcgaagctagtcagacctaagtagtaacttgtttacgaacctttaacttacgtactagtaaccaaacgttagtaacgttacnccggttacccgtaccccggtgggaccggttaccggaaccggaaacgggtacgtaaacggtaaacgtaaacgttaacaaacggtcgttaggacggtcaacgccttaacntttcggttac

SEQ ID NO: 287551 - DNA, 679 bp, Homo sapiens
  misc_feature: GYAE6OF01BMWHF.6.19.B08.1.454.CMB.1.raw
  modified_base (259)..(259): a, c, t, g, unknown or other
  misc_feature (259)..(259): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatccacttggccgggcaagtcagagcattagcaccttatttaaattggtatcagganaatccgaagggaaacgcccctaaactcctagatctatgatgctatcctactttgactaaaggtcgggtaccagtcgaaggttcaggtggacgtaggtggtatcgtagggactaggtacttttacctaaccttttccaacctactacgacgtacgtaacgttcctacgtaccctaaacccgttaggtaaacgtttacgttttacgaaccttaactttaccttaacgttacgtaaccgtaaacgtaaggttaacgttaccgtacggttacccgtacccccgttacgggtacccggttaccggtaacccggaaacgggtaacccgtaaaggggtaacggtaaaaccgtaaccggtaaaaccggtaacggttacgggtaccggtacgtacgtacccgtaaccgtacgtttccgttcgtttaccc

SEQ ID NO: 287552 - DNA, 621 bp, Homo sapiens
  misc_feature: GYAE6OF01B099Y.6.19.B08.1.454.CMB.1.raw
  modified_base (433)..(433): a, c, t, g, unknown or other
  misc_feature (433)..(433): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccggaggtgccagatgtgacatccagatgacccagtcctccatccctcctgtctgcatctgtaggacacagatccaccatcactcggccgggcaagtcagagctattacgctaaccttaatttaaattggtatcgaaggagaactccggaaggggaaacctacccccttaaactcctagacttctatagtatcgactacttccctacgtttcgaccgtaaacgggttccgggtacccagttacgtaaggttcgaggtcggacgtagggtcggtatcggtagggactagtactttcacttcctcacctntcagtctacgtctacgacctaaccgtagtaacttagtttacaacttaactttactacgtcgtaacaaacgtagtacttacgacggttacccgcccgtacgggtaccggtccggaaccgtaaacgggaccggaaggtacggtaaactacggaaacgacgtggacggtactacgacaccttgtccgttcg

SEQ ID NO: 287553 - DNA, 790 bp, Homo sapiens
  misc_feature: GYAE6OF01EBSKT.6.19.B08.1.454.CMB.1.raw
  modified_base (170)..(170): a, c, t, g, unknown or other
  misc_feature (170)..(170): n is a, c, g, or t
tcagatatcgcgagcacgaccggtgctcgatttagtgagtcagtaaggggagtccagtctcagtcaggacacgagcagtggacatggacgggtccccgctcagctccgtggggcctcctgctactctcggctccgaggtgccagatgtagacatccagatgacccagtcnccatcctcctgtctgcctattcgtaggtacgactacgagtacgtaccaacctatacctacgttcgggccgggtactaaggtacaaggactctaacgttacggacctaacgtttaagttttaaagttcggtaactacgtaaggaacgtaaccgtaccggaaacggtaaacccgtaccccttaaacgttccgtagtaaccttaccgtaaagtgtacgttacggtaccttacttaccttacgtttacggaacgtaacgggttccggtacctagttaaccggttaacggtcgtaggtcggtacgtaacgggtacgtacgttacggtacggtaacgtacgtttacgttaccaaccttctaacctaccgtagtacgtacgtactacgtctacgaactacgtagtaacgtttagttttaccgaacgttaaccgtttaccgtaacgtacgtaaaccaacggttaaccggttaccgttaaccgtacggtccccgttacccgggtacggtccggtaaccggtaaaccggtaaccgggaaaccgtttaacggtaaaacgggtaaactaaaccggttaaacggtacggtcgaaaccggttaccgtaaccgacctaactgttacccgttaacg

SEQ ID NO: 287554 - DNA, 815 bp, Homo sapiens
  misc_feature: GYAE6OF01AVM9H.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatgacccagtcctccatccctccctgtctgcatcgtgtaggacacagacgtccaaccatccacgttcggcccgggtacaacgtcaaggagtctaactttaacgacctaaccgtttaaatttttaaaagttcgggttaataccggaagggtaacgtaaacgttacccggaaaggggtaaaaccctacccccgttaaaacttcccgttagactttaccgtaagtgtactcgacctacttcccgtaatttacggaacgtaaacgggttccgggtaccaacgttacgtaacgggttaccagggtacgggactagggtcggtaacgttccggtagggaacctaggttaccttttacccgacctttacctaccctaacccgtactaccgtacgtacgtacgttaccgtaacgaaccgtaacccgtaggtaaagtttaccgttttacgaaccctttaaacgttttaacctacgttaccgttaaacaacgttaacggtttaacgttaaccgtaccggttccccggtaccccggtttaccggggtacccggttaacccgggaaccgggtaaaccggggtaaacccggtaaagggttaaccggaaaccttaacggtaaaccggtaacgttcggtacggtaccgtacgtaccctaaaccgtcggtttacgtaccg

SEQ ID NO: 287555 - DNA, 821 bp, Homo sapiens
  misc_feature: GYAE6OF01CB18P.6.19.B08.1.454.CMB.1.raw
  modified_base (212)..(212): a, c, t, g, unknown or other
  misc_feature (212)..(212): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccggaggtgccagatgtgacataccagatcgacccagtcctccactcctcctgtctgctatctggtaggacacaggactacaacctntacctacgttcggaccgggacaaggtcgagacgactagttacgacctaactttaattttaaagttaggtaattacgaaggaagtaaccgtacggaacgggtaaacctaccccctaaacgtcctagtactactagtagtacgtacaccttacgtaccttaagtttacggaacggttaaacggggttccggtacccgtaaggtaccggttaagggttcgtagggtacggtacggtacggtacggtacgtcggtaacgggtaattacggttactttacctactacccgtacaacccttagtaccacggtacctaacggttcctaaccgaacccttaacggtagtttaacggtttattttaacccgaacctttaaaccgtttaaccgttaacgttacgttaaccgtaaagtttacgggttaaccgttaaccggtaccgggttaccccggttaccccgggtagggtaaacccccggggttaacgggaaacccgggttaaaccgggggtaaaaccgggtaaaggggttaaaccggtaaaaccgttaaaaccggtaacggtaccggtttacggacgggtacctacggtaacccctaacgttacgttcccggttacc

SEQ ID NO: 287556 - DNA, 571 bp, Homo sapiens
  misc_feature: GYAE6OF01B5CAJ.6.19.B08.1.454.CMB.1.raw
  modified_base (255)..(255): a, c, t, g, unknown or other
  misc_feature (255)..(255): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttggccgggcaagtcagagcattagcacctatttaattggtatcagganaatccagggaaagccctaaatcctgatctatgatgctatcctacttttgactaaacggtgggtacccctatacgaaaggttcaaggtggcgaggtggatcgtgggacaggtatttcactctacaccatacagcagtctgaccaacctagtaagtagttttacgactaacttacttactagtacctaacagtacgtttaacacgttccgtacccccgtacggtaccgttaccgaaccgtaaacgggaaccggtaggtaacggtaaactaacgaaaccggtaactacggtacggtactacgactaccctgttcgtacg

SEQ ID NO: 287557 - DNA, 585 bp, Homo sapiens
  misc_feature: GYAE6OF01A43IN.6.19.B08.1.454.CMB.1.raw
  modified_base (275)..(275): a, c, t, g, unknown or other
  misc_feature (275)..(275): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacgagagtcaccatcacttggccgggcaagtcagagcattagcaccttatttaaattggtatcaggagaatccgaagggaaacncccctaaactcctgatctatgatgcatcctatttgacgtaaaggtcgggtcccagtacgtaaggttcaggtggactaggtggtactcgtaggggactaggtactttccacttctacaccatcagcctacggttcagacccaaccgttaggtaacgttattttcgaaccttaacttactactagtaccaacagttacgttacgacgtccgaccccgtacggtacgttaccggaccgtaaacggggaaccaagggtacgaaagtacgaaaaccggtacgtggtacgacgtcgacctacctaagttccttacg

SEQ ID NO: 287558 - DNA, 636 bp, Homo sapiens
  misc_feature: GYAE6OF01ET2J5.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatgacccagtctccatccctccctgtctgcatctgtaggacacagagtcaccatcacttcgccgggacaagtcagagcattagcaccttattaaatgtatcaggagaatccgaggaaacgcccctaaactcctgactctatgatgcatcctactttcgacgtaaaggtcggggtacccagttacgtaaaggttccaaggtggcgtagtcggatcgtgggactaggtatttccgactcgtaccacctagtacctacgtcctacgttctacggtaccctaaacccgtcgtaaacggtttattttacgaaccttaacgtttaaccttacggttactaactaaacgtaaggtacgtttaacgacggttacccgaccccgttacgggtaccgtcccgggtaacgtaaaccggggacctaaaggggttacggaaaagtaccgaaaacgtaacgtacggtacggtactacgaaccaccgtactcgttaaccg

SEQ ID NO: 287559 - DNA, 682 bp, Homo sapiens
  misc_feature: GYAE6OF01ETVF9.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctcctgtctgcatctgtaggacacagagtcaccatcacttggccgggacaagtcagagctattagctaaccttaatttaaattggtaatcgaaggaagtaactccgaagggaaactacccctaaactccgtagatactatagatcgactactcctatttgacgtaaaggtcgggtacccagtacgtaacggttcaaggtcggacaggtcggagttacggtagggtaactaaggttactttaccacttccgtaccaaccgtaactacacgcctaaggttcctacgacccgtaaccgtaggtaaacgttacttttacgaacccgttaaacttttaacctacgttacgtaacctaaactacggtaacgtttacgaccggttcccgtaccccggttacgggtacccggttaccgggaacccggtaaacgggtaacccgtaaaggggtaacgtaaacgtaccggtaaaacgtacgtaggtacgggacccttacggaaccctaccgttgttccggttacg

SEQ ID NO: 287560 - DNA, 920 bp, Homo sapiens
  misc_feature: GYAE6OF01AMDXT.6.19.B08.1.454.CMB.1.raw
  modified_base (95)..(95): a, c, t, g, unknown or other
  misc_feature (95)..(95): n is a, c, g, or t
  modified_base (220)..(220): a, c, t, g, unknown or other
  misc_feature (220)..(220): n is a, c, g, or t
tcagatatcgcgagcacgaccggtgctcgatttagtgagtcagtaagggggagtcagtctcagtcaggacacagcatggacatgagggtccccgntcagctcctggggctcctgctactctggctccgaggtgccagatgtgacatccagatgacccagtctccatccctccctgtctgcatctgtaggacacagagtcaccatccacgttggcccgggnaagtcaggagctaattacgacctaacctttaattttaaaagttggttaattacgaagggtaacggaaactacccggaaagggggaaaaccgtacccccttaaaaaccgttcccgtaggtacttacttaagtcggtaacttcgacctaacttacccctaacgttttacgaccgtaaaacgggttccgggggttacccctaacccgttacggtaaacgggttttcgacggttacgggacgtacgggttaggtacggtttccgtaacgggggtaacccttaaggttaacctttttccaaccccgtttcctaaccccgtaaccctaacgttaccccgaaggttaccccgtaacggtttacccgttacggaaacccttaaacccgggtaacgtttaaacgggttacttttttaacgggaacccttttaaaaccgttttacccgttaacgttaacggttaaaccctaaaacggttacggttaaccgtttaaccggtaccgggtttaccccggtaccccccggtttaccggggtaccccgggttttaacccggggaacccgggttaaaaccggggtaaacccgggttaaaggggttaaccggaaaaccggttaaacccggtaaaaaccgggttaacccggtttacgggttaaccgggtaccgttaaccccggaacccgttaacccgttacgttacccggtttaccgg

SEQ ID NO: 287561 - DNA, 863 bp, Homo sapiens
  misc_feature: GYAE6OF01EKU1Y.6.19.B08.1.454.CMB.1.raw
  modified_base (196)..(196): a, c, t, g, unknown or other
  misc_feature (196)..(196): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgaccctagtcctccactccctccctgtctgcatctgtagacanagacgtcaccatctacgttcggccgggacaagtcaagagtctatttagacctaaccttaattttaaaacttggttatcgaagggaagaaacttaccgaaaggggaaaacctacccccgttaaaactcccgtaggtaacttaccgttagtacggtactcgacctaacttaccccttaacgtttttacggaaccgttaaaaagggtttcccgggggttacccctaaattacccggttaaaacggggtttaccgtaacggggttcgggacccgtaaggggttacggtaacgtttacggtacgggtaactaaggtttacttttaccctacgttccctaaccgtaaccctacgttacgaaccgttctaacggttacctacgacccttaaaccgttaggtaaacgtttacgtttttaaccgaaccttttaaaccgtttaacccgttacgtttaaccggtaacctaaaccggtaacggtttaaaccgtttaacgtaccgggttacccccggttaacccccggttaccggggttaacccggttaacccgggacccggtaaaacggggtaaccccggttaaagggttaaccggtaaaacgttaaacccggtaaaacggttaccggttacggtacggtaccgtaaccggaccctaacgttaccgttcgtttacccgg

SEQ ID NO: 287562 - DNA, 724 bp, Homo sapiens
  misc_feature: GYAE6OF01ELZFW.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccactccctccctgtctgcatctgtacggacacagagtcaccatcacttcggccgggacaagtcagagactattacgacctaaccttaaattttaaaagttggttaattacgaaggggtaagaaaacgtacccggaaaggggaaaaccgtaccccccttaaaacctcccgttagaacttaccttaagtacggtacttacgacctacttaccctaactttacggaaccgtaaacggttcggggtaccctaagtacgtaaacgggttacgtaggtcggtacgaggttacggacttacggtagggaactagttactttacgaccttctaccaacctacgttacacgtaccgtacgtactacgaacctaaccgtaggtaaactttacgttttacgaaccttaaacctttacctaacgttacgtaaccaacgtaacgtacgttacgtacggtacccgtccccgttacggtaccggttaccggtaaccggaacggggtaaccgtaagggtaacggtaaactacgaaacggtacgttggacgtcgtacgacccgtactgttcccgtacg

SEQ ID NO: 287563 - DNA, 592 bp, Homo sapiens
  misc_feature: GYAE6OF01ETWE4.6.19.B08.1.454.CMB.1.raw
  modified_base (213)..(213): a, c, t, g, unknown or other
  misc_feature (213)..(213): n is a, c, g, or t
  modified_base (269)..(269): a, c, t, g, unknown or other
  misc_feature (269)..(269): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctcctgtctgcatctgtaggacacagagtcaccatcacttgccggnaagtcagagcattagctacttatttaaatggtatcaggagaatccgaagggaaacncccctaaactcctagactctatgatgactactcctagtttgacgtaaaggtcgggtaccagtcgtaaggttcaggtcggctaggtggactcgtagggactagtactttcacttctaccactatcagctaagtctagacctaacgtagtaagttacttttacgaccttaactttactactacgtacaacgtagtacgttacgcgttaccgtacccgttacgggtaccgttaccgggaccgtaaacgggaaccgtaaagggtacggtaaacgtaaccgaaacggtaacgttggtacggtacctacgacctacctagtcgttaccg

SEQ ID NO: 287564 - DNA, 659 bp, Homo sapiens
  misc_feature: GYAE6OF01BRQBQ.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctcctgtctgcattctgtaggacacagagtcaccatcacttgccgggcaagtcagagctattagctaaccttaattttaaagttggtatacgaggaagaactaccgaagggaaacctacccctaaactccgtagattctatagatgactactcctacgtttgacgtaaacggttcgggtacccaagttaccgtaaaggttcgtaggtcggacgtaggtaggtactacggtagggtaactaggttacttttacaccgttacctacctaacctatacacgtacctacgttccgtacgtaccctaacgttaggtaacgtttacttttacgaacctttaaactttactaacgttacgtaacctaaacgtacgtaacgtttaaccgtacgttcccggtaccccgttacggtaaccggttccgggaaccggtaacgggaaccgtaaggtacggaaactacgaaacgtacgtgtacggactacgacctactgtcgtacg

SEQ ID NO: 287565 - DNA, 707 bp, Homo sapiens
  misc_feature: GYAE6OF01EBQLK.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtctccatccctcctgtctgcatctgtaggacacagagtccaccatcacgttggccgggacaagtcaagagctattacgctaacctttaatttaaattggtatacgaaggaagtaactaccggaaagggaaaccgtacccccttaaaactcccgtaggtacttacctagtagagtacgcctaactacccttaagtttcgaacgtaaacgggtcgggtacctacgttacgtaaacgggttcaggtcggacgtaaggtggtactcggtagggactaagttactttacgaccttcctaccacctatcgaagtacgtacgtcctagaaccctaaccgtaggtaaacgttacgttttacgaaccctttaaacgtttacctaacgttacggtaaactaacgtaacggttacgttaaccgtacggttacccgtccccgttacgggtaccggttaccggtaaccggaacggggtaaccgtaacgggtaaagtaaaccgtacgtaaaaccggtacgttacggtacggtactacggtaccctaactgttccgttaacg

SEQ ID NO: 287566 - DNA, 604 bp, Homo sapiens
  misc_feature: GYAE6OF01DIHCD.6.19.B08.1.454.CMB.1.raw
  modified_base (262)..(262): a, c, t, g, unknown or other
  misc_feature (262)..(262): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcagtcagagcattagcactattaatgtatcagagaatccgaaggaacncccctaaactcctagatctatgatcgcatcctatttgactaaggtgggtaccatcgaagttcaggtgcagtgatcgtaggacagtactttcactctacacactacagactagttctacgaccctaactcgtaaagttacttttacgaccgttaaaacctttcttaaccgttagtaacctaaaaccgtaggttaaaccggtttaccgtaacggtccccgttacccccggttaccggtaacccggggttacccgaaccggggtaaacccggaacgggtaacgggtaaacgtaaaccgtaacgaaaacggtacgttggacggtcgtacgacaacctgttcgttcg

SEQ ID NO: 287567 - DNA, 583 bp, Homo sapiens
  misc_feature: GYAE6OF01C9WO0.6.19.B08.1.454.CMB.1.raw
  modified_base (217)..(217): a, c, t, g, unknown or other
  misc_feature (217)..(217): n is a, c, g, or t
  modified_base (225)..(225): a, c, t, g, unknown or other
  misc_feature (225)..(225): n is a, c, g, or t
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
  modified_base (286)..(286): a, c, t, g, unknown or other
  misc_feature (286)..(286): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccagtcacttggccggnaagtcagngcattagcactattaatggtatcagganaatcgaggaacnccctaaactcctgatctatgntgcatcctactttgacgtaaaggtcgggtacccagtaccgtaaggtttcaggttcggacgtaggtggtactcggtagggactaggtactttcgacttactccaccatcagctagtctcgacctaaccgtgaattattttgactaacgttatactagtaccaagtatagtactacggtccgaccccgtggtaaccggttccggaaccggtaaacgggaacccgtaaagggtaaccggtaaactaacgtaaaccggaacgttaggtacggtccttacgaacctaccgtattccgttccg

SEQ ID NO: 287568 - DNA, 600 bp, Homo sapiens
  misc_feature: GYAE6OF01DNNFX.6.19.B08.1.454.CMB.1.raw
tcagatatcgcgagcacgaccggtgctcgatttagtgagtcagtaagggggagtcagtctcagtcaggacacagcatggacatgggggtccccgctcagctcctggggctcctgctactctggctccgaggtgccagatgtgacatccagatgacccagtctccatcctccctgtctgcatctgtaggacacagagtcaccatcacttgccgggcaagtcagagcattagcaccttaatttaaattggtatcaggagaatccgaaggaaacgacccctaaactcctagatctatgatgctactacctactttgacaaaggtcgggtaccagtactaaggttcagtcggactaggtggatcgtgggactaggtactttcgacttctactaccactcagcacgttctacgactaaccgtagaattatttcgaactaactttactactagtacaaacgtagtaacgttactacgtcgtaccccgtacgggtacccgttacggaaccggaaacgggacccgtaaaggtaacggaaaaccgttacgaaaacggtaacgttacggtacggtacgtaccggaacaccgtacttcgttcggtttaccc

SEQ ID NO: 287569 - DNA, 558 bp, Homo sapiens
  misc_feature: GYAE6OF01AGRFJ.6.19.B08.1.454.CMB.1.raw
  modified_base (271)..(271): a, c, t, g, unknown or other
  misc_feature (271)..(271): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcacttatttaaatggtatcaggagaatccgaagggaaacncccctaaactcctagatctatgatgcatcctactttgacgtaaaggtcgggtaccagtaccgtaaggttcaggtggacaggtggtatcgtgggactagtacttcgactctcaccatcagctacgtctacgacctaaccgtgtaagttacttttcgaaccttaacttactacgttgtaacaactaggtacgttacgacgttccgccccgtacggaccggttccggaccgaacggaccgaagggtacgaaactacgaaacgtacgtgtacgctacgaccacctgtctcg

SEQ ID NO: 287570 - DNA, 588 bp, Homo sapiens
  misc_feature: GYAE6OF01BL3YZ.6.19.B08.1.454.CMB.1.raw
  modified_base (276)..(276): a, c, t, g, unknown or other
  misc_feature (276)..(276): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtccaccatcacttgccgggacaagtcagagcattagctaccttatttaaattggtatcgaggagaatccgagggaaacnccctaaactcctgatctatgatgcactcctacgtttagacgtaaaggttcgggtaccctagttacgtaaaggttcgaaggttggacgtaggtggactcgtagggactagtactttcgacttctaccacctatcgacgtactagtctacgacctaacgtagtaaacgttagttttacgaccttaactttactacgttacgtacaacgtagtacgttacacggtccgtcccgtacggtaccgtcggaccgaacggtaacgaacggtacgtaactacggaaactagtgtacgtacgtacactacctgttcttacg

SEQ ID NO: 287571 - DNA, 589 bp, Homo sapiens
  misc_feature: GYAE6OF01AP2MD.6.19.B08.1.454.CMB.1.raw
  modified_base (215)..(215): a, c, t, g, unknown or other
  misc_feature (215)..(215): n is a, c, g, or t
  modified_base (251)..(251): a, c, t, g, unknown or other
  misc_feature (251)..(251): n is a, c, g, or t
  modified_base (263)..(263): a, c, t, g, unknown or other
  misc_feature (263)..(263): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggnaagtcagagcattagcacttattaatgtatcagganaatcgaggaacncccctaaatcctagatctatgatgcatcctactttagactaaaggtcgggtaccatacgtaaggttcaggtggctaggtgatcgtagggacagtactttccactctacacctatacacgctagtctacgacctaacccgtgtaacgttacttttacgacctaaacttacttacctagtaaccaactagtacgtttaccgacgttccgacccccgttaggacccgttacggacccgtaaaggggtaacccaagggttacggtaaaactacgaaaaccggtaacgttggtacggtaccttacggacccgtaacctgttaccgttaccg

SEQ ID NO: 287572 - DNA, 618 bp, Homo sapiens
  misc_feature: GYAE6OF01DAXER.6.19.B08.1.454.CMB.1.raw
  modified_base (262)..(262): a, c, t, g, unknown or other
  misc_feature (262)..(262): n is a, c, g, or t
  modified_base (607)..(607): a, c, t, g, unknown or other
  misc_feature (607)..(607): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctcctgtctgcatctgtaggacacagagtccacatcacttcggccgggacaagtcagagctattagcaccttaatttaaattggtatcaagganaataccgaaggaacgacccctaaaactcctagatctatgatgactactcctactttgaacgtaacggttcggggtaccctagtaccgtaaacgggttcaaggttggacgtaggtggaacgtcgtagggactagtatttccgactctaccacctatacagctacgtctacggacctaaccgtaggaaacgttatttacgtaccttaaactttaacctaacttcgtaacaactacgtacgttacacggttcccacccggtggtacccggttacggaccggtaaaccggacgaacggtaaacgaaacgtaacgtaaaacgtacgttaggacggtactacgaccaaccngttcgttaccg

SEQ ID NO: 287573 - DNA, 662 bp, Homo sapiens
  misc_feature: GYAE6OF01EU0UP.6.19.B08.1.454.CMB.1.raw
tcagatatcgcgagcacgaccggtgctcgatttagtgagtcagtaagggggagtcagtctcagtcaggacacagcatggacatgagggtcccccgctcagctcctggggctcctgctactctggctccgaggtgccagatgtgacatccagatgacccagtctccatccctccctgtctgcatctgtaggacacagagtccaccatccacgttcggccgggacaagtcagagactattagactaaccttaattttaaagttggtacttacgaaggtaacgaactaccgaagggaaaccaccccttaaactcctgtactctatgatgactactcctactttgacgtaaggtcgggtaccatacgtaagttcgagtggcgaggtgacttcggacgggtacaggttactttaccacttacctaccaacctatacgagtacacgtcgtacgtacctaaccgtagtaaagttacttttacgaaccttaacgtttactacgttacgtaaccaacgtacggtaacgtttacccgacgttcccgtacccccggttacgggttaccggtaccggaaccggtaaccgggaacggtaaacgggtaacgggtaaaacgtaccggaaaacgtacggtaggttacggtaccgtagtacccaacgtcttccgttacg

SEQ ID NO: 287574 - DNA, 681 bp, Homo sapiens
  misc_feature: GYAE6OF01DUN90.6.19.B08.1.454.CMB.1.raw
  modified_base (448)..(448): a, c, t, g, unknown or other
  misc_feature (448)..(448): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatgacccagtcctccactccctccctgtctgcatctgtaggacacagagtccaccatcacttggccgggacaagtcaagagactattacgactaaccttaatttaaaagttgtaattacgaaggaagaacgtaccgaagggaaaccgtacccctaaaactcctagtacttactatagatcgactacttacctacgtttacgaacgtaaacggttcggggtaccctaagtaacgtaaggttctaaggtcggactaggtagacgtcggtagggatagttacttacacgtctccaacctntacgacgtctacgtctacgaacctaacgttagtaaacgttatttacgaaccttaacttactaacgtacgtaactaaacgtaggtaacttacgtaccgtcccggtaccccgtacgggtacccgttaccgggtacccggaaacgggtaacccggtaaagggtaaaccggtaaaacggtaaccgtaaaccggtaacgtacgggtaccgtccgtacgtaacccaccgtattcgtccg

SEQ ID NO: 287575 - DNA, 693 bp, Homo sapiens
  misc_feature: GYAE6OF01C6QQB.6.19.B08.1.454.CMB.1.raw
  modified_base (192)..(192): a, c, t, g, unknown or other
  misc_feature (192)..(192): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatgacccagtctccatcctcctgtctgcatctgtaggacanagagtcaccatcacttggacggcaagtcagagcattagcaaccttaatttaaagttggtatcgaaggagaacgtacaaggggaaccacccctaaaactcctagacttctatagattcgctaacttccctaatttcgaacgtaaggtcgggtaccatacgtaaggttacagtggactagagtatcgtagggactagtatttccacgtctacacctatacgactacgtagtaccttacgaccctaaccgttaggtaaaggtttctttttacggaacctttaaaacctttaaccgttaacctttacggtaacctaaaccgttaggttaaccgttaacgtacgggttccccgtaccccggttacggggtaaccggtttacccgggaacccgtaaacgggggtaacccgtaaaacggggtaaaccgaaagtttaaacccggaaaacggtaaccgttacgggttacgggtaccgttaacgacctaaaccgtcgttccgtttaaccgg

SEQ ID NO: 287576 - DNA, 639 bp, Homo sapiens
  misc_feature: GYAE6OF01A0T8T.6.19.B08.1.454.CMB.1.raw
  modified_base (262)..(262): a, c, t, g, unknown or other
  misc_feature (262)..(262): n is a, c, g, or t
  modified_base (620)..(620): a, c, t, g, unknown or other
  misc_feature (620)..(620): n is a, c, g, or t
  modified_base (632)..(632): a, c, t, g, unknown or other
  misc_feature (632)..(632): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctcctgtctgcatctgtaggacacagagtcaccatccacgttcgccgggcaagtcagagcattacgactaccttaatttaaatggtatcaggaanaactaccgaagggaaacgacccctaaactcctagactactatgatcgactactacctacgtttcgaacgtaaacgggttcggggtacccctaagtaccgtaaacgggttcgaaggtcggactaagggttcggtaacgttaccgggtaggggaaccgtagttactttaccaccttcctacctaaccctactaccgaagtacctaaggttctacgacctaaccgtagtaacgttattttacgacttaacttactacgttacgactaacgtacgtacgttacgtaccgtcgccccgttacgaccggttaccggacgtaaccgggaccagggtacgtaactacgtaaacgtacgtgtacggntaccgactacgngtcgtcg

SEQ ID NO: 287577 - DNA, 775 bp, Homo sapiens
  misc_feature: GYAE6OF01DI619.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtctccatccctccctgtctgcatctgtaggacacagagtcaccatcacttggccgggcaagtcagagcattagcaaccttaatttaaattggtaatcgaggaagaactaccgaaggaaaccgtaccccttaaaactccgtagtactactatagatcgactactcctacgtttgaccgtaaaggtcggggtaccctagtacgtaaggttactaggtcggtacgagggttcggtaacgttcgggtacgggaacgtaaggttactttttacccgaaccttacctaacccctaaccctaacgtttcccgaacggtacccgtaacgttcccgttaacgaccccttaaacccgggtttagttaaacggttttaacgtttttacggtaacccctttaaaacccgttttacccttaaccgtttaagtaaaccctaaaccgtaaggttaaccgtttaccgtaaccggttcccggttaccccccggttacggggttaaccccgggtttacccggaaaccggtaaaccggggtaaccgtaaaggggtaaacggtaaaacctaacccgtaaaacggtaacgttcggtacggtaccgtacgaaccctaacccgtagttccgttaaccg

SEQ ID NO: 287578 - DNA, 707 bp, Homo sapiens
  misc_feature: GYAE6OF01DD8ZX.6.19.B08.1.454.CMB.1.raw
  modified_base (273)..(273): a, c, t, g, unknown or other
  misc_feature (273)..(273): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatcgacccagtcctccatccctccctgtctgcatctgtaggacacagagtcaccatcacgttcggccgggacaagtcagagctaattacgctaaccttattttaaagttggtatacgagganaactaccgaagggaaacacccctaaactcctagactctatgatcgactacttcctactttgacgtaacgggtcgggtacctaagtaccgtaaggttcgaggtcggacgtaggtcggtaacttcgggtagggaactaggttacctttcgaaccttcctaccacctatccgaaggtcctacggttctaacgtacctaaaccgttaggtaaacgtttacgttttaccgaacctttaaacgtttactaaccgtagtaaccaaacgtacggttaacgtttaccgacggttaccccgtccccgggttacggggtacccggttccgaacccggggtaaacgggtacccggtaaaaggggtaacggtaaaccgttaaaccggtaaaccgggttacgtagggttccggtaccttaccggacccttaactacgttccgttaccg

SEQ ID NO: 287579 - DNA, 744 bp, Homo sapiens
  misc_feature: GYAE6OF01BZC9D.6.19.B08.1.454.CMB.1.raw
  modified_base (227)..(227): a, c, t, g, unknown or other
  misc_feature (227)..(227): n is a, c, g, or t
tcagatatcgcgagcacgaccggtgctcgatttagtgagtcagtaagggggagtcagtctcagtcaggacacagcatggacatggagggtccccgctcagctccgtggggctcctgctactctggctcggaggtgccagatgtgacatccagatcgacccagtcctccatccctccctgtctgctatcgtgtacggacacgagacgtcaccatcacgttggccgganaagtcagagctattacgactaaccttaatttaaagttggtatcgaaggagaactaccggaagggaactacccctaaatccgtagtactacttagtgtactgacctactaccttacgtttacgaacgtaaacggtcgggtacctagtacgtaggttacgaggtgtacgtaggtagtacgtacggtacgggacgtaacgtctttacgacttaccgactaacctagttaccgagtactacgttacgtaccgtaacctaaccgttaaggttaacgtttaacgttttaccgaacccgttttaaacctttaaccgttaccttaacgttaaccgaaacggtttaccggttaacgtttaacccgtacggttaccccgtacccccgggtttacggtaacccggtttacccgggaaccgggtaaaccggaaccggttaaacgggtaaacggttaaacgtaaaccggttaaaacggtcggttaggttaccggtccgtaacgtacccgtaaccttacgttcgttacccg

SEQ ID NO: 287580 - DNA, 903 bp, Homo sapiens
  misc_feature: GYAE6OF01D7VRO.6.19.B08.1.454.CMB.1.raw
  modified_base (204)..(204): a, c, t, g, unknown or other
  misc_feature (204)..(204): n is a, c, g, or t
  modified_base (221)..(221): a, c, t, g, unknown or other
  misc_feature (221)..(221): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtctccatcctccctgtctgcatctgtaggacacgagacacactntactacgtcggccgganagacgagacgactagtacgacctaactttaagttttaagttggtatacgaaggtaacgtaacgtaccggaaacgggaaacccgtacccccttaaacgttccgttaacgtacttacgttagtacgtagttacgacgtacctttacctttaacgtttacggaacggttaaacggggttcccgggttaccgtaacgttaaccgggttaaacgggtttacgtacgggttacgggacggttaacgggtcggtacgttaccggggtaagggtaactaacggttttacctttacccgtacctttaccctaacccgtaaccttaaccgtacgtaccggtacctacggttaaccgtacggtaacccgttaacgttaaggttaacggttttacttttacccgtaacccgtttaaacgttttaaccttaccggttacgtaaaaccgtaacgttaaacggttaaacccgtttaccggtaacccgggtttacccccgttaccccgggttaacgggtttaacccccggggtaccggggaaaacccgggtaaacccggggtaaagggtttaaacccgggggtaaaaacgttaaaccgggttaaacccggttaaaaccggttaaacgggttccgggtttaaacgggaccgttaacccggtaacccttaaaccgggtttcccttaacggttttacccgg

SEQ ID NO: 287581 - DNA, 873 bp, Homo sapiens
  misc_feature: GYAE6OF01BATUX.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatcgacccagtcctccactccctcctgtctgctatcgtgtacggacacgagagtccacctatccacgttcggaccgggacaagtcgaagacgactaacttacgaccttaaccgttaaattttaaagttgttaactacggtaaggaacgtaacgtaccggaaacggggaaacccgtaaccccttaaaacgttccgtacgtacttaccgttaagtgaacgtcggtacctacgttacccgttagtttacggaacggttaaacgggtccgggtaccctaagttaccgttaaagggttcgtaaggtcggtacgtaagggttggtacgttacggtaacgggtacgtaaagtttacgtttacctaaccgttaccacccgtaaccctaagtaccgtaaacgtcgtaacgtacccgttaacgggtaaacccctaaccgtttaagtaaaacgggttttacttttcccggaaacctttaaccttttaaccgaacgttttcgaaaccgttaacgtaaacgtttacggttaaaccgtcccgggtttacccgtaacccccgggttaacggggttacccgtttaacccgggggaaacccgggtaaaccggggtaaaaacccgggtttaacgggtaaaacgggttaaaaccctaacccgggtaaaaaccgttacgggggttacgtaaaccgggtactacccggttaaactacccggttaacgttcccgttttaacccg

SEQ ID NO: 287582 - DNA, 862 bp, Homo sapiens
  misc_feature: GYAE6OF01EDVNM.6.19.B08.1.454.CMB.1.raw
tcagatatcgcgagcacgaccggtgctcgatttagtgagtcagtaagggggagtcagtctcagtcaggacacagcatggacatgagggtccccgctcagctcgtgggctcctgctactctggctccgaggtgccagatgtgacatccagatcgacccagtcctccactccctcctgtctgctacttcgtaggtaacggaccaacaggtacgtaccaacctattccgaaccgtttcgggacccggggtacaaacggttcaaggtacgaccttaagtttaacggaccttaaaccttttaaagtttttaaaacgtttcgggttaattaccggaaagggtaacgtaaacgttacccggaaacgggggtaaaacctacccccttaaaacgttccgtaaggtaacctttaccgtagttacgaacgttcggtacttaccgttaacccgtttacgttttacggaaccgttaaaacgggttccgggtaaccccttaagttaccgtaaagggttccgtaggtacggtacgtacgggtaggtacgttacgtacggggacttaacgttactttacgaccttcgtaccacctagtcgacgtacgtagtccagtacctaaacggttgaaagtttcgttttaccgaacctttaaacgtttaccctacgtttaacgaaccgtaaacgttacggtacgtttaacgacccgtttacccggtaccccggttacgggttaacccgggttcccgggaaacggtaaaacccgggtaaacggttaaaccggtaaacgggtaaaacgttaaacccgtaaacggttaaaccgttcgggtaacgtacccgttacggaacctaccggtttaacggtccttttacccggg

SEQ ID NO: 287583 - DNA, 602 bp, Homo sapiens
  misc_feature: GYAE6OF01A6WUQ.6.19.B08.1.454.CMB.1.raw
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagacgtcaccatcacttcggccgggcaagtcagagcattagctactaatttaaatggtatcagganaatccgaggaaacncccctaaactcctagatctagtgactgctactcctactttcgacgtaaaggtcgggtacccaattacgtaacgggttctaggtcggacgtaggttggacttcggtaggactagtactttacaccttctactaccatcacgctagtctacgactaacgtagtaagttattttacgactttaacttaacttactacgtacaacgtacgtaacgttacgacgtccgtcccgtacggtaccggttccggacgtaaacgggaaccgtaagggtaacggtaaagtacggaaaccgtaacggtgtacggtcgtacgtaccgacctacgtcgttaccg

SEQ ID NO: 287584 - DNA, 618 bp, Homo sapiens
  misc_feature: GYAE6OF01A2P4B.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttggccgggcaagtcagagcattagcaccttatttaaattggtatcaggagaatccgaagggaacacccctaaatcctagatctatgatgacactccactttgactaaaggtcgggtacccagtcgaaggttcaggtcggacaggtggatcgtaggggacaggtactttcgacttcctacacctatacacggctacgtcctacgacctaaaccgttagtaacgttactttttacgaccttaaacctttacgtacttcgtaacaacgtaggtaacgtttaccgaacgttccgtacccccgttgggtaacccgtttccgggaacccggaaacgggtaacccgtaaaagggttcggaaaacttaccggaaaaccggtaacgttaggacggtactacgaccacctagtcgttaccg

SEQ ID NO: 287585 - DNA, 535 bp, Homo sapiens
  misc_feature: GYAE6OF01EWZHP.6.19.B08.1.454.CMB.1.raw
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
  modified_base (391)..(391): a, c, t, g, unknown or other
  misc_feature (391)..(391): n is a, c, g, or t
  modified_base (425)..(425): a, c, t, g, unknown or other
  misc_feature (425)..(425): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagagcattagctaactatttaaatggtatcgagganaatccgaagggaaacncccctaaatcctgatctatgatgcatcctatttgactaaaggtcgggtaccatacgaaggttcaggtggctaggtggaattcgtgggacagtactttcacttcacaccatcagctagtcngactactagaagttatttcgactaacttactatntacaatagtattacagttccgaccccgtaggtaccgttcgaccgaacgggaaccgtaagggtacgaaatacgaaaacgacgtggtacgacgtcaacctactagtcttacg

SEQ ID NO: 287586 - DNA, 729 bp, Homo sapiens
  misc_feature: GYAE6OF01EARMB.6.19.B08.1.454.CMB.1.raw
tcagatatcgcgagcacgaccggtgctcgatttagtgagtcagtaagggggagtcagtctcagtcaggacacagcatggacatgacgggtccccgctcagctccgtggggctcctgctactctggctccgaggtgccagatgtgacatccagatcgacccagtcctccactccctccctgtctgcatcgtgtaggacacagacgtccaccatcctacgttcggacccgggacaagtcgaggacgactatttagacctaacctttaattttaaaacgtttggttaattacgaaggggaacgaaacgttacccggaaacggggaaaaccgtacccccttaaaacgtccctaggtaacttccttaagtgtatcgacctactaccttacgttttacggaccgttaaacgggtccgggtaccctagtacggtaacggttcgaggtcggacgtaggtcggtactcggtagggaactagttactttcaccgttctaccgacctactacgactacgtagttcctacgaaccctaacgtaggtaactttagtttaccactttaacttaacgttacgttacgtacgaaactaggtacgttaaccgtaccggttcccaccccgggtacggtaccggtaccggtaaccgggaaacgggtaccgtaaaccgggtaacgtaaactaaccggaaaaccgtacggttggaccgtaccgtacggacccaaccttcgttcgttaccg

SEQ ID NO: 287587 - DNA, 613 bp, Homo sapiens
  misc_feature: GYAE6OF01CGKYQ.6.19.B08.1.454.CMB.1.raw
  modified_base (269)..(269): a, c, t, g, unknown or other
  misc_feature (269)..(269): n is a, c, g, or t
  modified_base (289)..(289): a, c, t, g, unknown or other
  misc_feature (289)..(289): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctttctgcatctgtaggacacagagtcaccatcacttgccgggcaagtcagagctaattagacctaaccttaattttaaaattggttaatcgaagganaaactccgaaggggtaaacnccccctaaaactccgtagattctatgatgcatcctatttgacgtaaaggtcgggtacccagtacgaaggttcgaagtcggactaggtaggtactcgtagggactaggtactttcgaccttctcaacctatcagtcagtctgacctaacgtagtaacttatttcgacttaaaccttactactgtaacaacgtaggtaacttaccgagttaccgtaccccggtacgggtaccgttaccgggaccgtaaggggaaccgaagggttaacgaaaacgttacgaaaacggtcgtaggtacgacctagacccaactacgttcttcgtaccc

SEQ ID NO: 287588 - DNA, 788 bp, Homo sapiens
  misc_feature: GYAE6OF01BXQYG.6.19.B08.1.454.CMB.1.raw
  modified_base (201)..(201): a, c, t, g, unknown or other
  misc_feature (201)..(201): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctcgaggtgccagatgtgacatccagatcgacccagtcctccacttccctccgtgtctgctatcgtaggtacgacanagacgtacacctatcacgttcggccgggacaagtcgaagcgtactaagttacgacctaacctttaattttaaagttggtaactacgaaggaagtaacgtccggaaacggtaaacctccccttaaaagtccgtaggtacttactagtgactcgactactccttacgttagacgtaacggttccggtacctacgttacgtaacggttcgacggtggaccgtagggtacgtacgttacggtagggtacttaaggttcttacctacgtacctaccgaacctagttaccgaagtaccgtacgttaccgtacggtaaccgtaacgttagtaaacgtttacgtttaacgaacctttaaacgtttacctacgtaacggtaactaaacggttacgttaacgtttaaccgacgtttcccggaacccggtttacgggtaccggttaccgggtaaaccgggttaaacggggtaaaccccgggttaaagggttaaacccggtaaaacgaaaccggttaaacccggggtaacgttttacgggggaaccgtaccggtttaacccgaacccttaaccggtttacgtttccggtttaaacccgg

SEQ ID NO: 287589 - DNA, 604 bp, Homo sapiens
  misc_feature: GYAE6OF01CH5XZ.6.19.B08.1.454.CMB.1.raw
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
  modified_base (277)..(277): a, c, t, g, unknown or other
  misc_feature (277)..(277): n is a, c, g, or t
  modified_base (468)..(468): a, c, t, g, unknown or other
  misc_feature (468)..(468): n is a, c, g, or t
tcagatatcgcgagcacgaccggtgctcgatttagtgagtcagtaagggggagtcagtctcagtcaggacacagcatggacatgagggtcccccgctcagctccgtggggctcctgctactctggctccgaggtgccagatgtgacatccagatgacccagtcctccatccctccctgtctgctatctgtaggacacagacgtcaaccatcacttgaccggganaagtcaganctaattagacctaacttaatttaaaagttggtaatacgaagganaactaccgaaagggaaacgacccctaaactcctagatactatgatgctatctaacttgactaaaggtcggtaccatacgaagttcgaagtcgacgtagtgtagtcgtagggactagtatttaccactctacactatacagctagtctagactaaccgagtaattagtttcgaactaacctttacaacgttnacaacgtagttaacgttacgacgttccgaccccgttagggtaccgttccggaaccggaaacgggaacgtaaagggtacgtaaacgtaacgtaaaacgacgttaggacggtacgactaaccacctagttccgttacg

SEQ ID NO: 287590 - DNA, 705 bp, Homo sapiens
  misc_feature: GYAE6OF01CNJ3X.6.19.B08.1.454.CMB.1.raw
  modified_base (697)..(697): a, c, t, g, unknown or other
  misc_feature (697)..(697): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccggaggtgccagatgtgacatccagatgacccagtctccatccctcctgtctgcatctgtaggacacgagagtccacatcacttggccgggacaagtcagacgctattagacctaacctttaattttaaattggtaatcgaaggaagaaatacccggaagggaaaccgacccccttaaaagtcctagtactacttatagatcgactacttcctaacttttggaaccgtaaagggtcggggtaccctagttacgtaacgggtttccaaggtcgggacgtaggttcggacttcgggtaacgggtaactaggttactttaccaccgtttacctaaccctaacctaacgttaccgaggtacccttacgggtccttaacgaccgtaaccgttagtaaacgttaccttttacggaaccttaaacgtttactaaccgtttcaaaccgtaacgtaagttaacgttacgtaccggttcccgtacccggttacggtaccgttaccggaaccggtaaacgggaacgtaagggtaacgaaattaccggaaaacgtacgtaggtcgtaccgtcgacctacgtntcgttacc

SEQ ID NO: 287591 - DNA, 675 bp, Homo sapiens
  misc_feature: GYAE6OF01C0BFM.6.19.B08.1.454.CMB.1.raw
  modified_base (94)..(94): a, c, t, g, unknown or other
  misc_feature (94)..(94): n is a, c, g, or t
  modified_base (188)..(188): a, c, t, g, unknown or other
  misc_feature (188)..(188): n is a, c, g, or t
  modified_base (216)..(216): a, c, t, g, unknown or other
  misc_feature (216)..(216): n is a, c, g, or t
  modified_base (666)..(666): a, c, t, g, unknown or other
  misc_feature (666)..(666): n is a, c, g, or t
tcagatatcgcgagcacgaccggtgctcgatttagtgagtcagtaagggggagtcagtctcagtcaggacacagcatggacatgagggtccccntcagctcctgggctcctgctactctggcctcgaggtgccagatgtgacatccagatcgaccagtcctccatcctcctgtctgcatctgacgcanagagtaccactatctacgtggaccgganagtcgagagtactatacgactaaccttaatttaaacgttggtaatacgaaggaagtaacgtaccgaacgggaaacctaaccccgtaaactccgtagtactacgtatagaactgactacttacctactttacggaacgtaacgggtccgggttaccagttacgtaacggttcgaggtcggactaggtgtaactcggtagggaactacggtttacttaccgtacttaccaccgtaactaacgttaccggacgtacgttaccggttactaaccggacctttaacccgtaaggttaacgtttactttacgtaaccctttaccgttaacttaacgttcgtaaactaagtaacgttacgtactacggtcccgtaccgtacggtacgttacccgcggaaacggtaacggacgtaacggaacttacgaaacgtacgtcgtcgtcgtaacgctaacgtnttcggtacc

SEQ ID NO: 287592 - DNA, 918 bp, Homo sapiens
  misc_feature: GYAE6OF01CDG5F.6.19.B08.1.454.CMB.1.raw
  modified_base (232)..(232): a, c, t, g, unknown or other
  misc_feature (232)..(232): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatgacccagtctccatcctccctgtctgcatcgtgtaggacacgagtagtccaacatcacgttcggccggacaagtcagancattacgactaacttaattttaaacgttggtaactcgaaggtaacgtaacgtaccgaacggggtaaaactacccccgttaaaacttcccgtaggtaactaccgttaagtagtaacgttacggtacctaacgtttacccgttaacgtttttacggaaccgtaaaagggtttccggggtacccctaagttccgtaaaagggtttcgtaacggttgggtactaagggtcggtaactccgggtagggtaaaccgttagttaaccgttttaccgtaaccgttacccgttaccgaaacccgttaacgttacccgtaaacggtaccgtaaccgggtttaaccgttaacggtaaaccccgttaaaccggttaacgggttaaaaccggttttaacgttttttaccgtaaacccgttttaaaacccgttttaaccgttttaaccgttaacggttaaaccgtaaaaccggttaacggttaaacccgggttttaacgtaacccgggtttaccccggtaccccgggtttacgggttacccgggtttaacccgggaaacccgggttaaccgggggtaaaaacccgtaccgggggtttaaaacggaaaacccgttaacggtaaaaaccccggttaacgggttacggttaaccgggtaaccgtacgtaacccgggtaacttaccgttaccgttttaacccgg

SEQ ID NO: 287593 - DNA, 616 bp, Homo sapiens
  misc_feature: GYAE6OF01E147N.6.19.B08.1.454.CMB.1.raw
  modified_base (274)..(274): a, c, t, g, unknown or other
  misc_feature (274)..(274): n is a, c, g, or t
  modified_base (356)..(356): a, c, t, g, unknown or other
  misc_feature (356)..(356): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacgttgccgggcaagtcagagcattagctaccttaatttaaatggtatcaggagaatccgaagggaaacncccctaaatcctagatctatgatgacatcctatttcgactaaaggtcgggtaccagtcaagggttcagtggcagtggatcgngggacagtactttcactctaccactatcagctaagtctacggacctaaccgtagtaagttacttttacgaaccttaaactttacctacttacgtaacctaaagtaggtaacgtttaaccgacggttcccgacccccgttacggggtaccgttaccggggacccgaaacggggtaacccgtaaaggggtaacgaaaacgttaaccgaaaacggttacgtacggtacggtaccgtacggaccctacccgtatccgttacccg

SEQ ID NO: 287594 - DNA, 605 bp, Homo sapiens
  misc_feature: GYAE6OF01BN5Y7.6.19.B08.1.454.CMB.1.raw
  modified_base (294)..(294): a, c, t, g, unknown or other
  misc_feature (294)..(294): n is a, c, g, or t
  modified_base (380)..(380): a, c, t, g, unknown or other
  misc_feature (380)..(380): n is a, c, g, or t
  modified_base (397)..(397): a, c, t, g, unknown or other
  misc_feature (397)..(397): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatgacccagtcctccatccctcccgtgtctgcatctgtacggacacagagtccaaccatccacgttggcccgggcaagtcagagctattagcaaccttatttaaattgtatcaggagaatcagggaaacacccctaaactccngatctatgatgcatcctactttcgactaaaaggtcgggtaccatacgtaaggtcagtggactagtaggtactcgtagggactagtntttacgactctcgaacnctacgactcacgtctaggactaacctgtaagttacttttagaccgtaacttaactaacttcgtaacaacgtacgtaacgttaactacggtcgtacccccgtagggacccttccgggaaccgaacgggtaaccgaaacgggtaacgtaaacgtaacgaaaccggtaactagggtcgtacgtacggtaacctaccgtagttccgttaccg

SEQ ID NO: 287595 - DNA, 660 bp, Homo sapiens
  misc_feature: GYAE6OF01DDQBT.6.19.B08.1.454.CMB.1.raw
  modified_base (273)..(273): a, c, t, g, unknown or other
  misc_feature (273)..(273): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatccctcctgtctgcatctgtagacacgagagtcaccatcacgttgccgggacaagtcagagctattacgctaccttatttaaattggtatcaggagaatccgaggaacnccctaaaactcctagatctatcgatgctatcctactttcgacgtaaggtcgggtacctagtacgtaacggttcaggtggacgtaggtggtactcgtagggacgtagtactttccactccgtaccactactcgagctacgtctacgacgtaacctaggtaacgttatttaccgactttaaccgtttactaccgtttagtaaccgtaacgtaacggttaacgttacgtacgggttacccgtaccccggttcggttaacccggtttcccgggaaccggtaaaacccggggtaccggtaaacgggttaacgggaaaccgttaaccggtaaaaccggtaccgtttagggaccggtacgttaccgaccgttaccctacgttcccgtttaaccg

SEQ ID NO: 287596 - DNA, 708 bp, Homo sapiens
  misc_feature: GYAE6OF01CMKZN.6.19.B08.1.454.CMB.1.raw
  modified_base (225)..(225): a, c, t, g, unknown or other
  misc_feature (225)..(225): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtcctccatccctccctgtctgcatctggtaggacacgagagtccaccatcgacgttggccggganaagtcaggacgtactattacgactaccttaatttaaagttggtatacgaggaagtaacgtaccgaagggtaaaccgtaccccctaaaacgtccttagacttctatacgtagtcgactactacctacgtttacgacgtaaacggtcgggtaccctaagtacgtaacggttacgagtcggacgtaggtggtacgttcgtagggtaacctaggttacttacctaccgttcctacctacgtaactacgtacgcgtaacgttctacggtaacctaaccgtaaggtaacgttaacgtttcgtaacccttaaacgtttacttaaccgttacgttaaaccaagttacgttaacgttacgtaccggttccgtacccggtcgggttaaccgttacggaccgtaaacgggtaaccggtaaacggtaacggtaaacgtaacgaaccggtaacgtacggtacgacgtacgtaaccgaaccgttcgtccgttaaccg

SEQ ID NO: 287597 - DNA, 715 bp, Homo sapiens
  misc_feature: GYAE6OF01B2JX5.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctcctgctactctggctccggaggtgccagatgtgacatccagatcgacccagtcctccactccctccctgtctgctatcgtgtaggacacagagtcacatcacgttcggccgggacaagtcaagagtacctaattacgactaaccttaagttttaaagtttggtaattacgaagggtaacgaaacgttacccggaaacggggtaaaaccgtaacccccttaaaacgttcccgtaagtacttaccttataggtatcgactacgttaccctatttacgaacgtaaacgggtcgggtaccctaagtacgtaacggtcgagtcgggactaggtggtactacggtagggaactagtactttccgacttccacgacctatcacgactacgtctacgactaacgtagtaattacgtttacgaacttaaccttacgtaacttacgtaacctaaacgtaggttaaccgttacgacccggttcccggtacccccggttgggttaacccggttaccggaacggggtaaccggaaacgggtaacgggtaaactaaacggtaaccgaaacggtaacgttcggtacggtacttaccgaaccgtacctagtttcctacgg

SEQ ID NO: 287598 - DNA, 790 bp, Homo sapiens
  misc_feature: GYAE6OF01E29ND.6.19.B08.1.454.CMB.1.raw
  modified_base (95)..(95): a, c, t, g, unknown or other
  misc_feature (95)..(95): n is a, c, g, or t
tcagatatcgcgagcacgaccggtgctcgatttagtgagtcagtaagggggagtcagtctcagtcaggacacagcatggacatgagggtccccgntcagctcctggggctcctgctactctggctccgaggtgccagatgtgacatccagatgacccagtctccatcctcctgtctgcatctgtagacacagagtcacctatctacttcggaccgggacaagtcagacgctattacgactaacctttaattttaaacgttggtatacgaaggaacgtaactaccggaacgggaaaccgtacccccttaaacgtccgtagtaacttacgtaagttagaactcgtacctacttaccctagtttacgacgtaacggtcgggtacctagtacgtacgttacgaggtacggactaggtggtactacgggtacgggtaactaggttactttaccgtaccttccgtaaccctacccgtacgtacgaacggtacgtaacggttaccgtaccgtaaccgtaacccgtttaaggtaaaccgtttacgttttacggtaaccctttaaaccgtttaaccgttacgttaaccgttaaccgtaaaccggttacggtaaccgttttaaccgaacccggtttccccggacccccgggtttacggggtacccggttaccgggaacccggttaaacgggaaaccccggtaaaggggtaaccggtaaaaccgtaaaccggtaaaaccgggttaaccggtacggttaacggtaaccgtaccggaaccttaaccctagttcccgtttaccg

SEQ ID NO: 287599 - DNA, 702 bp, Homo sapiens
  misc_feature: GYAE6OF01CLGIV.6.19.B08.1.454.CMB.1.raw
  modified_base (146)..(146): a, c, t, g, unknown or other
  misc_feature (146)..(146): n is a, c, g, or t
tcagatatcgcgagcacgaccggtgctcgatttagtgagtcagtaagggggagtcagtctcagtcaggacacagcatggacatgagggtcccccgctcagcctccgtggggcctcctgctactctggctccgaggtgccagatgtnacatccagatgaccctagtcctccactccctccctgtcctgctatctgagacacgtagatcacatcacgttgccggactaagtcagagactaattacgacctaaccttaagtttaaaagttggtaactagaacggtaagaacctaccggaaacgggaaacctacccccttaaactccgtagattacctaagtagagttacgctaacttaccgtaacctttggaaaccgtaaacgggttcgggtaaccctagtaccgtaaaggttcgaggttgactaggcgtagtcgtaggactagttacttacactcactaccatctagctacgtacacgacctaacgtagtagtttacgttactaacttaaacttacttaactacgtaaaccaacgttaacggtaacgttacgtaaccggtcccgtacccggtacccgggtaacgttaaccggaacccggtaaacgggtaaccggtaaacggtaaacggtaaaaccggtaaacgaaaccggttaaacggtggttaaccgtcggtaaccgtaaccctaactccgttcgtttacccg

SEQ ID NO: 287600 - DNA, 696 bp, Homo sapiens
  misc_feature: GYAE6OF01B6W8G.6.19.B08.1.454.CMB.1.raw
  modified_base (285)..(285): a, c, t, g, unknown or other
  misc_feature (285)..(285): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtccaccatcacttggccgggacaagtcagagctattagactaccttaatttaaagttggtatacgaaggagtaactccgaagggaaacncccctaaactccgtagactactatgatgctactcctacgtttagacgtaaacggtcgggtaccctagtacgtaaggtttcaggtcggtacgtaggtaggtactccggtaggggtaactaggttactttaccgtaccttaccgtacctaacctagtaccgtaacggtaccgtagttaccgtacgtaaccctaaccgttaagtaaacgtttacgttttacgaacctttaacctttaccgttacgttacgtaacccaacgtacgttaacgttaccgacggttcccgtaccccggttacggttaccggttaccgggaaccgtaaacggggtaacctaaaggggtaacggaaacttaaccggtaaacggtacggttacggtacggtaccgtacgacctaccgtacgttcgttaccg

SEQ ID NO: 287601 - DNA, 672 bp, Homo sapiens
  misc_feature: GYAE6OF01C4API.6.19.B08.1.454.CMB.1.raw
  modified_base (94)..(94): a, c, t, g, unknown or other
  misc_feature (94)..(94): n is a, c, g, or t
  modified_base (278)..(278): a, c, t, g, unknown or other
  misc_feature (278)..(278): n is a, c, g, or t
  modified_base (316)..(316): a, c, t, g, unknown or other
  misc_feature (316)..(316): n is a, c, g, or t
  modified_base (620)..(620): a, c, t, g, unknown or other
  misc_feature (620)..(620): n is a, c, g, or t
tcagatatcgcgagcacgaccggtgctcgatttagtgagtcagtaagggggatcagtctcagtcaggacacagcatggacatgagggtccccgntcagctccgtgggctcctgctactctggctccgaggtgccagatgtgacatccagatcgacccagtctccatccctcctgtctgctattctgtagaccacgagactaccacctatccacgttcggccccggataagtcagagtctaattagctaacctttatttaaagttggtatcgaaggtanactaccgaagggaacctccctaaactcctagactctangatgcactcctacttgacgtaaggtcggacccagttacgtaaggttctaggtcggtcgtaggtaaggtcttacgggtgggaaactaaggtttcttacggaaccttaccgtaccaccgtaataccgtagtaccgtacgttacgacgtaacctacgggtattaacgttactttcgaaccttaactttcctaactacgtaaccgaacgtaggtactccgtaccgtccgtacccggttaccggtaaccgtccgggaaccgaaaccgggtactaaacggggttactaaaaccggtaccggttaaaaccnggttacggtacccggattacccgtaacccgacccgttgttacccggttaacg

SEQ ID NO: 287602 - DNA, 719 bp, Homo sapiens
  misc_feature: GYAE6OF01BJUWB.6.19.B08.1.454.CMB.1.raw
  modified_base (248)..(248): a, c, t, g, unknown or other
  misc_feature (248)..(248): n is a, c, g, or t
tcagatatcgcgagcacgaccggtgctcgatttagtgagtcagtaagggggagtcagtctcagtcaggacacagcatggacatggagggtccccgctcagctccgtggggctcctgctactctggctccgaggtcgccagatggtgacatccagatcgacccagtcctccactccctccctgtctgctattcgtaggtaggacacgagacgtaccaccatctacgttcggccgggataagtcgagganactattacgaccttaaactttaagttttaacgtaggtactacggaaggaacgtaacgtaccggaaacgggaacctaacccgtaaactccgtagtacttactagtgtatcgacttacctaccttacgttacggaacggttaacggtccggtaacctacgtaacgtaacggttacggaggtacgtacggtaacggtacggacgtttacggaggtaaccgttagttacttacccgacttaccgtacctacgtaactacgacgtacgtacttcgaacctacgtaaccgtagttacgttactttacgacctttaacttacgttagaacttaagaaacgttcggtaaccgttacgtaccggtcccgttaccccggtagtaccgggtacggaacggtaaacgggaccgtaaagggactaaacggtacgtaaaccggtgtacgttacggcgtaacctaccgtacgtagtttcgtaaccg

SEQ ID NO: 287603 - DNA, 788 bp, Homo sapiens
  misc_feature: GYAE6OF01B8GMB.6.19.B08.1.454.CMB.1.raw
  modified_base (95)..(95): a, c, t, g, unknown or other
  misc_feature (95)..(95): n is a, c, g, or t
  modified_base (604)..(604): a, c, t, g, unknown or other
  misc_feature (604)..(604): n is a, c, g, or t
tcagatatcgcgagcacgaccggtgctcgatttagtgagtcagtaagggggagtcagtctcagtcaggacacagcatggacatgagggtccccgntcagctccgtggggctcctgctactctggctccgaggtgccagatgtgacatccaagatcgacccagtcctccactccctccctgtctgctatcgtgtaacggacaacagtacgtccaacctatcaacgttcgggccgggacaaagtcgaagagtactaattacgaccttaacttaattttaaaagttggtaatacgaaggtaacgaaacgtaccgaaagggtaaacctacccccttaaaactcccgttagtacttacgttaagtgtaactgacctacttacccgtacgtttacgaaccgtaaacgggtcgggtaaccctagtaaccgtaagtacgtaggtcggagtaggtgtagtacgtagggaacagttacttacaccgtctacccactatacgaacggtctacgtcctacgtaacctaaccgtagtaaacggtttactttacgaacctttaaactttaacgtaacgtacgttaaaccgaaacgtaaacggttaaccggtttaaccnccgggttaccccgtaacccccggttacggtaaacccggtttaccccgggaaaaccggggaaaacggtttaaaccccgggtaaaagggttaaaccgggaaaacttaaaccggtaaaaacccggtaaccgtttggggtaaaccctcggtaaccgaaaccctaacccgttaagttaccgtttacccg

SEQ ID NO: 287604 - DNA, 700 bp, Homo sapiens
  misc_feature: GYAE6OF01BJ9W0.6.19.B08.1.454.CMB.1.raw
  modified_base (334)..(334): a, c, t, g, unknown or other
  misc_feature (334)..(334): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggcctccgaggtgccagatgtgacatccagatgacccagtctccactccctccctcgtctgcatctgtaggacacgagagtcaccactctacgtcggtccgggacgaagtcgagagacaattagacctaaccgttaattttaaattcggtatacgaaggaagtaacgtaccgaacgggaaaccgtacccctaaacctcctagtatacctagtnagtgtactactcctacgttgacgtaacggtcggtcccatacgtaaggttgtagtacggcgtaggtggtacgtacgtagggtaactagtactttacgcctactacctacctacgtaccgtgaaccgttacgcttaccggtaaccaaccgtttaggtaaacggtttacttttaccgtaaccgtaaaccttttaacgtaaccgttacggtaacctaaacgtacggtaaccgttacggtacccgttaccgtacccccggtacgggttaacccggtccgggacccggtaaaaccggtaacgggtacggtaaacggtaaacaaccggtaaagtccgtaggtcgttaccgaggtaccaccttgtcgttacccg

SEQ ID NO: 287605 - DNA, 565 bp, Homo sapiens
  misc_feature: GYAE6OF01EMGH6.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggggctcctgctactctggctccgaggtgccagatgtgacatccagatgacccagtctccatcctccctgtctgcatctgtaggacacagagtcaccatcacttcgccgggcaagtcagagcattagcacctatttaaattggtatcaggagaatccagggaaagacccctaaacctcctgatctactgatgcactccactttagcgaaagtgggtcccgaagtcaaggttcagtggcgagtggatctgggactagatttcactctcacctatcagcagtctcgcaactgtaatatttcgactaactttacttactagttacaacgtagtaagttacacgttcggtccctcgggaccggttcggacccgaaacgggaacccgaaaggggttacggtaaaacgtacgaaaacggtaacgaggttacggacggtacgaccgtaacctacgtaccgtttacgg

SEQ ID NO: 287606 - DNA, 819 bp, Homo sapiens
  misc_feature: GYAE6OF01C77L9.6.19.B08.1.454.CMB.1.raw
  modified_base (192)..(192): a, c, t, g, unknown or other
  misc_feature (192)..(192): n is a, c, g, or t
tcagatatcgcgagcacgaccggtgctcgatttagtgagtcagtaagggggagtcagtctcagtcaggacacagcatggacatgagggtccccgctcagctcctgggatcctgctactctggctccgaggtgccagatgtgacatccagatgacccagtctccatccctccctgtctgcatctgtaggacanagagtcaccatcacttgccggcaagtcagagcattagcacttattaaattgtatcgagagaatccgaaggaacacccctaaacgtcctagatctagtagatgactacttaccctaattttcggaactaaacgggttcggggtacccctaagttaccgtaaaaggggttttccgaaggtttacggggaccgttaaagggttcggggtaactttacccgggttaagggggtaaaccccgttaaaggtttaaccttttacccgttaacccttacccgtttaacccccgaaaccccttaagtttacccgaaaaccgggtccctttaaaccgggttaccctttaaccgggaacccctttaaacccggttaaggtaaaacgttttacgtttttaccggtaacccttaaaccgtttttaaccttaaccgttacgttaaacccgaaacgtttaaccggtaacggttttaacccgtaacggtccccggttccccgttaccggggtaaaccggttaccccgggtaaaccggtaaaccggggtaacccggtaaacgggtaaagggtaaaccgtaaacgaaaccgggttaaacgttcgggtacggtaaccacgtacccaaccctagttacgtttacccg

SEQ ID NO: 287607 - DNA, 712 bp, Homo sapiens
  misc_feature: GYAE6OF01BK911.6.19.B08.1.454.CMB.1.raw
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (698)..(698): a, c, t, g, unknown or other
  misc_feature (698)..(698): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggcctccgaggtgccagatgtgacatccagactcgacccagtcctccactccctcctgtctgcatcgtgtacggacacagacgtccacatccacgttcggccgganagtcagactanacttacgactaacttaagtttaagtcgtatcgaaggtactacgtacggaacggtaacccgtacccttaacgtcgtatactctagtacgatcgactactactacgtttagaccgttaacgggtccggtaacctacgtacgtaacgttcgacggtgacgtaggtcggtaacgttacggtacgggaactaggttacccttacgccctttacgtaaccctaccgttaaccgtcgaacggttaccctaaggtaccctaaccgaaccgttaaccgttaaggtttaaaccgtttccgtttaacgtaaccctttaaacgtttaccgtaacgttaacgtaacccgttaaacggttacccgtaacgttaaccggtacccggtttacccgacccggttacgaccggttaccgtaaccggaacggtaaccgtaggtaacgtaacgaaccgagtacgtgacgtacgctaccnctaccgtcgtaccg

SEQ ID NO: 287608 - DNA, 848 bp, Homo sapiens
  misc_feature: GYAE6OF01BBIMK.6.19.B08.1.454.CMB.1.raw
tcagatatcgcgagcacgaccggtgctcgatttagtgagtcagtaagggggagtcgagtctcagtcaggacacagcatggacatgagggtccccgctcagctcctgggctcctgcctactctggctccggaggtcgccgagagtcgtgacatcccagatcgacccagtcctcccactccctccctgtctagctatcgtgacgacacaggactcaaccatacacttcggaccgggactaagtcagacgtactattacgccttaaccttaagttttaaacgttggtaacgtaccgaagggaacgtaaacgtacccggaaaggggaaaacccctacccccgttaaactccgtagtactaccgtattacggacgtacgtacctacgttacctaaccgtttaggaaccgttaaacgggtccggtacccctaaggtacccgtaaacgggttccgtaaaggtcgtaaccggtaaggtacggtaaccgtttcgggaacgggtaacttaccgttactttacccgacttccgtaaccgtacctagtaccggtacgtacggtacgttccgtaacgtaaccgttaacccgttaggtaaacgtttaccgttttaaccgaacctttaaacccttttaacgttacccgttaacgtaacccggtaaacgtaacggttaaaccggtttacggtacccggttacccgggtaacccccggttacgggttaccccgggttaacccgggtaaccgggtaaccccggggttaaacggtaaaccgggtaccggtaaaaccgttacccggtaaaaccggtaccggttacggtacgtaccggtccgtaacccgtacctaaccgttcgtacccg

SEQ ID NO: 287609 - DNA, 809 bp, Homo sapiens
  misc_feature: GYAE6OF01BTFXE.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtcctccatccctccctgtctgcatctgtaggacacagagtcaccatcacgttcggccgggacaagtcagacgactattagacctaacctttaattttaaattggtaactacgaaggtaagaaacgttacccggaaaggggaaacctaacccccgttaaaaccttcctaaggtacttaccttaagtaggtaacttgacctaacttccctaacgttttacgaacgtaaagggttccgggtacctaagttacgtaacggttcgtacggtggtacgtaaggttcggtacttcgtagggtaactagttacttttaccaaccgtttcccacctaacctaacgtaccgtacggtaccgtaacgtttccgtaaccgtaaccgttaaacccgttaggttaaacgtttaaccgttttacgaaccctttaaaccttttaacccgttaaccttaacggtaaccctaaacggttacggtaacgttttaaccgaccggtttaccccggtacccccggttacgggtaacccgggttaccggaaccccgggtaaaacggggtaaaccccggtaaaggggtaacccggtaaaacgtaaacccggtaaaacggttaacgttacggtacggtaccgtacgggacccctaactacggttaccgtttacg

SEQ ID NO: 287610 - DNA, 642 bp, Homo sapiens
  misc_feature: GYAE6OF01BAWHP.6.19.B08.1.454.CMB.1.raw
  modified_base (237)..(237): a, c, t, g, unknown or other
  misc_feature (237)..(237): n is a, c, g, or t
  modified_base (278)..(278): a, c, t, g, unknown or other
  misc_feature (278)..(278): n is a, c, g, or t
  modified_base (378)..(378): a, c, t, g, unknown or other
  misc_feature (378)..(378): n is a, c, g, or t
tcagatatcgcgagcacgaccggtgctcgatttagtgagtcagtaagggggagtcagtctcagtcaggacacagcatggacatggagggtccccgctcagctcctggggctcctgctactctggctcgaggtgccaggatgtgacatccagatcgacccagtctccactcctccctgtctgacatcgtagtacggacacgagacgtcactatcacgtcggccggactaagcgagacnctaattacgacctaacttaatttaagttgtatcgaaggtanaactaccgaaggtaacgaccccttaaactctagacttacgtatagtactcgactactacctatttcgaacgtaacggtcgggtaccaagtacgtaacgtnacggtcggtcaggtggacgtcgtagggactagttacgtttcaacgtctaccacgtactacgacgtcgtactccgtacgacctaacggtataaacgttgtttaacgacttaaaccttagtacccttagtacaaagttacgtacgttaaccgtacgtcgtacccgttagggaccttaccgggaacgaaacgggtaccgaaagggttaacggtaacttaacgaaaccggttacgtacgtacgtccgacgtaaccacctgtcttaacg

SEQ ID NO: 287611 - DNA, 787 bp, Homo sapiens
  misc_feature: GYAE6OF01A8JZ4.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtctccatccctcctgtctgcatctgtaggacacagagtcaccatcacgttggccgggacaagtcagagctattacgctaaccgttaattttaaaagttggttaacttacgaaggtaacgaaacgttacccggaaaggggtaaaaccgtacccccttaaaacgttcccgttaggtacttaccgttaataggactaggacctacgttaccctaacgtttacggaacgtaaaacgggttccggggtaccctaagttaccggtaaacggtttccggaaggttacgggacgtaaggtacgggtaacttacgggtacgggtaaccgtaaggttaacttttaccgaaccgtttaccgtaccgtaaaccctacgttaacccaggtaccctaacggttccgtaacgaaccccgttaaaccgtaggttaaacgttactttttaacgaacctttaaacctttaacctacgttaagtaccctaaacgtaggtacgttaacgttccggtaccgttaccccggtcggtaaccggttaccgtaaccggaaacgggtaaaccgtaaacgggtaacgttaaaccaacggtaaaaccgtacgacggttacggaccctacggtaacccaacttcgtaccgtttacg

SEQ ID NO: 287612 - DNA, 612 bp, Homo sapiens
  misc_feature: GYAE6OF01CFX5R.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatccctccctgtctgcatctgtaggacacagagtcaccatcacttggccgggacaagtcagagcattacgctaaccttaattttaaattggtatacgaggaagaataccgaagggaaaccgacccctaaactcctagatctatgatgctactcctactttgacgtaaaggtcgggtaccctagtacgtaaggttcaggtggacgtaggtggactcggtagggaactagttactttaccacttcctaccaacctagtccgacgctagttctacgacctaaccgttagtaaacgttattttacggaacctttaaacttacgttaaccgtgtaacctaacgtaggtacttacgacgtccgtaccccgtcggtaccgttccggaccgaaacgggaccgtaagggtaacgaaataccgaaacgtaacgtgtacggtctagaccactatcgttcg

SEQ ID NO: 287613 - DNA, 578 bp, Homo sapiens
  misc_feature: GYAE6OF01EK3JU.6.19.B08.1.454.CMB.1.raw
  modified_base (259)..(259): a, c, t, g, unknown or other
  misc_feature (259)..(259): n is a, c, g, or t
  modified_base (367)..(367): a, c, t, g, unknown or other
  misc_feature (367)..(367): n is a, c, g, or t
  modified_base (570)..(570): a, c, t, g, unknown or other
  misc_feature (570)..(570): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttggccgggcaagtcagagcattagctacttaatttaaattggtatcagganaatccgaaggaacacccctaaactcctagatctatgatgctattcctactttgactaaaggttcgggtaccaatacgtaaggttcaggtggacaggtggatcgagganagtatttcacttctacaccatacagtctagtctgacctaactgtaaacttacttttacgaccttaactttaactactacgtaacaacgtagtacgttaacacgttaccgtaccccggtacggtaccgttacggaccgtaacgggaaccgtaaggtacggaaactacggaaacgtaacgtcgtacggtacctacgaccaccgtntcgttacg

SEQ ID NO: 287614 - DNA, 609 bp, Homo sapiens
  misc_feature: GYAE6OF01EWYSU.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtcctccatccctccctgtctgcatctgtaggacacagagtcaccatcacttgccgggcaagtcagagcattagctaaccttaatttaaattggtatcgaggagaatccgaagggaaacgcccctaaactcctagatctatgatgctatcctacttttgactaaaggtcgggtacccaagtcgtaaaggttcaggtggactaggtggatcgtgggactagtatttcacttctaccacctatcagtctagtctagacctaacgtgtaagttattttcgacctaactttactacgtgtacaaacgtagtaacgttaccacggttccgtccccggtacgggtaccgttacggacccgtaaacggggaacccgtaaagggttaacggtaaaactaaccggtaaaacggtaacgttcgggtacgtaccgtacgaccctacgtaacgttcgttaccg

SEQ ID NO: 287615 - DNA, 710 bp, Homo sapiens
  misc_feature: GYAE6OF01BI4T5.6.19.B08.1.454.CMB.1.raw
  modified_base (228)..(228): a, c, t, g, unknown or other
  misc_feature (228)..(228): n is a, c, g, or t
tcagatatcgcgagcacgaccggtgctcgatttagtgagtcagtaagggggagtcagtctcagtcaggacacagcatggacatgacgggtccccgctcagctccgtggggcctcctgctactctggcctccggaggtgccagatgtgacatccagactcgaccctagtcctccactccctccctgtctgcatctagacgacacagactcacatctacgtcggccgganagtacagagctagttacgacctaactttaatttaagttggtatacgaaggacaacgtaccggaagggtaaacccacccttaaccgtccgtagtactactagtagtactacgacctacttacccttaagtttacggaaccgttaacgggtccgggtacctaacgtacgtaacggtgacggtcggacgtagggtacggtacgtcggtaggtaactacttaccttaccgtacttaccaccgtacctagtccgacggacctacgtccgtaacgtaacccgtaacgtaggtttaaactttaccgtttaccgtaacccttaaccgtttaccgtaacgttacggaaacctacgttaacgttacgtaccgttaccggtacccgtacccgggtaccggttaccgggtaaccggaaccggtaacggggaaacgttacgggaaaacttaccgaacgtacggtacgtggtacgactcggaactcttgtcgtacg

SEQ ID NO: 287616 - DNA, 709 bp, Homo sapiens
  misc_feature: GYAE6OF01CJJO7.6.19.B08.1.454.CMB.1.raw
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
  modified_base (251)..(251): a, c, t, g, unknown or other
  misc_feature (251)..(251): n is a, c, g, or t
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgccatctgtaggacacagagtccaccatcacttgccggnagtcagancattagcactattaatggtatcagganatcaggaacnccctaaatcctanactctatgatgctatcctacgtttacgacgtaaaggtgggtaccccattacgtaacggtttcgaaggttggacgtacggtaggtacgtacgtacgggaactacggttaactttaccgtaccttaccgtaccctaaccgtaacgtccgtaaacggcgtaaccggtttccgtacggtaaccccgtaacccgttaagggtaaacggtttaactttttacggaaccctttaaacgtttaacccgttaccgttacgtaaccgttaaacgaacggttaaccgttaccggtaacgttacccggtacccccggttacgggtaacccggtttccgggaacccggtaaaccggggtaaccgttaacgggtaacggtaaacgtaacccgaaaggtacccggtagtaccgggtacctcgggtaaccaccgttaaccgtcgttaaccg

SEQ ID NO: 287617 - DNA, 732 bp, Homo sapiens
  misc_feature: GYAE6OF01APTFT.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtagacacagacgtcaccatcacgttggccgggacaagtcagagctattacgacctaacctttaatttaaagttggtaactacgaaggaagaactaccgaacggggtaaacctacccccttaaaactccgtagtacttactaagtcgtactcgacctactacccttacgtttacgacgtaaacgggtcgggtaccctaagtacgtaacggttcgaggtggtacgtaggtaggtacgttacggtagggtaactagtttaacctttaccgaaccttcctaccaaccgtactaccgacgtaccgtacgttaccgtacgtaaccgtaacgttaggtaacgtttacgtttaccgaacccttaactttaccgtaacgttacgtaacctaaacgttagtaaccgttaccgtaccggttcccgtaccccggtacgggtacccggttaccgggaacccggtaaaccggggaaaccgtaaacgggttaacgtaaaccgtaaccggtaaaccggtacgtcggtacggtaccctcgaacctacccgttgtccgtttacccg

SEQ ID NO: 287618 - DNA, 904 bp, Homo sapiens
  misc_feature: GYAE6OF01BA0TQ.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggccctcggaggtcgacgagtatgtagactactacgagtagtaccgaccgtacgttcctacctaccttccccttccgttcgttcgtcgacctacttcgttaggtaacggaccaagaggtacgtaccaacctacgtacctacgttccggggacccggtaacgtaacgtacgaaggacgtactaagttacgaccttaaaccttttaaaattttaaaggtttaggtaactaacggaagggtaacgtaaacgtaccgggaaaacgggtaaaaccccgtaaccccttaaaacgttccgtagttaacttacttaggtacgtacgtccgacttaccttaccgttaacgtttacggaaacggttaaacgggggttcccggtaaccctaaggttaacggttaaacgggttcgtaacgggtcgtacgtagggtaacggtaacgttcggggtaagggtaaacgtaagtttacctttaccaacccgtttccgtaaccctaacctagtaccgtaaccgtacccgttcggttacaccggtaaaccctaacggtaagtttaaaccgttttacgttttaaccgaaacccttttaaaccgtttaacgttaaccgttacggtaaactaaacggttacggttaaaccgtttacgtaccgggttaccccgttacccggtacgggttaacggtacccggggaaacccgtaaggggttaaacccggtaagggtaaacgtaaacctaaaccgggtaaacctagggttccgtacgggtactaccgacccttaacgtacgttcgttcg

SEQ ID NO: 287619 - DNA, 598 bp, Homo sapiens
  misc_feature: GYAE6OF01CS13I.6.19.B08.1.454.CMB.1.raw
  modified_base (223)..(223): a, c, t, g, unknown or other
  misc_feature (223)..(223): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagngcattacgctaccttaatttaaattggtatcgaggagaataccgaagggaaacgcccctaaactcctagactactatgatgcatcctactttgacgtaaggtcgggtacccagttacgtaagggttcaggtggacgtaggtggtatcgtagggactagttactttccacgttcctaccacctataccgagactacgttctacggaccctaaccgtagtaaagttattttacgaccttaaacttacttactacgtacaacgtagtaagttacagtcccgtaccccgtcggtaccgttccgggacgtaaacgggtaccgaagggtacggaaactacggaaacgtacgtaggtcggtactcgactacctagtcttacg

SEQ ID NO: 287620 - DNA, 654 bp, Homo sapiens
  misc_feature: GYAE6OF01B1CVW.6.19.B08.1.454.CMB.1.raw
  modified_base (487)..(487): a, c, t, g, unknown or other
  misc_feature (487)..(487): n is a, c, g, or t
  modified_base (645)..(645): a, c, t, g, unknown or other
  misc_feature (645)..(645): n is a, c, g, or t
tcagatatcgcgagcacgaccggtgctcgatttagtgagtcagtaagggggagtcagtctcagtcaggacacagcatggacatgagggtcccccgctcagctcctggggctcctgctactctggctccgaggtgccagatgtgacatccagatgacccagtcctccatcctccctgtctgcatctgtaggacacagagtccaccatcacttggcccgggacaagtcagagctattacgactaaccttaatttaaattggtatacgaaggaataatccggaagggaaaccgtacccccttaaaactccgtagtacttactagtagatcgactacttcctaacgtttcgaaccgttaaagggttccgggtaccccaagttacgaaggttccgaaggtcggactaggtggaagttcggagggtaactagtactttcacctcgtaccactactcgacgtcgacgttctacgtaactaccgtaggtaacttntttacgaccttaaactttacgtaacgtcgtaacaacgtacgtaacgttaccgtacgtcccgtacccgtagggtacccgggttaccgaaccggtaacggaacggtaacggtaaacggaaacgtacgaaaccgtaagttcgacggtctacgacaaccttntccgttacg

SEQ ID NO: 287621 - DNA, 833 bp, Homo sapiens
  misc_feature: GYAE6OF01CFLCW.6.19.B08.1.454.CMB.1.raw
  modified_base (217)..(217): a, c, t, g, unknown or other
  misc_feature (217)..(217): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgaggacacagacgtcaccatcacttggccgganaagtcagagcaattagactaccttaatttaaagttgtatacgaaggagaacgtaccgaagggaaaccgtacccctaaaacgtcctagtactacgtaatgaacttgacctacttacccttacgtttacggaaccgtaaaacgggttccggggtaccctaacgttacggtaaaggtttcgaggttacgggtcgtaagggttacggacgttacgggtaggggtaacctaaggttacttttaccgaacctttccgtaacctaaccctaacgttacccgtagtacccgttaagttcccgtaagtaaccccgttaaacggttaaggttaaacgttagtttttaaccggaaacctttaaaccgttttaacccgttaaccgttaacgttaaacccgttaaacgtaaacgggtttaaccgtttaacccggttaaccggttaaccccgggttaccccccggttaaccggggtttaacccggggttcccggaaacccgggtaaaccggggaaaacccggttaaagggtaaaccggttaaaccgtaaaccgggtaaaacccgtaacgggttacgggtacggttaaccacggttaacccgtacccgttaccgtttccgtttaaccccgg

SEQ ID NO: 287622 - DNA, 583 bp, Homo sapiens
  misc_feature: GYAE6OF01BUGUI.6.19.B08.1.454.CMB.1.raw
  modified_base (212)..(212): a, c, t, g, unknown or other
  misc_feature (212)..(212): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctcctgtctgcatctgtaggacacagagtcaccatcacttgccggnaagtcagagcattagctaacttatttaaatggtatcgaggagaatccgaggaaacgcccctaaatcctgactctatgatgcatcctatttgactaagtcgggtccatacgaacggttcagtcgctagtggatcgtagggactgtatttcactcacaccatcagctagtcagacctacgagtaatacttttgactaagttacctagtcgtacaacgtaagtacgttacgacggttccgtacccggtacgggtaccgttaccgggaacccggtaaacggggtacccgtaaaggggtaccggtaaaactaccggtaaaacggtaaaccgttcggagggtaccctacggaacctaaacccgtagttcgttaaccg

SEQ ID NO: 287623 - DNA, 543 bp, Homo sapiens
  misc_feature: GYAE6OF01A3NNO.6.19.B08.1.454.CMB.1.raw
  modified_base (483)..(483): a, c, t, g, unknown or other
  misc_feature (483)..(483): n is a, c, g, or t
  modified_base (513)..(513): a, c, t, g, unknown or other
  misc_feature (513)..(513): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctaatttaaatggtaatcaggagaatccgaagggaaacgcccctaaaactcctagactctatacgatgacacttacctactttcgacgtaagtcggggtaccaacgtacgtaaaggttcaaggttcggctaaggtggactcgtagggacagttacttcgactcttacacctataccgagtcaagtcgtcgacaaccgttgaaactcttttagactacttactactagtacaacagtacgttacagtaccncccgtagccgtcgacgaggaccaggagaanacaacgatgacggctacgacactgtcttcg

SEQ ID NO: 287624 - DNA, 749 bp, Homo sapiens
  misc_feature: GYAE6OF01A8X9V.6.19.B08.1.454.CMB.1.raw
  modified_base (217)..(217): a, c, t, g, unknown or other
  misc_feature (217)..(217): n is a, c, g, or t
tcagatatcgcgagcacgaccggtgctcgatttagtgagtcagtaagggggagtcagtctcagtcaggacacagcatggacatgagggtcccccgctcagctcctggggctcctgctactctggctccgaggtgccagatgtgacatccagatgacccagtctccatccctcctgtctgcatctgtaggacacagagtcaccatcacttggccgggnaagtcagacgcattacgcctaaccttaattttaaagttggtaatacgaaggaagaactaccgaagggaaacctaccccctaaacctcctagtacttcctagtgatcgactacttacctacgtttgaacgtaacggtacggtaccaagtacgtaaggttcgaggtcgacgtaggtggtagttcgtacggtactagttactttaccgtacctccgtaacctaccctaagtccgaacgtaccttacgtccgtacggtaaacccgtaaccgttaagttaaccgttacgtttttaccgaacctttaaaccgtttaccttaaccgttacgttaaccaaacggttaacgttaaccgttaaccgttacgggttacccccgttacccccgggttacgggttaccccggttaccgggaacccggtaaacggggtaaacccgggttaacgggtaaaccggttaaaaccgtaaacccggtaaacccgttaacgttacggtacgggtactaccggaccccttaaccgtacgttcccgtttacccg

SEQ ID NO: 287625 - DNA, 619 bp, Homo sapiens
  misc_feature: GYAE6OF01A7UU8.6.19.B08.1.454.CMB.1.raw
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgctatctgtaggacacagacgtcaccatcactgccggacaagtcagagcattagctactaatttaaatggtatcgaganatccgaggaacnccctaactcctagatctatgatcgctatcctacgtttgaccgtaaaggtcggtacctatcgaaggttcaggtgacagtggatcggagggactagtactttacgaccttactacaacctattaccgacgtaccgtaaggttccctaacgtaaccctaaccgttaggtaaacgtttacgttttacgaaccttaaacgttttactaactttacgtaacaactaggtaacgttaccacggttccgtaccccgttacggtaccggttaccgggaaccgtaaacgggtaaccgtaaggtaacggtaaactaccggtaaacgtacgtggtacgtacgtacgacctactacgttctacg

SEQ ID NO: 287626 - DNA, 699 bp, Homo sapiens
  misc_feature: GYAE6OF01BDGVI.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctcctgtctgcatctagtaggacacagacgtcaccatcacgttcggccgggacaagtcagacgctaattacgacctaaccttaattttaaagttggtaatacgaaggaagtaacgtaccggaaacgggaaaccgtacccctaaaactccgttagacttacgtaacgtagacgtgacctacgtcctacgtttagacgtaaacgggtcgggtacccagttacgtaaggttcaggtaggcgaggtggagtcgtagggaactagtacttcacttctaccacctatacgagtactacgtcgtacgtaacctaacgtagtaacgttactttacgacctttaaactttacctacgttacgtaacctaacgtaacggtaacgttaacgacgttacccgtaccccggtacgggttacccggtacgggaacccggtaaaccgggtaaccggaaacgggtaacggtaaaccgtaaccggtaaacggtaccgttacgggtaccggttacgtaacgtaccgtaaccttaccgttcgttaacccg

SEQ ID NO: 287627 - DNA, 728 bp, Homo sapiens
  misc_feature: GYAE6OF01DP8A1.6.19.B08.1.454.CMB.1.raw
  modified_base (197)..(197): a, c, t, g, unknown or other
  misc_feature (197)..(197): n is a, c, g, or t
tcagatatcgcgagcacgaccggtgctcgatttagtgagtcagtaagggggagtcagtctcagtcaggacacagcatggacatgagggtcccccgctcagctccgtggggctcctgctactctggctccgaggtgccagatgtgacatccagatcgacccagtcctccatccctccctgtctgcatctgtaggacanagagtccaaccatcacgttcggccgggacaagtcagacgctagttacgacctaacctttaagtttaaagttggtaacttacggaaggtaagtaacgtaccggaaacggggaaacctaacccccctaaacttcctaggtacttcgttagtgtacgtcgcctaacgttcccttaacgtttcgaacggtaaaggttccgggtacctagtacgtaaggttcaggtcggactaggtggtactacggtagggaactaggttctttaccaccttcctacacctacgtacgtacgtctagtctaacgaccttaacgtaggtaacgtttacgttttacgaacccttaaacgttttacctaacgtacgtaaactaacgtaacggttaacgttaccggaacgttccccggtacccggttcggtaacccgggttaaccggaaccggtaaacgggtaaccggtaaagggttaaacgaaaacgtaccggtaaaacggtaccgttaggtaccggtactcggtaaaccctacgttagttctacccgg

SEQ ID NO: 287628 - DNA, 725 bp, Homo sapiens
  misc_feature: GYAE6OF01DTH0B.6.19.B08.1.454.CMB.1.raw
  modified_base (229)..(229): a, c, t, g, unknown or other
  misc_feature (229)..(229): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatcgacccagtcctccactccctccctgtctgctatcgtagtacggacacgagacgtccacatcacgtcggccggganaagtcagagactattacgacctaaccttaatttaaagttggtactacgaaggtaacgaacgtaccggaaacgggtaaaccgtaccccttaaacgtccgtagtactaccgtatacgatacgacctacttaccgttacgtttacgaaccggtaacgggtcgggtaaccctaagtacgtaaaggttccgaggtacggacgtagggtacgtacgtacggtagggtaactaacgtttacttaccgacttaccgacctaaccgtactacgtaccgtaccgttacgtaccgtaccgtaaccgtaacgttaacgtaacggtttactttaccggaaactttaaacctttacgtaacgttaacgtaaccaaacggtacgttaacgttaaccgtaccggtacccgtacccggttacggtaaccgttccggaaccggtaaacggaaccggtaaggtaacgtaaactaaccgaaacggtcgtaggcgtacaccgactacctgtcgttac

SEQ ID NO: 287629 - DNA, 741 bp, Homo sapiens
  misc_feature: GYAE6OF01EUCJQ.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctcctgtctgcatctgtaggacacagagtcaccatcacttcggccgggactagtcagagcattacgctaaccttaatttaaagtggtatacgaggtagaactaccgaagggaaccgtaccccctaaactccgtagtacttactataggactcgactactaccttactttacggaacgtaacgggtcgggtaccctaagttacgtaacgggttactaaggttcgggacgttaagggttacggtaacgttacgggtaacggggtaacgtaaggtttaccttttaccgtaacccttaccttaacccctaacctaaccgttaccacgggtaccgttaacggttcccgtacgtaaacccctaacgttaaggtaaacggtttattttaccggaaccttaaacgttttactaaccttagtaaccgtaaactacggttaacgttacccgaggttacccgtcccggtaccggtaccggtacccggaaccggaaacggggtaaccgaagggttaaccgtaaaagtacccgtaaacggtaacgtcggtacggtaccgacgaacccttactaccgttcgttaccg

SEQ ID NO: 287630 - DNA, 624 bp, Homo sapiens
  misc_feature: GYAE6OF01DZIEO.6.19.B08.1.454.CMB.1.raw
  modified_base (225)..(225): a, c, t, g, unknown or other
  misc_feature (225)..(225): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttggccggacaagtcagngcattagacacctaatttaaattggtatcaggagaatccagggaacgacccctaaactcctgatctatgatgcatcctactttgacgtaaaggtcggggtacccagtacgtaaacggttcgaggtggactaggtcggatcggtagggactaggtactttacgactcctacacctactcgaagtctacgtctcgacctaaccgtagtaacgttattttcggaactaacctttacttaacgtcgtaaccaacgtaacgtaacgtttacgtaacggttccgacccccgttcgggtaacccggttaccgggtaccgaaacgggaacccgtaaagggtacggtaaacgtaaccgaaacggtaacgttaggtacggtactacggacctaaccgtcttcgttaccg

SEQ ID NO: 287631 - DNA, 608 bp, Homo sapiens
  misc_feature: GYAE6OF01BZC5S.6.19.B08.1.454.CMB.1.raw
  modified_base (282)..(282): a, c, t, g, unknown or other
  misc_feature (282)..(282): n is a, c, g, or t
  modified_base (375)..(375): a, c, t, g, unknown or other
  misc_feature (375)..(375): n is a, c, g, or t
  modified_base (598)..(598): a, c, t, g, unknown or other
  misc_feature (598)..(598): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtccaccatcacttcggccgggacaagtcagagactattagcaaccttaatttaaattggtactcgaggagaactccgaaggaaacncccctaaatcctagactactactgatgctactcctacgttagactaacggtcggtaccagtacgaaggttcaggtgacgaggtgatcgtgganagtacttcactctaccacatcgacgactacgtctacgacctacgtagtaagttcgtttacgaccttaactttacgtactacgtaccaaacgtaggtaacgttaactcggtccgtaaccccggttcgggtaccggttacccgggaaccggtaacggaacccggtaagggtaaccggtaaagaccgtaaaacggacgttcggacggtccttacgaccctaccgtnttccgttacg

SEQ ID NO: 287632 - DNA, 686 bp, Homo sapiens
  misc_feature: GYAE6OF01CIELC.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctcctgctactctggcctccggaggtgccagatgtgacatccagatgacccagtctccatccctccctgtctgcatctgtaggacacagagtcaccatccacgttcggcccgggacaagtcaagagactattagcctaaccttatttaaaagttggtatcgaggagaactacccggaagggtaaaccgacccctaaactccgtagactctatgatcgctactacctattacgacgtaaacggtcgggtaccatacgtaaggttcgagtcgataggtgtatcgtagggactagttacttcactcctacgaccatcaagtctacgtctagacctaaccgtagtaagttacgttttacgaaccgttaaacctttaccttaacgttaccgtaaccgtaaacgttacgggtaactttaaccgaccgttcccggtacccccgttaccgggtaacccgttacccgggaaacccggtaaaccggggtaaaccgtaaacgggtaaacggttaaactaaacccgggtaaacgtaacggttcggacgggtaacccgttcggaaccctaaccgtagttcccgttaacgg

SEQ ID NO: 287633 - DNA, 718 bp, Homo sapiens
  misc_feature: GYAE6OF01D7IRZ.6.19.B08.1.454.CMB.1.raw
  modified_base (243)..(243): a, c, t, g, unknown or other
  misc_feature (243)..(243): n is a, c, g, or t
  modified_base (533)..(533): a, c, t, g, unknown or other
  misc_feature (533)..(533): n is a, c, g, or t
  modified_base (706)..(706): a, c, t, g, unknown or other
  misc_feature (706)..(706): n is a, c, g, or t
tcagatatcgcgagcacgaccggtgctcgatttagtgagtcagtaagggggagtcagtctcagtcaggacacagcatggacatggagggtccccgctcagctccgtgggcctcctgctactctggctccgaggtgccagatgtgacatccagatgacccagtcctccatccctccctgtctgcatctagtaggaccacagacgtaccacctatctacgttcggccgggacaagtccaaggacnctaattacgacctaaccgtttaatttaaacgttggtaactacgaaggtaagtaacgtacgaaacgggtaacctacccctaaacgtcctagtacttctaagtgatcgtctaactccttaacgtttgaacggtaaaggtccggtaccctagttaaccggtaaaggttcgtaacggtcggacgtaacgggttggtacgttacggtacgggaacttacggtttaacttttccaaccttccgaacctaccgtaacgtccagtacgtcgttacagacccgtaactaggttaacttntttaacgaccttaacgttacttacgtactaacaacggtaataccgttacgcttcccggtaccccgtacgggtacgggttacccgaaacggtacgggaaaccggtaagggtaaccgtaaacgtaaccgtaaaccggtacgtaggtaccggtacctaccggaccttaacccggtnttccgttaaccg

SEQ ID NO: 287634 - DNA, 568 bp, Homo sapiens
  misc_feature: GYAE6OF01EUIEH.6.19.B08.1.454.CMB.1.raw
  modified_base (95)..(95): a, c, t, g, unknown or other
  misc_feature (95)..(95): n is a, c, g, or t
  modified_base (215)..(215): a, c, t, g, unknown or other
  misc_feature (215)..(215): n is a, c, g, or t
tcagatatcgcgagcacgaccggtgctcgatttagtgagtcagtaagggggagtcagtctcagtcaggacacagcatggacatgagggtccccgntcagctcctggggctcctgctactctggctccgaggtgccagatgtgacatccagatgacccagtctccatccctcctgtctgcatctgtaggacacagagtcaccatcacttggccggnaagtcagagcattagctaaccttaatttaaattggtatcaggaagaataccgaagggaaactacccctaaactcctagtactctatgatgctatcctactttgacgtaaaggtcgggtacccagtaccgtaaggttcaaggtggactaggtggtactcggtagggatagtactttcactctaccaccatcagtctagtctcgaccaactgtaacgttatttacgacctaacttactactgtaacaactacgtacgtacgtacgtaccgcccgtacggtacgtcggaccgaacgggaaccgaaggtacggaaatacgaaacggagtcgtacggtactcgaacaccgtagtctcg

SEQ ID NO: 287635 - DNA, 810 bp, Homo sapiens
  misc_feature: GYAE6OF01CYR5M.6.19.B08.1.454.CMB.1.raw
tcagatatcgcgagcacgaccggtgctcgatttagtgagtcagtaagggggagtcagtctcagtcaggacacagcatggacatggacgggtcccccgctcagctccgtggggctcctgctactctggctccgaggtgccagatgtgacatccagatcgacccagtcctcccacttcccctcccgttgtctgctatcgtaggtacggacacagactccaccatactacgtcggaccgggacaagtcgaaggagacctaagttacgacctaacctttaaattttaagttagggtaactacggaagggaacgtaaacgtacccggaaaacggggaaaccttaaccccccttaaaacgtccgttagtaacttaccgttaagtaggaacttcgaaccttacgttacccgttaacgttacggaaacgttaaacgggttcgggtaaccctaacgtttaacggtaaacgggttttacgagggttacggacggttaacgggtaggtacgttacggtaggggaaacttacgttacctttaaccgacccttacctaacccgtactacgttaccaacgtacgtactaccgtacaacccgttaacgttaaggttaacctttatttaaccgtaacctttaaacttactaccgttacgtaaccgtaacgtacgttaacgttaaccgaccggttcccgtaaccccgtcgggttaaccgtacccggaacgggtaaccgggtaaaccggtaaggtaaacggaaactaaacccggtaacggtaagtccggtaacgtcccaacgtacccgacgttaactcggtttaaccg

SEQ ID NO: 287636 - DNA, 804 bp, Homo sapiens
  misc_feature: GYAE6OF01B3ARB.6.19.B08.1.454.CMB.1.raw
  modified_base (227)..(227): a, c, t, g, unknown or other
  misc_feature (227)..(227): n is a, c, g, or t
tcagatatcgcgagcacgaccggtgctcgatttagtgagtcagtaagggggagtcagtctcagtcaggacacagcatggacatgagggtccccgctcagctccgtgggctcctgctactctggctccgaggtgccagatgtgacatccagatcgacccagttctccatccctcctgtctgcatcgtagtacggacacagacgtacaccatccacgttcggccggtanaagtcagagctatagactaccttaatttaacttggtaactcgtaaggacgtaactaccgaaggaaaccgtacccgtaaaactccgtagtactactacgtagagtacgtacctaactccgttaacgtttacgaccgtaaacggtcggggtaccacgttaacgtaacggttcgaaggtcggtacgtaacggttaggacgttcggtacgggtacgtaacgttacgttttaccaaccttcgtaccctaacgtactccgtaacgggtacctgtaaccgtacgtaaccctaaccgttaggtaaacgttacgtttttaacgaccctttaaaacgtttaaccctttaacgtaacggttaacctaaaaccggtaaggtaacgtttaaaccgaacgggttacccgtaccccgggttacggttaacccgggttaccggtaaccggtaaaacccgggtaaacccggtaaaacggggttaaacggtaaaacccgttaaaccggtaaaacccggttaaacgtttacccgggtaaccggtaaccggtacccgtaaccccgtaaccctttaaccggttccgttttaaacccgg

SEQ ID NO: 287637 - DNA, 766 bp, Homo sapiens
  misc_feature: GYAE6OF01AKI9C.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtcctccatccctccctgtctgctatcgtaggtacggacacgagtacgtaccaaccgtactactaccgttcgggacccgggtactaacgtaccgaggaccgactaagttacggacctaaccgtttaaattttaaaggttggtaatacgaagggtaagtaactaccggaaaggggaaaccctacccccgttaaaacctccgtagattactagtaggacttcgactacttcccgttaacgtttcgaaacgtaaacgggtccgggtaccctagttacggtaaacggtttcacggggtcggacgtaggttcgggacttccggtaggggaacctagttacctttcgaacccttccgtacctaaccgtactaccggaagtccgtaacgttccgtacgtaacccgtaacccgtaagggttaactttacgtttaaccggtaaccttaaacctttcgtaacccgttacgtaacaaccgtagtaccgttaaccgaccggttccgtaccccggtagggtacccggttaccggaccggtaaaccgggacggtaaagggtaccgtaaagtaaccgaaacggtaccgtaggtaccgtacctacgaccacgtacgtcttaccg

SEQ ID NO: 287638 - DNA, 650 bp, Homo sapiens
  misc_feature: GYAE6OF01DTCPU.6.19.B08.1.454.CMB.1.raw
  modified_base (640)..(640): a, c, t, g, unknown or other
  misc_feature (640)..(640): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatgacccagtcctaccactcctcctgtctgctatctggtagacacagactccactatcactcggccggacagtacagagactatagactacttatttaagtgtatacgagagactaccgaacgggaaccacccctaactccgtagtacttactatgatcgactacttacctatttagacgtaacggtcggtacctagtacgtaagttgaggtggactaggtgtacgtacggagtaactagttacttacctactccgtactacctagtacacgtactacgtcgtacgtaaccctaacgttagttacggttaacttttacgtaaccttaaacgtttaacctaccgttacgtaaaccgtaaccggttattaaccgttaccgaaccgggttccccgtaacccgggttacggtaccggttacccggaccgggtaaaccggtaacggtaggtaaacgtacaaaccgtacggaacggtcgtacgtcacaccgtacnttccgttccg

SEQ ID NO: 287639 - DNA, 799 bp, Homo sapiens
  misc_feature: GYAE6OF01AWS05.6.19.B08.1.454.CMB.1.raw
  modified_base (245)..(245): a, c, t, g, unknown or other
  misc_feature (245)..(245): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccgaggtcgccagatgtgacatccagatcgacccagtctaccatccctccctgtctgcatcgtagtaggacacagagtcaccatcacgttcgccggactaagtcaagacactaagttanacctaaccttaagttttaaaagttggtataccgaaggtaacgaaactaccggaaggaaaccgtacccccgtaaaactcccgtagtaactacctaagtcgtaactacgacctaacgttccctacgttttagaacgtaaacgggttccggggtaccctaagttaccgtaaacgggtttacgaacggttcgggaccgtaagggtcgtaacgtaccggttacggggaaacgttaacgttacttttacccaacctttaccttaccctaaaccgtaacgtacgaaccgtacgttaaaccggttcccgtaagtaaccccgtaaaccgttaggttaaaacgtttacgttttaacaaccctttaaacgttaacccgtaacgtacgtaaaccgtaaacgtaacggttaaccgttaacccggtagtttacccccgccccggttaacggtaccggtacccgggaaacgtaaaccgggaaccggtaaagggttaacgaaacgtaaccggttaaacgaccgttaaggttaccggaacttaccggaaccacgttaaccgtcgttaaccg

SEQ ID NO: 287640 - DNA, 622 bp, Homo sapiens
  misc_feature: GYAE6OF01EMR9Z.6.19.B08.1.454.CMB.1.raw
tcagatatcgcgagcacgaccggtgctcgatttagtgagtcagtaagggggagtcagtctcagtcaggacacagcatggacatgagggtcccccgctcagctcctggggctcctgctactctggctccgaggtgccagatgtgacatccagatgacccagtctccatcctcctgtctgcatctgtaggacacagagtccaccatcacttggcccgggcaagtcagagcattagcaccttaatttaaattggtatcaggagaatccgaaggaacgacccctaaactcctagatctatgatcgactatcctatttcgactaaaggtcgggtacctaagtacgtaaggttacgaggtcgaccgtaggtggacgttacggtacgggtaacgtagtactttcaccttactaccacctaatcaggtctacgtctagacctaacgtggtaaacgttacttttgaaccttacctttaacgtacgttactaacgtaaactaggttaacgttaccgtacggtcccgtaccccgttacggttaccgggtacccgaaccggtaaaccgggaaccgtaagggtaacggaaattaccgaaacgtaacgtggacgtcgtcgacctactgttcgtacg

SEQ ID NO: 287641 - DNA, 680 bp, Homo sapiens
  misc_feature: GYAE6OF01ER4F3.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttggccgggcaagtcagagcattagctaccttatttaattggtatcaggagaatccgaagggaaacgcccctaaactccgtagatctatgatgactatcctatttagacgtaaaggtcgggtaccctagtacgtaaggttcgaaggttcggacgtaggtggtacgttcggtagggtaactaggttacttttaccacttaccgtaccaacctataccgaacgtcctaacgttcctacgaccctaaccgttaggtaaacgttacttttacgaacctttaaactttaacctacgttacgtaacaaacgtaggttaacgttacgtacggttacccgtaccccgttaccgggtaaccggttacccgggaaccgtaaaccggggtaaccgtaaacggggttaacggtaaaacgtaaccggtaaaaccggtaacgttacggtacggtaccttacggaccctaaccgtacgttccgttacg

SEQ ID NO: 287642 - DNA, 600 bp, Homo sapiens
  misc_feature: GYAE6OF01BMY7M.6.19.B08.1.454.CMB.1.raw
  modified_base (95)..(95): a, c, t, g, unknown or other
  misc_feature (95)..(95): n is a, c, g, or t
  modified_base (219)..(219): a, c, t, g, unknown or other
  misc_feature (219)..(219): n is a, c, g, or t
  modified_base (302)..(302): a, c, t, g, unknown or other
  misc_feature (302)..(302): n is a, c, g, or t
  modified_base (317)..(317): a, c, t, g, unknown or other
  misc_feature (317)..(317): n is a, c, g, or t
tcagatatcgcgagcacgaccggtgctcgatttagtgagtcagtaagggggagtcagtctcagtcaggacacagcatggacatgagggtccccgntcagctcctggggctcctgctactctggctccgaggtgccagatgtgacatccagatcgacccagtctccatccctccctgtctgcatctggtagacacgagatcaccatcacttggcccgganaagtcagagcattagcctaaccttattttaaacgttggtattcgaaggagtaacgtacgaacggggaaaccaccccctaaacncctagacttctagtnagtgcacttcctacgtttcgaacgtaacggttcgggacctacgtacgtaacgtcgaggtgacgtaggtcgtagtcgtaggactaagtactttacacgtctacacctatacagtactacgtactcgtaaccacgtagtaacttattttacgacttaacttactacttagtacaagtagtactacgtacgtccgtcccgtacggtacgtccggacgtacggaaccgtaagggtaaccgaagttaaaccgacgtagtcgtacggtactcggacacgttgtcttacg

SEQ ID NO: 287643 - DNA, 697 bp, Homo sapiens
  misc_feature: GYAE6OF01AECDH.6.19.B08.1.454.CMB.1.raw
  modified_base (94)..(94): a, c, t, g, unknown or other
  misc_feature (94)..(94): n is a, c, g, or t
  modified_base (311)..(311): a, c, t, g, unknown or other
  misc_feature (311)..(311): n is a, c, g, or t
  modified_base (378)..(378): a, c, t, g, unknown or other
  misc_feature (378)..(378): n is a, c, g, or t
tcagatatcgcgagcacgaccggtgctcgatttagtgagtcagtaagggggagtcagtctcagtcaggacacagcatggacatgagggtccccnctcagctcctggggctcctgctactctggctccggagtgccagatgtgacatccagatcgaccctagtctccactccctccctggtcctgctatcgtgtaacggacacgagtacgtcaccagtccacgtcgccggactaagcaagtgactattagactacctaatttacgtggtatcgaggaactacaccggaaggaacctaccccctaaatccgtntacgtactatgtagtcgacctacgcttacttagacggtaaacggtcggtacctgtaacgacgttcgnggtaggctaggtggtacctagtacgggactatacgtttcaacttccgtactactaactccgtaacgtaccgttataccgttaccggtaaacctaccggttaaaggtaaacggtttacccttttaacggtaccctttaaaccgttacctttaacggttacctaaaccctaaagggttacggttaacttaacgtccgggttacctaccccgggttaggtacccgtaaccggtccgtaaaacggggtaccgtaaacgggttacaaccggtaacgtaacccggtactgggtacgctaccggaaccaccgttgtcgttaacccg

SEQ ID NO: 287644 - DNA, 618 bp, Homo sapiens
  misc_feature: GYAE6OF01EHRNH.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctcctgtctgcatctgtaggacacagatcaccatcacttgccggcaagtcagagcattacgctaccttaatttaaattggtatcgaggagaatccgaagggaacacccctaaatcctagtatctatgatgactatcctatttcgacgtaaaggtcggggtaccctaatcgtaaaggttcaaggtcggcgtaggtgatcggtagggactagtatttcactactcaccgtatacagcaacgttcacgtacctaaccgtagtaaacgtttacgtttacgaaccttaaactttactaacttacgttaacaaacgtagtaagttaccgaggttcccgtaccccggttacgggaaccggtttccgggaaccgtaaacggggtaaccgtaaaggttacggaaaattacccggaaaacggtacgttagaccgggtctacgacctaactgtcgttaccg

SEQ ID NO: 287645 - DNA, 670 bp, Homo sapiens
  misc_feature: GYAE6OF01BQL8T.6.19.B08.1.454.CMB.1.raw
  modified_base (94)..(94): a, c, t, g, unknown or other
  misc_feature (94)..(94): n is a, c, g, or t
  modified_base (160)..(160): a, c, t, g, unknown or other
  misc_feature (160)..(160): n is a, c, g, or t
  modified_base (480)..(480): a, c, t, g, unknown or other
  misc_feature (480)..(480): n is a, c, g, or t
  modified_base (616)..(616): a, c, t, g, unknown or other
  misc_feature (616)..(616): n is a, c, g, or t
  modified_base (625)..(625): a, c, t, g, unknown or other
  misc_feature (625)..(625): n is a, c, g, or t
  modified_base (645)..(645): a, c, t, g, unknown or other
  misc_feature (645)..(645): n is a, c, g, or t
  modified_base (657)..(657): a, c, t, g, unknown or other
  misc_feature (657)..(657): n is a, c, g, or t
  modified_base (662)..(662): a, c, t, g, unknown or other
  misc_feature (662)..(662): n is a, c, g, or t
tcagatatcgcgagcacgaccggtgctcgatttagtgagtcagtaagggggagtcagtctcagtcaggacacagcatggacatgagggtccccntcagctccgtggggctcctgctactctggctccggaggtgccagatgtgacatccagatcgaaccngtcctcactcctcctgtctgcctatcgtgtacggacacgagacgtcaaccattcacgttcggaccgggactaagtccgaaggacgactacgttacgacctaacctttaaagttttaaagtcggtaacgtacgaagggtaacgaaacgtacccggaaaggggtaaaaccttacccctaaacgtcctaagtattccgtaatacgtatcgactactcttacgttacgaacgtaacgggtcgtacctaagtacgtaaggttcgaggtacggacgtagggttcgtacgtacgtagggtactagttcttacactctaacccacgtntacgtacgctacgttacgacgtaatacctaaggttaacttcgtttaacgaaccttaacgttacgtaacgtacgtaacgtaacgagttacgtaacgtcggaccgtcggtacggtacccgtagtaacggacgggtaanaaccgggtnaaaccgacctaaagcggtancgtacgccgaancgttntcgtaccg

SEQ ID NO: 287646 - DNA, 904 bp, Homo sapiens
  misc_feature: GYAE6OF01A0H7Z.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggcctcctgctactctggctccgaggtgccagatgtgacatccagatgacccagtctccatccctccctgtctgcatctgtaggacacagagtcaccatcctacgttcggccgggacaagtcagagctattacgactaacctttaattttaaacgttggtaatacgaagggtaacgtaaacgtaccggaaacggggaaaaccgtaccccccgttaaaaccgttcccgtaggtaacttaccgttaagtacgtaactcggtacctaaccgtttacccttaacggttttacggaaaccggtaaaacgggttccgggggttaacccctaaagttaaccggtaaacggggtttcgaagggttacgggacgtaagggttcgggtacgttaccgggttaaggggtaaccgtaagtttacgttttacccaacctttacccgttaacccaaacccgttaagtaccgaacggttaccccgttaaacgggttacccttaaccgggtaaacccttaaacccgggttaaggttaaaaccggttttactttttaacggaaacccttttaaacccgttttaaccctaaccggttttacgtaaaccgtaaacgttaacgggttaaaccgtttaaccgtacccgggtttaccccgtaaccccccggttaaccgggtacccgggtttacccgggaaacccgggtaaacggggaaacccggttaaagggtaaaccggtaaaccgttaaaccggtaaaaccggtaccgtagggttaccggaccgtaacgtaccctaacgtaacgtttcccgttaccg

SEQ ID NO: 287647 - DNA, 682 bp, Homo sapiens
  misc_feature: GYAE6OF01BI6OZ.6.19.B08.1.454.CMB.1.raw
  modified_base (546)..(546): a, c, t, g, unknown or other
  misc_feature (546)..(546): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtacggacacagacgtcaccatcacgttcggcccggacaagtcaagagtactattacgactaaccttaattttaaaattggtaatacgaagggtaagtaacgtaccgaagggaaaaccgtacccccttaaaactcccgtagtactacctagtagtactcggactacttaccgtacgttttacgaacgtaaacggtccgggtaccctaagtacgtaacgttcgaggtcggacgtaggtacggacgttcggagggtaactagttactttaccgaccttccgtaccgaacctagtacaacgtcaacgttctacgaacctaacctaggtaacttacgtttaccgacttaaacgtttacctacgttanaccgaatacggtaacgttaccgacgtcccgacccggtacgtaccggttaccggaccggtaaacggaccggtaagggtaacgaaacttaacggaaaccggtagtcgacggtaccactacccacgtacgtcgttaccg

SEQ ID NO: 287648 - DNA, 696 bp, Homo sapiens
  misc_feature: GYAE6OF01E2AAZ.6.19.B08.1.454.CMB.1.raw
  modified_base (236)..(236): a, c, t, g, unknown or other
  misc_feature (236)..(236): n is a, c, g, or t
  modified_base (284)..(284): a, c, t, g, unknown or other
  misc_feature (284)..(284): n is a, c, g, or t
  modified_base (423)..(423): a, c, t, g, unknown or other
  misc_feature (423)..(423): n is a, c, g, or t
tcagatatcgcgagcacgaccggtgctcgatttagtgagtcagtaagggggagtcagtctcagtcaggacacagcatggacatgaggtccccgctcagctccgtggggcctcctgctactcgtggctccggaggtcgccagatgtagacatccagatcgacccagtcctccactccctcctgtctgctatctaggtacgacacgagacgtaccaccatcgtacgttcggccggganaagtcagagctagttacactaacttaattttaagtgtatacgaggaanacgtaccggaagggtaacctaccccttaaactcgtacgtattaccgtatgtaactcgactacgttacccttagttacgaacggtaacggtccggtacctagtacgtaaggtctaggcgagtagtcgactcggagaactnttacttaccactactaccacctactacgacgtcctacggtctacgtaccgtacgttaagtacgttactttacgaacctttaacgttactacgtaataaccgtaacgtaacggttaacgtaccgttacgtcccgttacccgtacgggtaacccggttaccggaaccggtaaccggggaaaccggttaacgggtaactaaacggtaacccgtaaaacggtaccggtacggttacccgggtactaccggtaacccttacgttcgttccgtttaccg

SEQ ID NO: 287649 - DNA, 1197 bp, Homo sapiens
  misc_feature: GYAE6OF01CU81P.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatccctccctgtctgccatctgtacgacacagacgtcactatcacgttcggccgggacaagtcagacgactaattacgacctaacctttaaagttttaaacgttagggttaactacggtaaggtaacgtaaacgttacccggaaacggggtaaaaccccgtaaccccccgtttaaaaaaccgttcccgttaaggtaactttaccgttaaagttacggtaacgttcggtacctaacctttacccccgtttaaaccggtttttacggaaaccgggtttaaaaaacccggggggttttccggggggttaaccccccttaaacggtttaaaccccggtttaaaaacgggggtttttaccccgggtaaaacggggttttcccgggggtaacccggtttaaagggggtttacggggttaaaccggtttacccggggttaaacgggggtaaccccgttaaacggttttaaacccggtttttacccttaaccccggtttaaccccttacccgttaaaacccccggtaagttttaacccggaaccggtttaacccggttaacgggtttaccccgttaaacgggaaaccccccgtttaaaccggtttaaaggggtttaaaaccgggtttttaaacctttttttaaccgggaaacccccttttttaaaaaccccggtttttaacccgttttaaacccggtttaaccgggtttaaaccccgtaaaaaccggttttaaacggggtttaaaacccggggttttaaccctaacccgggggttttaacccccccggttacccccccgggggtttaaaccgggggtttaacccccggtttaaaccccggggggtaaaacccccgggttaaaaaccgggggtaaacccgggttaaaaaccggggggtttaaaaaccgggtaaaacccctttttaaaaaccccgggggaaaaacccggtttaacccccgggggtttaaggttaaccccggggggtttaaccccgttaaccgggtaaccccccgtttaaaaccccggttggttttaacccccgg

SEQ ID NO: 287650 - DNA, 726 bp, Homo sapiens
  misc_feature: GYAE6OF01A7SRA.6.19.B08.1.454.CMB.1.raw
  modified_base (179)..(179): a, c, t, g, unknown or other
  misc_feature (179)..(179): n is a, c, g, or t
  modified_base (195)..(195): a, c, t, g, unknown or other
  misc_feature (195)..(195): n is a, c, g, or t
  modified_base (221)..(221): a, c, t, g, unknown or other
  misc_feature (221)..(221): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatcgacccagtctccatcctccctgtcngcatctgtacggacanagacgtcaccatcacttggccggganaagtcagacgcattacgactaaccttaatttaaacgttggtaactacgaaggtacgaaacgtaccgaacggggaaaaccgtacccccttaaaacgtcccgttagtaacttacgttagttcggtaatcggtactacgtaccttagttttacgaacgtaaacggttccgggtacctaacgttacgtaaacggtttcgaacggttcggacgtaaggtggtacttcgggtacgggaactacggtactttaccgacttcctaccgaacctatacgtagtacctagtaccgagtaaccctaacgtagtaaacgttctttacgaacctttaaccgttaacttaccgttacgtaactaaacgtagttaaccttacgacggtttacccggacccgttacgggaccgtttaccggaccggttaacgggaaaccgtaggggttaaacctaaaggaacccgtaaacgggtacgtaggttacggtacctacggaccctacgttacgtcccgtttacgg

SEQ ID NO: 287651 - DNA, 691 bp, Homo sapiens
  misc_feature: GYAE6OF01CP2TI.6.19.B08.1.454.CMB.1.raw
tcagatatcgcgagcacgaccggtgctcgatttagtgagtcagtaagggggagtcagtctcagtcaggacacagcatggacatgacgggtccccgctcagctccgtggggctcctgctactctggctccgaggtgccagatgtgacatccagatcgacccagtctccatccctccctgtcctgcctatctggtacggacacagagtccactatcacgttcggccggtacaagtcagagtcattacgactaacttaatttaaagttggtactacgaaggaagtaactaccgaaacggggaaaccaccccttaaactaccgtagtactacgtaagtagtagttacgactaacttacctacgtttacgaacggtaaacggttaccggggtaccctaagttaacggtaacgggttacgaaggttacggggtactaagggttaggtacgttacgggtagggtaaccgtagtttaactttaccgtactacctaccaacctacgtcaacggtctaacgtcgtacgaactaacgtaagtaattagttacgaacttaacgttactaacgtacgtaacaacgtacgtaacgttacgtacgtcctacccggtacgtacggtaccgacggaaacggaacgtaagggtaactaacgaaacgaaccggtaacgtggtacgtacgacaccgtacgtcttcgttccg

SEQ ID NO: 287652 - DNA, 648 bp, Homo sapiens
  misc_feature: GYAE6OF01AO3OZ.6.19.B08.1.454.CMB.1.raw
  modified_base (94)..(94): a, c, t, g, unknown or other
  misc_feature (94)..(94): n is a, c, g, or t
  modified_base (165)..(165): a, c, t, g, unknown or other
  misc_feature (165)..(165): n is a, c, g, or t
  modified_base (268)..(268): a, c, t, g, unknown or other
  misc_feature (268)..(268): n is a, c, g, or t
  modified_base (594)..(594): a, c, t, g, unknown or other
  misc_feature (594)..(594): n is a, c, g, or t
tcagatatcgcgagcacgaccggtgctcgatttagtgagtcagtaagggggagtcagtctcagtcaggacacagcatggacatgagggtccccntcagctcctggggctcctgctactcgtggctccggaggtcgccagatgtgacatccagatcgacccagtcnccatccctcctgtctgcatctgtaggacacagtagcaccatcacgttcggccgggacagtcaggacgactattacgactacttaatttaagtggtatcgaganacgtccgaaggaactcccctaatctgatctatgatcgacactcctacgttacgacgtaagggtccggtaccagtaccgtaggttcaggtcgcgtagtcggtactcggtacgggtactagtctttaccaccgttaccgtacctaaccgataccgacggtccgttaacgtcgtacgtaaccctaacgttaagggtaattccgtttacggacctttaaaccgtttacgtaacgtacgttaacaaccgtaggttaactacccggtagtacccgggtacccttacgggaccgttaccggaaccggtaacgacggttaaacggccgttaaanaccggtaaacggtactgggtacgtcctacgacctacgtaaccgttcgttaccgg

SEQ ID NO: 287653 - DNA, 870 bp, Homo sapiens
  misc_feature: GYAE6OF01CH87X.6.19.B08.1.454.CMB.1.raw
  modified_base (95)..(95): a, c, t, g, unknown or other
  misc_feature (95)..(95): n is a, c, g, or t
  modified_base (120)..(120): a, c, t, g, unknown or other
  misc_feature (120)..(120): n is a, c, g, or t
  modified_base (198)..(198): a, c, t, g, unknown or other
  misc_feature (198)..(198): n is a, c, g, or t
tcagatatcgcgagcacgaccggtgctcgatttagtgagtcagtaagggggagtcagtctcagtcaggacacagcatggacatgagggtccccgntcagctcctgggctcctgctactcnggctccgaggtgccagatgtgacatccagatcgacccagtcctaccatccctccctgtctgctatcgtgtaggaccanagagtaccacatctacgttcggccgggtacaagtcgaaggagtctaagttacgacctaacgttaattttaaagttcggtaatccgaaggtaacgtaaactaccggaaaggggaaaacccctacccccgttaaaacgttccctaggtaacttaccgttaagtacggtaacgttcggtacctaccttaccccgttagtttaccggaaccgttaaaacgggtcccgggttaccctaagttacccgtaaacgggtttcgaacgggttcgggtaccgtaacgggttacggtaacgttccgggtaacggggttaataacggttttaaccgtttaccctaaccggtttaccctaaccctaaccccgtacgttaaccgacgtacccgttacggttaacctaccggtaacccttaaccggtaaaggtttacttacgtttacgtaacctttaaacctttcgtaaacctttcgaactaaggttacgttacgttaacccgtaccggttcccgaccccggttaccgggttaaccgggtacccggtaaacccgtaacgggggtaaaccgttaaacgggttaaacggtaaaacccgttaaacccggtaaaaaccggtaccgttttacggggtaaccgtaccgtaacccggtacgtaacccccgtttaccgggttccttttaacccgg

SEQ ID NO: 287654 - DNA, 784 bp, Homo sapiens
  misc_feature: GYAE6OF01CXDLH.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatcgacccagtcctaccactccctccctgtctgcatctagtacggactacagactcacctactctaccgttcggccgggacaagtcaggacacgtattacgactaaccttaattttaagtggtaatacgaaggaacgtaactaccggaaacgggaaaccgtaccccttaacgtaccgtagtactactagtcgtaagtcactactcctacgtttacgaacggtaacgggtacggtaccacgttacgtaacggttcgacggttggacgtaggtacgtagtacggtaggactagtactttacgaccttacctacaccgtatacgtacgtcgtaacgttactacggtaaccgtaaccgttaggttaaacgtttagttttaccgtaacctttaaacctttaaccgttcgttaacccgtaacgttaaaccgtacggttaaaccgttaccggttaaccggtaccccgttaacccggttaccgggtaaccggggttaaccggaaccccgggggttaaaaccgggtaaaccgggtaaagggtaaacccggtaaaaggttaaaccccggtaaaccggttaaccggttacgggtacggttacccggtaacgtacccgtaacccgttaacgttccggttaacccg

SEQ ID NO: 287655 - DNA, 867 bp, Homo sapiens
  misc_feature: GYAE6OF01CSU4X.6.19.B08.1.454.CMB.1.raw
  modified_base (135)..(135): a, c, t, g, unknown or other
  misc_feature (135)..(135): n is a, c, g, or t
tcagatatcgcgagcacgaccggtgctcgatttagtgagtcagtaagggggagtcagtctcagtcaggacacagcatggacatgagggtccccgctcagctccgtggggcctcctgctactctggctccgaggtnccagatgtgacatccagatcgacccagtcctccactccctcccttgtctgctatcgtaggtaggacacgagacgtaccacctatacctaccgttcggacccggggactaaggtccgaagacgactaattacgacctaaacctttaattttaaaagttggtaactcgaaggagaaacgttaccggaaacggggaaaaccctacccccttaaaaccgttcctaaggtacttaccgtaagtcgaacgttacgtacctaacttacccgttaacgtttacggaacgtaaaacgggttccgggtacccctaagttacggtaaaccgggtttcgtaacggtaggacgtaaggtcggttaacgttcgggtacggtaacgtagtttactttaccgtaccttccgtaacctaacccgtacttaccggacgtacccgtaacgttcctaaccggaaccgttaaccgtaagttaaagtttctttaacggaaccttttaacgtttaccgttaacgttcggttaaaccctaaaggttacgtaaaccggtttaccgtacccgggttacccgtaaccccccgggtttacggtaaccccggggttcccggaaaacccggggttaaaccggggtaaaccgtaacgggggttaaaacggttaaacccgtaaacccggttaaaaccgggtacggttacgggttaccgggtacttaacccggtaccgtaacctttaccgtccgttttaaacccg

SEQ ID NO: 287656 - DNA, 619 bp, Homo sapiens
  misc_feature: GYAE6OF01CSN5B.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcaccttatttaaattggtatcaggagaatccgaagggaaacgacccctaaaactccctagacttctaatcgattgcctattccctactttgactaaaggtcgggtccatcgaaggttcaggtgcgtagtggatcgtggactagtactttcactctacaccatcagactagtctagacctaacctagtaaagttattttacgaaccttaaacgtttacctaacgttacgtaacctaacgtaacgttaacgttacgacgttccgtacccccggttcgggtacccggtttaccgggaacccggtaaacgggaacccgaaagggttaaacggaaactaaccgaaaacgtacgtaggtacggtactacgaccgtaacctagttccgttaaccg

SEQ ID NO: 287657 - DNA, 731 bp, Homo sapiens
  misc_feature: GYAE6OF01CHBSA.6.19.B08.1.454.CMB.1.raw
  modified_base (253)..(253): a, c, t, g, unknown or other
  misc_feature (253)..(253): n is a, c, g, or t
  modified_base (486)..(486): a, c, t, g, unknown or other
  misc_feature (486)..(486): n is a, c, g, or t
tcagatatcgcgagcacgaccggtgctcgatttagtgagtcagtaagggggagtcagtctcagtcaggacacagcatggacatgagggtcccccgctcagctccgtggggctcctgctactctggcctccgaggtgccagatgtgacatccagatcgacccagtcctccctacttcccctccctgttcctgctattccgtaggtaacggacctaacgaggacgtaccaacctattcctacgttcggccggganaaggtcaaggacgactattacgacctaactttaatttaaagttgtatacgaaggtaactaactaccggaacgggtaaaacctaccccctaaaactccgtagtactccgtatagaacttcgactactacccttagttcgaaccgtaacgggtccgggtacctagttaccgtaaggttacgaggttggacgtaggttacggtacgttcggtaaggtacctaagtttcctttaccncgttactaccgtactacttacgacggtactacggttactaccggtactaaccgttaaggttaacgtttacgttaacgtacctttaaccgtttactacttacggtaacctaacggtacgttacgtaacgtccgtaccgtacccgtacgggtaccgtccggaacgtaaccggaacggttaaggtaaaccgtaacaacggttaaccaacgggttcgtacggctaccgtaccaacgttccgtcgttacg

SEQ ID NO: 287658 - DNA, 859 bp, Homo sapiens
  misc_feature: GYAE6OF01D8C8W.6.19.B08.1.454.CMB.1.raw
tcagatatcgcgagcacgaccggtgctcgatttagtgagtcagtaagggggagtcagtctcagtcaggacacagcatggacatgacgggtccccgctcagctccgtggggctcctgctactctggctccggaggtcgccagatgtgacactccagactcgacccagtcctacctacttccctcctgtctgctatcgtaggtaacgacacgacgtacgtaccaacctactacctacgttcgggaccggaactaacggtcgaaggacgtactacttacgacctaacgttttaaagttttaaagttcggtactacggaaggtaacgtaactaccgggaacggtaaaacccctaccccttaaacgtccgtagtacttacgtagtacgtacgtccgtaacctccgtttaccttacggtttaacggtaaaccgggtaaaccgggttcccgggtaaccttaaggttaaccggttaacggggttcgacggggtcggtacggtaagggtcggtaacgttacggggtaacgggttaacttaaccgtttaactttacccgtacttcccaacctaacgtacgttacgacgtacgtacgttaccgtaccgtaaaccgttaagtttaacgggttaaacttttacgtttaaccggtaaaccctttttaaacgtttaccgttaaacgttaccgttaaaccgaacgttaacgggtttaaccctttaaccggttcccgggacccgggttaccccgtaaggggtaaccccgttacccgggaaacgggtaaccggaaacggttaaggtaaaccgtaaacgtaacggaaagttaccgcgggttacgacccgtaccgtaagtacctttaggtcgttaaccc

SEQ ID NO: 287659 - DNA, 768 bp, Homo sapiens
  misc_feature: GYAE6OF01EVP3R.6.19.B08.1.454.CMB.1.raw
tcagatatcgcgagcacgaccggtgctcgatttagtgagtcagtaagggggagtcagtctcagtcaggacacagcatggacatgagggtcccccgctcagcctcctggggctcctgctactctggctccggaggtgccagatgtgacatccagatcgacccagtcctccactccctcctgtctgcatctgtacgacacagactccacatcacttcggccgggacaagtcagacgactattacgctaactttaatttaaagttgtactacgaaggaagtaacgtaccgaaagggaaaccgtacccctaaactccgtagtacttactagtacgagtcgtactacttcccttacgtttacgacggtaacggtccgggtaccaagtacgtaacggttcgtaggtcggacgtaggtcgtacgtcggacggaactaacgttctttactacccgttacacccgtacctaacgtcacggtactacgttaccgtacgtaaccctaacgttacgtaagtttaccgtttccaacttaacccgtttactaaccgttacgtaaccgtaaagtaacggttaaccggttactacccgggttacccgtaacccccggttacgggtaacccggttaccgggaaaccccggggttaaaacgggaaaccccgggttaaaggggtaaccgttaaaaacccgggttaacccgaaaacggttaacgggtttacccggttacggtaaccgttacccgaaacccttacccggttacgttccgtttaacccgg

SEQ ID NO: 287660 - DNA, 723 bp, Homo sapiens
  misc_feature: GYAE6OF01BXYO1.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtctccactcctccctgtctgctatcgtgtaggacacagacgtccaccatactaccgttcggccgggactaagtcagagctattagacctaacttaatttaaattggtaacttacgaaggtaagaactccggaacgggaaaaccgtaccccttaaaaccgtccgttagaattacctaagttacggtacgtcgacctaccttaccgtaaccgttttacgaaccgtaaagggttccggggttaccctaagttacgtaaggtttccgaggtcggtacgacgggtagtacgtcgtagggtactacgttacttacaccgtctaccactactacctacgtactacgtacgtacaaccgtactaggtaacgttacgtttacgaaccttaacgtttaacctacttacgtaacgtaaacgtacgttaccgttacgtacggtccccgtcccggtaccgggtaaccgttaccgggaacccggtaacggtaaacccggtagggtaaacgtaaaccgtaaccggtaaacggtacggtacggttacggtacgccgtaaccacgtacgtttccgttacg

SEQ ID NO: 287661 - DNA, 705 bp, Homo sapiens
  misc_feature: GYAE6OF01BD9EM.6.19.B08.1.454.CMB.1.raw
  modified_base (95)..(95): a, c, t, g, unknown or other
  misc_feature (95)..(95): n is a, c, g, or t
  modified_base (579)..(579): a, c, t, g, unknown or other
  misc_feature (579)..(579): n is a, c, g, or t
tcagatatcgcgagcacgaccggtgctcgatttagtgagtcagtaagggggagtcagtctcagtcaggacacagcatggacatgagggtccccgntcagctcctggggctcctgctactctggcctccggaggtcgccgagatgtcgactactcccaggactcgacccagtcctaccacgtccctccgtgtctgactatcgtagtacgacacgagtacgtaccacctatcctacgttcggaccgggtacaagtcacggacgctacgtacgacctaacttaagtttaattggtacttacgaaggaagtaacgtaccgaaggtaacccgtacccctaaactccgtagtacttactactggtatcgactactcgttacgttacgacgtaacggtccggtacctagtaccgtaacgtcgtaggtgcgtaaggttcggaacgttcggtacggtaacgtacgttacttacgtaacctaccgtacccgtactatcgaacgtacgacgttcgacgtaccgtaactagggttaacttactttacgaacctttaacttacgtactacgtaacgaacgtataccgttacncggttacccgtacccggtacgggtacccgtaacggacccggtaaacggaacggtaaagtaaccggtaaactaccgtaaacggtcgttacggacgtccgtacgaaccttaccgtactcggttacccg

SEQ ID NO: 287662 - DNA, 718 bp, Homo sapiens
  misc_feature: GYAE6OF01BTLA0.6.19.B08.1.454.CMB.1.raw
tcagatatcgcgagcacgaccggtgctcgatttagtgagtcagtaagggggagtcagtctcagtcaggacacagcatggacatgagggtcccccgctcagctcctggggctcctgctactctggctccgaggtgccagatgtgacatccagatcgacccagtctccatccctccctgtctgcatctgtaggacacagagtcaccatcacttgccggcaagtcagagctattagcctaaccttaattttaaattggtatacgaaggaagtaaacgtacccggaaggggaaaccgtaccccctaaaacgttcccgtagacttacctatacgatcgactactccctacgttttacgacgtaaagggttccggggtaccctaacgtacgttaaacgggttcgaaggtacgggtacgtacggtacggtaacgttacggtacggggtaacctaggttactttacccacgttacctacctaaccgtactacgacgtacgtacgttccgtacgaccgtaaccgttaggtaacttacgttttacgaacccttaacgtttactaacgttcgtaaactaacggtaacgttacggttaaccgtacgtacccgtaccccggtaccggtaccggtacggacccggtaaacgggtacccggtaaagggttaccggaaactaacccggtaaacgtaccgtaggtacgtcggtccacgtacctagtccgttaccg

SEQ ID NO: 287663 - DNA, 788 bp, Homo sapiens
  misc_feature: GYAE6OF01DGMS0.6.19.B08.1.454.CMB.1.raw
  modified_base (96)..(96): a, c, t, g, unknown or other
  misc_feature (96)..(96): n is a, c, g, or t
  modified_base (224)..(224): a, c, t, g, unknown or other
  misc_feature (224)..(224): n is a, c, g, or t
tcagatatcgcgagcacgaccggtgctcgatttagtgagtcagtaagggggagtcagtctcagtcaggacacagcatggacatgacgggtccccgntcagctcctggggctcctgctactctggctccggaggtgccagatgtgacatccagatgacccagtctccatcctccctgtctgctatctggtacgacacagacgtccacctatcacttggccggganaaggtcagagctaattacggactaacttatttaaagttggtaactacgaaggagtaaccgtaccgaaacgggtaaaccgtacccccttaaaacgtccgttaggtaacctttactaacgttacggacgttacggaccttaaccgttacccgtttaacgttttccggaaaccgtaaacggggttcccggggttaccctaaaggtttacccggtaaagggtttccgagggttaccgggtactaaggttacggtaacgtcgggttaggggaacttaaggttactttccgaactcccgttaaccacgtaacttaccgagtacccgttaggtaccgttaacggaaccttaccttaaagggtaaccgtttgtttaccaaacttttaaccgtacttacgtacgtaactacggttaagttacgttacggtacgttacccgttaccccgtagggttacggttacccgggacgggtaaaacggtaccggtaaacgggtaaacggtaaaccctaagggaaacccgttcggtcggttaacggcccttaactaaccgtaccttacttcgggtttaccc

SEQ ID NO: 287664 - DNA, 750 bp, Homo sapiens
  misc_feature: GYAE6OF01E254B.6.19.B08.1.454.CMB.1.raw
  modified_base (96)..(96): a, c, t, g, unknown or other
  misc_feature (96)..(96): n is a, c, g, or t
  modified_base (257)..(257): a, c, t, g, unknown or other
  misc_feature (257)..(257): n is a, c, g, or t
  modified_base (629)..(629): a, c, t, g, unknown or other
  misc_feature (629)..(629): n is a, c, g, or t
  modified_base (734)..(734): a, c, t, g, unknown or other
  misc_feature (734)..(734): n is a, c, g, or t
tcagatatcgcgagcacgaccggtgctcgatttagtgagtcagtaagggggagtcagtctcagtcaggacacagcatggacatgagggtcccccgntcagctcctgggggtcctcctgctactcgtggcctccggaggtcgccagtatgtagactactaccagatcgaaccctacgtcctcctacttcccctcccttgtctcgctattcgtaggtacgacacgagacgtaccacctatcctacgttcgggcccgganacgtacgacgacgtacttaagttacgaaccttaacttttaaattttaaagttggtaactacgaagggtaataaaccgtaccgggaaggtaaaccccgtaccccttaacgtccgtagtactactagtacgtatcgacctacttaccgttagtttacggaacgtaagggttcccggacctaagttacgtaaggtttcgagggtacgacggttaggtagtcggttacgtaggaacgttagtttactttccgaccttactaccgtaacctccagtcgaacgttcgtacccgtactaaccgtacgttaaggttaacgtttacttaccgttaaccttaacgtttacgtaccttaagaacctaaacggattacgtaacncggttcccgtaccggttacggtcggtaacggaccggtaaccgaaggtaaacgggtataaacccggaactaacggtacggtacggttacgtaaccgcgttaaaccnctttacgcggtttacc

SEQ ID NO: 287665 - DNA, 931 bp, Homo sapiens
  misc_feature: GYAE6OF01A7VFI.6.19.B08.1.454.CMB.1.raw
tcagatatcgcgagcacgaccggtgctcgatttagtgagtcagtaagggggagtcagtctcagtcaggacacagcatggacatgacgggtcccccgctcagctccgtggggctcctgctactctggcctccgaggtcgccagatgtgacatccagatcgacccagtcctccactccctcctgtctgctatctgtaggacacgagtacgtaccaccatcctacgttcggacccgggactaacgtcgaggacgtctaagttacgacctaacctttaaagttttaaagttcggtaatacgaaggaacgtaacgtacccggaaagggaaaccctaccccctaaacgtccgtagtacttacttagtagtacgttgtacctacttaccttacgtttacgaacgtaacgggtccgggtacctacgtacggtaggtacgtaggtcggacgtaggtggtacgtcggtacggtaacgtacgttacgtttacccaaccgttcccgtaacctaacccgtacgttaccggtaacggaccctttaccggtaacccgtaacccggtaacccttaaacccggtttaaagggtttaaaccggtttttaaccgtttttaaacccgaaccccgttttaaaaccgttttacccggttaaacctttaacccgggtaaaccttaaaaacggggtttaccggttaaaacccggtttacccggtaaccccggtttccccccggggtaccccggggtttacccggggttaaacccgggggtaaccccccgggtaaaacgggggtaaaaccccgggttaaaaccggggaaaacggggggttaaaacccgttaaaaccggtttaaaaccccggaaaacccggggtttaagggttaccggttaacccgggtacctaacccggtaaccctttaccggttaaccgtttaaccggtttcccg

SEQ ID NO: 287666 - DNA, 734 bp, Homo sapiens
  misc_feature: GYAE6OF01CD0L9.6.19.B08.1.454.CMB.1.raw
  modified_base (224)..(224): a, c, t, g, unknown or other
  misc_feature (224)..(224): n is a, c, g, or t
tcagatatcgcgagcacgaccggtgctcgatttagtgagtcagtaagggggagtcagtctcagtcaggacacagcatggacatgagggtccccgctcagctccgtgggctcctgctactctggctccgaggtgccagatgtgacatccagatcgacccagtcctccatccctcctgtctgcatctgtaggacacagactcaacctatcacgttcggccgggtanaagtcagagctaattacgactaaccttaaatttaaaacgttggtaactacgaagggtaagaaacgtcccggaaacgggaaaaccgtacccccttaaaaacttccccgtagtaacttacctaagtggtactacggacctaacttccctaacgttttcggaacgtaaagggttcgggtaccctagtacgtaacgggttcaaggttcggacgtagggtacggtacgttacggtagggtaactaagtacttttaccaccgttaccgtaccaaccgtactacgacgtacgtagttcctagtaaccctaaccgtaagtaacgttattttaccgaaccttaaacttactaacgtcgtaacctaaagtacgtacttacgaacgttcccggacccgtacggtaaccggttccggaaccggtaaacgggaaaccgtacgggtaaacggtaaacgtaaccggtaaaacggtacggttaggtaccgggtactaccggtaaccaaccttacgttcgttaaccg

SEQ ID NO: 287667 - DNA, 646 bp, Homo sapiens
  misc_feature: GYAE6OF01AYQ6S.6.19.B08.1.454.CMB.1.raw
  modified_base (95)..(95): a, c, t, g, unknown or other
  misc_feature (95)..(95): n is a, c, g, or t
tcagatatcgcgagcacgaccggtgctcgatttagtgagtcagtaagggggagtcagtctcagtcaggacacagcatggacatgagggtccccgntcagctcctggggctcctgctactctggctccggaggtgccagatgtgacatccagatcgacccagtcctccatcctccctgtctgcatctgtaggacacgagacgtccaacctatccacgttcggaccgggactaagtccaagacgctaattacgacctaaccttaatttaaacgttggtaatacgaaggaacgtaactacccggaagggtaaaccaccccctaaaactccgtagtactactagtagatcgactactccgtactttacgaacgtaaagggtcgggtacctaattacgtaacggttcaggtcggactaggtggtacgttacgtagggaacctagttactttaccgacttctaccactacgtacgacggtactacgtccactaccgtaactacggtaatactttacgaaccttaacgttactaacgtacgtactaaacgtacggtaacttgaccggttccgacccgtacggtaccggtacggtaacgacgggaacgtaacgtagaaagtacgaaacgactgacgtctacgcacttgtcgtac

SEQ ID NO: 287668 - DNA, 558 bp, Homo sapiens
  misc_feature: GYAE6OF01EM5LE.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagatcaccatcacttgccgggcaagtcagagcattagcactatttaatgtatcagagaatcaggaacgccctaaatctagatctatgatgcatcctactttgacgaaaggtcggggtcccaatcgaaaggttcaggtggcaggtggatcgtgggacaggtatttacactctacaccatcaggcaagtctgaccaactgaattattttacgactaaacgttttacctaacgttagtaccaaacgtaagttaacgttacgtaacgtccgtaccccgtcgggtaaccggttccggaaccgaacggggaaccgtaaagggtcggaaaataccggaaacgacgtaggtcggtctagaccactacgtcttcg

SEQ ID NO: 287669 - DNA, 617 bp, Homo sapiens
  misc_feature: GYAE6OF01B0LAH.6.19.B08.1.454.CMB.1.raw
  modified_base (436)..(436): a, c, t, g, unknown or other
  misc_feature (436)..(436): n is a, c, g, or t
tcagatatcgcgagcacgaccggtgctcgatttagtgagtcagtaaagggggagtcagtctcagtcaggacacagcatggacatgagggtccccgctcagctcctggggctcctgctactctggctccgaggtgccagatgtgacatccagatgacccagtctccatcctcctgtctgcatctgtaggacacagacgtccaccatcacttcggaccgggacaagtcaaggagtctaattacgactaaccttaattttaaaagttggtaattacgaaggaagaactaccgaagggaaaccacccctaaactccgtagactctatgaatgactactcctacgtttgaactaacgggtcggtacctatacgtaagtcgagtgacgaggtgatacgaggactaagtattcactctactacctatacagtacgtacgtacncgacctaacgtgtaattagtttcgaaccttaaacgttctaactacgtacaaacttagtaacgttacgacgtcccgtacccgttacgggtaccgtaccggaacggtaaacgggaaccgtaacgggtaacgaaacgtacggaaacgtacgtaggtccggatacgacctaacgtcgttcgtacg

SEQ ID NO: 287670 - DNA, 617 bp, Homo sapiens
  misc_feature: GYAE6OF01DTP0Q.6.19.B08.1.454.CMB.1.raw
  modified_base (133)..(133): a, c, t, g, unknown or other
  misc_feature (133)..(133): n is a, c, g, or t
  modified_base (252)..(252): a, c, t, g, unknown or other
  misc_feature (252)..(252): n is a, c, g, or t
  modified_base (263)..(263): a, c, t, g, unknown or other
  misc_feature (263)..(263): n is a, c, g, or t
  modified_base (607)..(607): a, c, t, g, unknown or other
  misc_feature (607)..(607): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtnccagatgtgacatccagatgacccagtctccatccctcctgtctgcatctgtagacacagagtcaccatcacttgccgggacaagtcagagcattagcactatttaaatggtatcaganaatcaggaacnccctaaactcctagatctatgatgcatcctatttgacgtaaaggtcggggtaccaagtcgtaaacggttcaaggtggactaaggtggtaactcggtagggactaagtactttaccacttcgtaccaaccattcaagtctagttctgacctaaccgttagtaaacgttacttttacgaaccttaaactttaacctaacgttagtaaccaaacgtaacgttaagtttaccacggttccgtaccccgttcggtaaccggttccggaaccggaaaccggtaacgtaacgggtaacggaaaactacgtaaaaccggtaacgttgggtacgtccgtacgtaccctaactnttcgttaccg

SEQ ID NO: 287671 - DNA, 818 bp, Homo sapiens
  misc_feature: GYAE6OF01BZCLD.6.19.B08.1.454.CMB.1.raw
  modified_base (216)..(216): a, c, t, g, unknown or other
  misc_feature (216)..(216): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccggaggtgccagatgtgacatccagatgacccagtctccactcctccctgtctgcatctgagacacagatcaccatcacttcgccggganagtcagagactattacgctaaccttaattttaaagttggtaatcgaaggtaacgaactacccggaagggggaaaacctacccccgttaaaaacgtccgttaaggtaacttaccgttagtgacttcggactacttacccgtaacgttttggaaccttaaacggggtccggggttaccctaaggttaccgtaacgggtttcacgggtcggacgtaggtacgggtattccgggtagggaactacgttacgtttacctaccgttaccctaaccgaaccccttaagtaccgtaacggtacctaacggttaaccttcggtaaacccgttaaccccttaagggttaaacgtttaacgttttttaaccggaaacctttttaaacccgttttaacgttaacgtttaaccggtaaaccgtaaaacgtttaccggttaaacgttttacccggtacggttcccccggttaccccggttaacccggggtaccggtttacccgggaaaccggtaaaccgggaaaccggtaaaaccggggttaacggtaaaacgtacgaaaaccgggttaacgtacggtcggtaacctacggaaccctacctaattccccggttacg

SEQ ID NO: 287672 - DNA, 761 bp, Homo sapiens
  misc_feature: GYAE6OF01E4EFM.6.19.B08.1.454.CMB.1.raw
tcagatatcgcgagcacgaccggtgctcgatttagtgagtcagtaagggggagtcagtctcagtcaggacacagcatggacatgacgggtccccgctcagctccgtggggctcctgctactcgtggcctccggaggtgccagatgtgactactccagatcgacctagtctccactcctccctgtctgactactcgtaggtacgacacgaggactaccacctatctacgttggccgggactaagcagacactacgtacgacttaacttaatttaaagttgtactacggaaggaataaccgtaccgggaacggaaaccctaccccttaaacgtccgtatacgtactagtacggtactcgactaccgttaccttacgttacgaacgtaacgggtcggtaacctagtaccgtaggttcgaggtggtacgtaggtacgtacgttacggacggtactacgtttacgttacctaccttcgtaacccgatacgtacgacgttacgtaccggttactacggtaacccttacggtaggttaacgttttcgtttaaaccgaacctttaaccgtttaaccgtacgttacgtaaccgtaaagttacggtaaacgtttacggtccccggaacccggtttacccggtaaccggttaccgggtaacccgggaaccggttaaaacggtacccgggtaaaaggtacccgttaaaatacccgggttaaacgggtaccgttaggtaccgtacgtaactaccgttacgttaatcccggttac

SEQ ID NO: 287673 - DNA, 749 bp, Homo sapiens
  misc_feature: GYAE6OF01B1S0L.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtgggctcctgctactctggctccgaggtgccagatgtgacatccagatcgacccagtctccatccctccctgtctgctatctgtaggacacgagactccaaccatcctacgttcggcccgggactaaagtcaagacgactaagttaacgacctaaccgtttaattttaaaacgttggtaactacgaagggaagtaacgtaccgaaacggggaaaaccccgtaacccccttaaaaccgttccctacgtaacttccgttaagtacgaattcgacctaacttacccttacgttttacggaacgtaaaacgggttccgggtaccctaagtaccgtaaggttaccggaggtcggacgtaggtaggtaagttcgggtagggaaccgtaagttacctttacctacttccgttacccaacgtactacgacgtcgtaacgttcctacggacctaacgtagtaacgttactttacgaaccttaacttacctatacgaactaagtaagtacgttaacgacgttccctacccggttacgtaccggttaccgggaaccgttaaacgggaaccggtaaacggtaacgtaaaccgtaaccgtaaaacggtcgtacgggtacgtaccgtaccgaaccctaacccgttcgttaccgttaccg

SEQ ID NO: 287674 - DNA, 823 bp, Homo sapiens
  misc_feature: GYAE6OF01EHKYH.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatcgaccctagtcctccacttccctccctgtctgctatcgtggtacggacacgagacgtccaacctatcctacgttcggacccgggactaagtcgaaggacgtactaacgttaagacctaacctttaagttttaaacgttggtaactacgaaggtaacgaaacgtacccggaacgggaaacctaccccctaaaacgttccgtaagtacttacgtagtaggtatcggacctacttcccgttaacgtttacggaacggttaacgggtccgggtacctaacgtacggttaaacgggttcgacgggttacgggtacggtaaggttcggtaacgttacgggtagggtaaccttaacggtttaaccttttacccggtaacctttacccgtaacccttaaacccggacttacggtaacccggttactaaccggttactacggtaaacccgtaacgtttagttaaacggtttcttttaaccggaacctttaactttaaccgtacgtaacgtaacctaaaggtacgttaccgttaacggtacccgttcccggtacccggttaccgggtaccggttacccgggaaaccgggtaaacgggaaaccgttaaggggtaaaccgttaaacgaaccggtaaacgtacggttcggacggtaccacgaccctacgttactccggtttac

SEQ ID NO: 287675 - DNA, 738 bp, Homo sapiens
  misc_feature: GYAE6OF01EOEHC.6.19.B08.1.454.CMB.1.raw
tcagatatcgcgagcacgaccggtgctcgatttagtgagtcagtaagggggagtcagtctcagtcaggacacagcatggacatgagggtcccccgctcagctccgtggggctcctgctactctggctccgaggtgccagatgtgacatccagatcgacctagtcctccacttccctcccgtgtctcgctatcgttaggaggacacgagtacgtaccacccatccgtacgttcggacccgggataacggtcgaagacgacgttaacgtttacgacctaacctttaaagttttaaagttaggttaataccgtaaggaacgtaaacgtaccggtaagggaaacccgtaccctaacgtaccgtagtacttactagtcgatcgtactacttacctattacgtacgtaacggtcggtacctagtacgtaacggttcgaggtacgacgtaaggtcggtacgtacgtacggggtaactagttacgttaccgtacctacttacccgtaaccgttacctacgtaacggttaccgtacgttaccttacggacccttaacgtaacggttaaagtttacctttaacgtaaccgttaaccttacgttaaccgtagtaaccgtaataacgttaccggttaacgccgttaccgtaccccggagttaccggtccggaaaccggtaaccggtaacgtaaacgggtacgtaagaacgttaaacgacgtcgacgtacgcgaccgtactgtccgttacg

SEQ ID NO: 287676 - DNA, 697 bp, Homo sapiens
  misc_feature: GYAE6OF01CKE9I.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccactccctcccttgtctgcatctgtaggacacagacgtccaccatcacgttcggccgggacaagtcagagctattagacctaacctttaattttaaagttggttaatacggaaggtaacgaaactaccggaaacggggtaaaaccgacccccttaaacgtccgtagtacttacgtaagtcgtatcgtactaacttcctacgtttcgaacggtaaacgggtccgggtacctagttacgtaaggttcgacggtgacgtaggtaggcttacggtacggacgtaagttacttacctacctccgtacctaacctagtaccgacgtactacggttaccacgtaacccgtaaccgttagtaaacgtttactttaccgaacctttaaccttaacgtacttacgtaacaacgtagttaaccgttacgtaccgttcccgtaccccgggtacggtaccgggttaccgaaccggtaacgggaacgttaaacggtacggtaaactaaccgaacgtacgtgaccgtctacgacctaccgtatgttaccg

SEQ ID NO: 287677 - DNA, 650 bp, Homo sapiens
  misc_feature: GYAE6OF01C5NO8.6.19.B08.1.454.CMB.1.raw
  modified_base (96)..(96): a, c, t, g, unknown or other
  misc_feature (96)..(96): n is a, c, g, or t
  modified_base (230)..(230): a, c, t, g, unknown or other
  misc_feature (230)..(230): n is a, c, g, or t
  modified_base (466)..(466): a, c, t, g, unknown or other
  misc_feature (466)..(466): n is a, c, g, or t
  modified_base (635)..(635): a, c, t, g, unknown or other
  misc_feature (635)..(635): n is a, c, g, or t
  modified_base (644)..(644): a, c, t, g, unknown or other
  misc_feature (644)..(644): n is a, c, g, or t
tcagatatcgcgagcacgaccggtgctcgatttagtgagtcagtaagggggagtcagtctcagtcaggacacagcatggacatgacgggtccccgntcagctccgtgggctcctgctactctggcctccggaggtcgccagatgtgacatccagatcgacccagtcctccactccctcctgtctgctatcgtagacggacagagactccactatctacgtcggccggtanaacgtcaggatactagttaacgccttaaaccttttaagtttaaacgttaggttaactacggaaggtaacgtaacgtaaccggaacgggaaacccctaccccttaaacgtcctaagtacttacgtatagtactcgactactacctacgttacgacgtaacggtcggtaccagtacgtacggtacgaggtcgacgtgtaggtacgtcggtacgactagtttcgtactactctcaactntacacgtctagtcacgtaactagtagtacgttattacgaactttacgtaactcgttaacaactaagtacgtattcgaccgttacccggtaccggttacggtacggtacggaaccggtaaacgggtataacggtaacgtaaactaacggtaacgtgtcggactacgtacntaactgttnttaccg

SEQ ID NO: 287678 - DNA, 861 bp, Homo sapiens
  misc_feature: GYAE6OF01BUAA4.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctccgtgctactcgtggcctccggaggtcgccagatgtgacactccagactcggaccccagttcctacctacttcccctcccgttgtcctgactacgttcgtaggtaacggaccacgagacgtaccaccctagttcctacggttcgggaccccgggtactaaagtcaaggtacgtacctaagttacgacccttaaccgttttaattttaaacgttaggtactacgaagggacgtaacgtaccggaaacgggtaaaccctacccctaaacgttccgtacgtactacgtagtagtactcgtacctaccgttacccttaacgttttacgaaaccggttaaccgggttccgggtacccctaagttaaccggtaacggtttaccggaggtacggtacggtacggtacggtacgttacgggtaacgggtacttaacgttacgtttaccgaccttaccgtaaccgtaccgtagtccgtaacgtaccgttacgtaccgtacgtaacccttaacggttacgttaacggtttaccgtttaccggtaacctttaaccgttaaccttacggtacgtaaacccgtaaccgtaaggtttaacccgtaccgtaccgttccccggtacccggtacgggttacccggttaccggaacccggttaaacgggaaccggttaaacgggtaaacccggtaaacctaaccgggtaaaccggttacgtcgggtaccgtacctaccgaacccgtaaccttccgtaccggtttaccg

SEQ ID NO: 287679 - DNA, 690 bp, Homo sapiens
  misc_feature: GYAE6OF01BMN5K.6.19.B08.1.454.CMB.1.raw
  modified_base (203)..(203): a, c, t, g, unknown or other
  misc_feature (203)..(203): n is a, c, g, or t
  modified_base (441)..(441): a, c, t, g, unknown or other
  misc_feature (441)..(441): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtctccatccctcctgtctgcatctgtaggacacagagtcaccntccacgttcggaccgggacaagtccagacgctaagttacgacctaaccttaattttaaagttggtactacgaaggtaagaactaccggaaacgggtaaacctacccccttaaacgtccgttaggtaactacttagtagactacgacctaactaccttaacgtttacggaacgtaaacgggtccgggtaccctaagtaccgtacggttacgaggttacggacgtaggtaggcttacggngggtaaccgtagtactttaccgacttccgtacctaacacgttacgacgttctagttacctacgaccttaacgtaagtactttacgtttacgaacttaaccttactacgtacaacaacgtagtaccttacgacgttcccgcccgttaggacccggtacgaacccggtaggtaacccgttaagggtacgtaaaaccgagttaaacccggaagttcggaccgcgttaccgaaccgttacctgtcgttaaccg

SEQ ID NO: 287680 - DNA, 835 bp, Homo sapiens
  misc_feature: GYAE6OF01CUBA2.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctcctgctactctggctccggaggtgccagatgtgacatccagatcgacccagtcctccactccctcctgtctgctatcgtgtaggacagagacgtacacctatactacgtcggccgggactaagtcgaagagactagttacgaccttaacgtttaatttaaagttacggtaatacgaaggaactaacgtaccggaacggtaaaccgtacccttaactcctagtactctagtaggactcgactacttactacgttacgacggtaacggttcgggtaccctaagtacggtaacggttacgaggtacggacgtaacggtacggtacgttaggtacggaacgttaagtttacgttacctacttacctaccaaccgtactacggaacgtaccttacgtacggtaccgtaaaccgtaaccgtttaaggttaaacgtttacttttaacccggtaacctttaaaccgttttaaccttaacggttaaccgttaaaccgtaaacgggtttaccgtttaaacggtttaccggtaaccccgtttcccggaacccccggggttttacgggtaacccgggtttaacccgggaaaacccggggtaaccgggtaaaccgggtaaaaggggttaaccggtaaaaacgttaaaccccgggttaaacgggttacccggtaagggtaccccgtttaccggaaaccgttaccccgggtaaactttcggtttaaaccgtttccccgg

SEQ ID NO: 287681 - DNA, 712 bp, Homo sapiens
  misc_feature: GYAE6OF01CC1BP.6.19.B08.1.454.CMB.1.raw
  modified_base (259)..(259): a, c, t, g, unknown or other
  misc_feature (259)..(259): n is a, c, g, or t
tcagatatcgcgagcacgaccggtgctcgatttagtgagtcagtaagggggagtcagtctcagtcaggacacagcatggacatgagggtccccgctcagctcccggggctcctgctactctggctccgaggtgccagatgtgacatccagatgacccagtctccatccctccctgtctgcatctgtaggacacagagtcacatcacttgccggcagtcgagagctattagctaaccttaatttaaatggtatcgagganaactccgaagggtaaacaccccctaaatcctaggaactcgtatacgaatcgactactacccgttactttcggaacgtaaacgggtcgggttacccaagttacgaaacgggtttcaagggtcgacgtaaggtcggtaactcggtacgggaactacgtacttttacgaccttctacctaaccgtactacgtacgtaccgtacgtacctacgactaaacccgtagtaacgtttaactttacgtaaccgttaacttaaccttaacgtacgtaacctaaacgtaagttaaccggttacctacggttacccgtaccccggtaaccggtaccggtttaccgggaacccggtaaacgggtaaacccgtaaacggggtaaacgtaaacggttaaccgaaaacggtaccgtacggtacggtaacctcggtacccaaccgtaccgttccgttcggtttaacccc

SEQ ID NO: 287682 - DNA, 707 bp, Homo sapiens
  misc_feature: GYAE6OF01DOMG7.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtgggctcctgctactctggctccggaggtgccagatgtgaccatccagatcgacccagtcctccatcctccctgtctgcatctggtacgacacgagacgtcaccatctacgttcggccgggacaagtcagagcctaattagaccttaaccttaattttaaagttggttaatacgaagggtaacgtaaacgtaccggaaaggggtaaacccgtacccccttaaaactcccgtaggtacttaccgtaattcgacgttcgactacttacccgtacgttagaacgtaagggtccggtccctaagttacgtaaacgggttcaaggttcggacgtaggtacggtacttcgggtagggtactaagttacttttaaccgaccctttccgtacctaaccgacgtcgtaaccgtcgtaccggtactaccggaacctaaccgttaggtaacgtttcgtttacgacctttaaacgttctacttacgtaacctaagagttacgttacgcggtacccgttaccccggtggtacccggttcgaaccggtaacgggacggtaggtaacgtaacgagtaaaccgtaggtagtacggtctacgataacctcgttagttccg

SEQ ID NO: 287683 - DNA, 645 bp, Homo sapiens
  misc_feature: GYAE6OF01AC8W2.6.19.B08.1.454.CMB.1.raw
  modified_base (269)..(269): a, c, t, g, unknown or other
  misc_feature (269)..(269): n is a, c, g, or t
tcagatatcgcgagcacgaccggtgctcgatttagtgagtcagtaagggggagtcagtctcagtcaggacacagcatggacatgagggtcccccgctcagctcctggggctcctgctactctggctccgaggtgccagatggtgacatccagatgaccccagtcctccatccctccctgtctgctatctgtaggacacagagtcaccatcgtacttggccggcaagtcagagctattagccaccttaatttaaagttggtatcgagganaacgtccgaagggaaactcccctaaatccagatctaagtgatcgctactccgtaactttgacgaaaggtccgggtaccaagttacgtaaggttcaggtggacgtaggtacggtactggtagggaactggtactttaccgacttactacgaaccctagtaccagtaccgtagttccgtacgaacccgtaaccgttaagtaacggtttacttttaccggaccttaaacccgtttacttaacgattaacccaacgtagtaccgttacgacgttccggaccccgtacggtacccgtcgggaccgtaacgggaacctaagggtacgaaagttacccgaaaggtcgtaggttacgtacttacggtaacctcttgtaccttcg

SEQ ID NO: 287684 - DNA, 693 bp, Homo sapiens
  misc_feature: GYAE6OF01BG0VZ.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgaccccagtcctccatccctccctgtctgctatctgtaggacacagagtcaccatcacttcggccgggcaagtcagagctaattagactaaccttaattttaaaattgggttaatacgaaggagtaacgtaccgaacgggtaaaccgaccccctaaaacctcccgtagtactacctaagttagatacgacctaacttacccgtacttttacggaaccgtaaacgggttccggggtaccctaacgtaaccgttaagggttcagggttcgacggtaaggttcggacgttcggtaggggtacaaggttactttaccgtaccttcctaccacctataccgtagacctagtccgtacgtacctaaccgtagtaagttacgttttacgaccttaacttactacgtactaacaagtacgtacgtacgtacgtccgcccgttacggaccggttaccggaccggtaaccggaacggtaacggtaacgtaaacgtaaccgtaaacgtaacgtggttaccggtacgttacgaccgtacctgtccgttaccg

SEQ ID NO: 287685 - DNA, 665 bp, Homo sapiens
  misc_feature: GYAE6OF01DAUVX.6.19.B08.1.454.CMB.1.raw
  modified_base (659)..(659): a, c, t, g, unknown or other
  misc_feature (659)..(659): n is a, c, g, or t
tcagatatcgcgagcacgaccggtgctcgatttagtgagtcagtaagggggagtcagtctcagtcaggacacagcatggacatgagggtccccgctcagctccgtggggcctcctgctactctggctccgaggtgccagatgtgacatccagatcgacccagtctccatccctcctgtctgctatctgtaggacacagacgtccaccatctacgttcgcccgggacaaggtcaagacgctaattacgctaaccttaatttaaattggtaactacgaaggtaagaaactaccggaacgggaaaccgtaccccttaaaacgtccgttagatctatagtatgtacacttcctacgttacgaacgtaacggtcgggtaccctaagtacgttaaacggttacgaggtacgggacgtagggtacggtacgtcggtagggaactaggttaactttctacgtacctacctacccgtataccgacgtctacgttactacgacctaacgttagtaacgttagtttacgactttaacttaacctagttacgactaactaggtaacgttacgacgtccgtaccccgtaggtacggtaccgaacggtaaccggaacggtaacggtaaggaaacttacgaaacgtaggtcgacgtacgtacaccgaactcgtnttaccg

SEQ ID NO: 287686 - DNA, 650 bp, Homo sapiens
  misc_feature: GYAE6OF01EXESW.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttcgccgggacaagtcagagactattacgacctaaccttaatttaaaagttggttaatacgaaggtacgaaattacccgaaagggaaaaccgtaccccctaaaaacttccgtagtaacttacgtaatagtaactgacacttaccgtaacgttttgaaccgtaaacgggttacgggtcccaagttacgtaaggttcaggtaggacgtacgggtaggtaacgtggtagggaactagttactttacgtactctacaacctataccagactaacgtctagaaccctaacgtagtaagttatttacgactaaacgtttactacgtataacgaactaagtacgttaaccgacgttccgtaccccgtacggtaccggtcggaaccggaacggaacgtaaggtacgaaaagtaccgaaacgaacgtgacggtctacgctaccagttgttacg

SEQ ID NO: 287687 - DNA, 660 bp, Homo sapiens
  misc_feature: GYAE6OF01A4ZLY.6.19.B08.1.454.CMB.1.raw
  modified_base (284)..(284): a, c, t, g, unknown or other
  misc_feature (284)..(284): n is a, c, g, or t
  modified_base (652)..(652): a, c, t, g, unknown or other
  misc_feature (652)..(652): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccggaggtgccagatgtgacatccagatcgacccagtctccactcctccctgtctgcatctgtaggacacagagtcaccatcacgttgccgggacaagtcagagcattagctaccttaatttaaagtgtatacgaggagaacgtaccgaagggaaaccncccctaaactcctagtatactatgatgacactcctactttgacgtaaggtcgggtacctagttacgtaaggttcgaaggtggacgtaggttacggagttcggtagggactaacgtacgttttaccaacgttcctacccaaccgatacgacgcgtaacgttccgacgaccctaaccgtaggttaaacgttagttttacgaacctttaaacctttacgtaccgttacgtaaccgtaaacgtagttaacgttacctacggttccccgtaccccgtacggtaaccggttccggaaccggtaaagggaacccgtaagggtaacgtaaacgtaccaaacgggtacgtagtacggtctacggacctacttacgtntttaccgg

SEQ ID NO: 287688 - DNA, 694 bp, Homo sapiens
  misc_feature: GYAE6OF01DDKL3.6.19.B08.1.454.CMB.1.raw
  modified_base (92)..(92): a, c, t, g, unknown or other
  misc_feature (92)..(92): n is a, c, g, or t
  modified_base (129)..(129): a, c, t, g, unknown or other
  misc_feature (129)..(129): n is a, c, g, or t
tcagatatcgcgagcacgaccggtgctcgatttagtgagtcagtaaggggagtcagtctcagtcaggacacagcatggacatgaggtccccntcagctcctgggctcctgctactctggctccgaggtnccagatgtgacatccagatgacccagtcctcatcctacccgtgtactcgctactctaggacggaccacagtacgtaccaactatcacgttggccggactaaggtcaaggctctaagttacgtctaaccgtttaattaagttggtactacgaaggtataactacgaaggaacctaccctaaacgtcctagactactagtgatcgctactctacgttcgaacgtaaggtcggtacctagtacgtacgttacaggttcgacgtaggtggtacgtacggttacgggaacttacggttactttaccgccgttaccttacccgacctagttacccgtaagggaccttcggttacttacccggaaccgtaacgtacggtaaagtttccgtttacgaacctttaacgtacctacgtacggtaacctaacgtagttaccgttacgaccggttccgtcccggttacggtccgtaccggtaacgaacgggttaacccagggttaaccgaaagttaacccgaaaccggttacgtacggtaccgggtaactactccgtaaccctagttcgtttaccgg

SEQ ID NO: 287689 - DNA, 720 bp, Homo sapiens
  misc_feature: GYAE6OF01EZPGI.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctcctgtctgcatctgtaggacacagagtcaccatcacttggccgggacaaggtcagagactattagctaccttaatttaaattggtattcgaaggagaatccgaacgggaaactccccgtaaactcctagactaccttatgaacttcgctactcccgtacttttacgacgtaaacggtcggggtaccctaagttacgtaaagggttccgtaaggttgggaccgtagggtacggtaaggttaccgtacggggtaacaagggttacttttaccgacttctaccgtaaccctagtacaggtaccgtaagttccgtagtaccgtaaccgtaggtaaacgttacgtttttagaaccgtaaccttttaaccgtacttacgtaaccgtaaagaccgttaaaggtttacacggttaccgtacccccgtacgggtaccggtttaccgggacccgaaacgggggtacccctaaaggggtacggaaaacgttacggaaaaccggtaccgttaacgggtaccggtaacgttcgtaaccgtcccttaaaggtccctttaaccgg

SEQ ID NO: 287690 - DNA, 875 bp, Homo sapiens
  misc_feature: GYAE6OF01EHMEX.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtgggctcctgctactctggctccgaggtgccagatgtgacatccagatcgaccctagtcctccatccctccctgtctgcatctaggtagacacagacgtccaacctatccacgttcggccgggacaagtcgaggagctatacgctaacttaattttaaagttggtaatcgaaggaagtaaacgtaccggaaagggaaaacccgtacccccttaaaactcccgtaagtactttaccgttaagttacggtaactacggtacctaaccgtttacccttaacggtttttacggaaaccgttaaaacggggttccggggttaacccctaaacgttaaccggtaaacgggtttcggtaacggttcgggtacgtaacgggttacgggtaacgttcgggtaacgggtaaccttaaagtacgtttttaacccactttaccccgtaacctaaaccccgtaactaccgtaaccgggtacccgttaacggttaccgtaacgtaaaccctttaaaccggttaacggttaaacggttttactttttacgaaacccgtttaaaccttttaaccgttaaccgttacggttaaacccaacggttaacgttacggttaacccgtacggtttccccgacccccggttacggggttaacccgttacccgggtaaaccgggtaaaccggggtaaacccggtaagggtaaaaccggtaaacggtaaacccgtaaacgggtaaacgttcggtaacggtaccgtaccggtaacctaacggtacgtttcccgtagg

SEQ ID NO: 287691 - DNA, 793 bp, Homo sapiens
  misc_feature: GYAE6OF01BJ4YN.6.19.B08.1.454.CMB.1.raw
  modified_base (94)..(94): a, c, t, g, unknown or other
  misc_feature (94)..(94): n is a, c, g, or t
tcagatatcgcgagcacgaccggtgctcgatttagtgagtcagtaagggggagtcagtctcagtcaggacacagcatggacatgagggtccccntcagctcctggggctcctgctactctggctccgagtgccagatgtgacatccagtatcgacctagtcctccacttccctccgtgtctgctacgttcgtaggaacggacacgtagtacgtaccaccgtactcgtaacgttcgggacccggtataaaggtcgaaggtacgacctaagttacgaccttaacgtttaatttaaacgtggttaactccggaaaggtacgtaaacgtaccggaaacgggtaaacccgtaccccttaaacgtccgtagttaacttacgtagtacgtactcggtactacgttacctacgtttagaacgttaacggtcggaacctagtaccgtaaaggtcgtacggtgacgtacggtacgtacgtacggtacggtaactaggttaaccttcctacgttaccgtaccgtaaccgttcgtaacgacgtacgtaccgtcgtaaccgtacctaaccggttagttaaccggttactttacggtaaccttaccttaaccgttacgtaccgttaacgttaacgtacggttaaccggttaccgtaaccgggttcccgttaacccgggttaccggtaacccggttaccggaaacccggtaacgggtaacccgtaacgggtaaaccggtaactaaaccggtaaaccgttacggtacgttaccgtaccgtaacgacctacgttaacgtcgttaaacccg

SEQ ID NO: 287692 - DNA, 674 bp, Homo sapiens
  misc_feature: GYAE6OF01CV1MH.6.19.B08.1.454.CMB.1.raw
  modified_base (332)..(332): a, c, t, g, unknown or other
  misc_feature (332)..(332): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatgacccagtctccatccctcctgtctgcatctgtaggacacagagtccaccatcacgttcggcccgggacaaggtcaaggagctaagtttacgactaaccttaattttaaagttggtaatacgaaggaagaacgtaccgaacgggaaaccgtccccttaaactccgtagatactatgatnactactcctactttagacgtaacggtcgggtaccattacgtaaggttcgaggtaggcgtaggtggtaacgtcgtagggaactagtactttccacgttctaccgaactactacgaagtacgtacgttacgtacgtaacctaaccgttaggtaaacgtttagttttacgaacctttaaacttcttaacgttacgttaacaacgtaacggttaacgtttaaccgcggttaccgtccccgttagggtacccggttaccggaacgaaacggggtaccgtaagggtaaaccgaaagtaacggtaaaccgtacgtggtacggtactacgactacctagttcccgttacg

SEQ ID NO: 287693 - DNA, 698 bp, Homo sapiens
  misc_feature: GYAE6OF01DQ4K3.6.19.B08.1.454.CMB.1.raw
  modified_base (167)..(167): a, c, t, g, unknown or other
  misc_feature (167)..(167): n is a, c, g, or t
  modified_base (469)..(469): a, c, t, g, unknown or other
  misc_feature (469)..(469): n is a, c, g, or t
  modified_base (623)..(623): a, c, t, g, unknown or other
  misc_feature (623)..(623): n is a, c, g, or t
  modified_base (684)..(684): a, c, t, g, unknown or other
  misc_feature (684)..(684): n is a, c, g, or t
  modified_base (688)..(688): a, c, t, g, unknown or other
  misc_feature (688)..(688): n is a, c, g, or t
  modified_base (693)..(693): a, c, t, g, unknown or other
  misc_feature (693)..(693): n is a, c, g, or t
tcagatatcgcgagcacgaccggtgctcgatttagtgagtcagtaagggggagtcagtctcagtcaggacacagcatggacatgacgggtccccgctcagctccgtggggctcctgctactctggctccgaggtcgccagatgtgacatccagatcgacccagtccnccactcctccctgtctgctatcgtagtaggacacagtacgtacacctatactacgttcggaccggggactaaggtccgaaggactactacgtttaacgacccttaaactttaaagttttaaaagttacgggtaacttacggaaggaacgtaaacgtaccggaaacggggaaacccttaaccccgtaaacctcctagtaacttctaagtcgacgttcacctactaccccgttagtttacggaacgtaacgggttcggtaccagttacgtaaggtcgtaggcgtcgtaaggtcggtagttacgngggtaactacggttaacttttccaaccgtttcccaacccgtacttaacgcccgtaagcgttacggtacctacggtaaccttaaccggagttaacgtttagtttacccgaacctttaacgttactacgtacgtaaccgtaaacgagttaccgtanacgttccaccgtcggtacgtacgacggaacgcgtaaggactaagacctaagctaggctacnaccngtctnttacg

SEQ ID NO: 287694 - DNA, 753 bp, Homo sapiens
  misc_feature: GYAE6OF01EF6V9.6.19.B08.1.454.CMB.1.raw
  modified_base (743)..(743): a, c, t, g, unknown or other
  misc_feature (743)..(743): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtctccatcctcctgtctgcatctgtagacacagagtcaccatccacttggccggacaagtcagagcattagcacttaatttaattggtatacgaggaagaactaccgaaggggaaacctacccccttaaaactccgtagtaacttctaagtgtaatcgactacttccctaacgtttcggaacgtaaacgggtcggggtacccctaagttaccgtaaacgggtttcaagggttcggaccgtaagggttacggtaacgttccgggtacggggtaactaacggtttaaccttttaccgaaccctttcccgttaacccaaaccctaacgttacgaacgtaccctaaggttcctaggaaccctaaaccgttaggttaaatttacgtttttacgaacccttaaacttttaacgtaccgttacggtaacaaacgttaacggtacgtttaacccgacgggttccccgtacccccggttacggggtaaccgttacccggggaaccgtaaacggggaaacccgtaaaggggttaaccggaaaacgtaccgtaaaacggacgtttacgggtacggtactacggaccctaacgtnttcgttaccg

SEQ ID NO: 287695 - DNA, 851 bp, Homo sapiens
  misc_feature: GYAE6OF01EWOZW.6.19.B08.1.454.CMB.1.raw
  modified_base (838)..(838): a, c, t, g, unknown or other
  misc_feature (838)..(838): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccggaggtgccagatgtgacatccagatcgacccagtcctccattccctcctgtctgctattccgtagtacggacacgagacgtcacctactctacgttcggccgggacaaggtcaaggacgactaagttacggaccttaacctttaaattttaaaagtttggttaacttaccggaaagggtaacgtaaacgttaacccggaaagggggtaaaacccctaaccccctaaaacgttcccgttaaggtacttaaccttaagttgtaaccgtgtacctaccttaccgttacgtttagaaaccggttaaacggggtttcccgggtaccctaacgttaaccggttaaacggttcggtaacggtagggtacggtaagggtttacggtaacgtaccggggttacgggaacgttaacgtttacgtttaccctacttacccgtacccaaaccttactaccgtacggtacgttaaaccgtcctcgaaaccccggttaacgtaaggttaaaccgtttacgttttacgaaacccttaacttttaaccctaagttacgttaacgaaattaacggttacgttaccgtacgtccccgggttacccgttacgggtacccgggttaccgggaaaccgtaaccggggaaacggttaaccgggtaaaacgttaaaccggaaccccgtaaaaggttaccgtggggtacccgtactaccggaactaaccgttnttcccgttaccgg

SEQ ID NO: 287696 - DNA, 717 bp, Homo sapiens
  misc_feature: GYAE6OF01A5LDK.6.19.B08.1.454.CMB.1.raw
  modified_base (347)..(347): a, c, t, g, unknown or other
  misc_feature (347)..(347): n is a, c, g, or t
tcagatatcgcgagcacgaccggtgctcgatttagtgagtcagtaagggggagtcagtctcagtcaggacacagcatggacatgagggtccccgctcagctcctggggcctcctgctactctggctccggaggtgccagatgtgacactccagatcgacccagtctccatccctccctgtctgcatcgtgtaggacacagagtccaccatcgtacttcggccgggacaagtcagacgactattagacctaacctttaagttttaaagtggttaactacgaagggaacgtaactaccggaaacggggaaacctaccccctaaaaccttcctagtacttacttataggntcgctactcctacgttagacgtaacggtcgggtacctagtacgtaaggttcaggtgcgtaggtacgtagtaggacggtactagttactttccaccttactaccgtaacctgtaccgaacgtccgtacgttacgtaccgtaccgtaaccgtttaggtaaagtttaactttttacccgaactttaaacccgttttactaaccggttacttaaccgaacgtacggtttaacgttacgttaaccggtcccgtaccccggttagggttacccgttccgggaaccggtaaccgggaacgtaaacgggtaacgtaaacgttaccggaaacgttacggtcgcggtaacccgtacgacccgtacttagtcgttaacccg

SEQ ID NO: 287697 - DNA, 642 bp, Homo sapiens
  misc_feature: GYAE6OF01DFEQI.6.19.B08.1.454.CMB.1.raw
  modified_base (94)..(94): a, c, t, g, unknown or other
  misc_feature (94)..(94): n is a, c, g, or t
  modified_base (477)..(477): a, c, t, g, unknown or other
  misc_feature (477)..(477): n is a, c, g, or t
tcagatatcgcgagcacgaccggtgctcgatttagtgagtcagtaaggggagtcagtctcagtcaggacacagcatggacatgagggtccccgntcagctccgtgggctccctgctactctggctccgaggtgccagatgtgacatccagatgaccagtctccatccctccctgtctgcatctgaggacacagagtccaccactctacgttcgccggacaagtcagagctagttacgctacttaatttaagttgtaatcgaaggaagaactaccggaaacggaaccgtaacccctaaacgtcctagtataccgtatgatgacgtaccttacccgtaagtttcgaacggttaccggtacggtaccctagtacgtaaggttacgaggtacggacgtaggtaggactcggtaggactagtacttcgtacctcgtaccaccgttatacgtagactacgtctacgacctaactagtaagttntttaccgacttaacgttaccttaagtcgtaaactagtaacgttaacgtccgtacgtccgtaccccgttaggtacccgtacggtaaccggaccgggtaaccgtaacggtaaggaaccgtaacgaaacgtacgttaagcgtactacccgataccctgttccgttacg

SEQ ID NO: 287698 - DNA, 591 bp, Homo sapiens
  misc_feature: GYAE6OF01A6CEB.6.19.B08.1.454.CMB.1.raw
  modified_base (95)..(95): a, c, t, g, unknown or other
  misc_feature (95)..(95): n is a, c, g, or t
  modified_base (406)..(406): a, c, t, g, unknown or other
  misc_feature (406)..(406): n is a, c, g, or t
  modified_base (582)..(582): a, c, t, g, unknown or other
  misc_feature (582)..(582): n is a, c, g, or t
tcagatatcgcgagcacgaccggtgctcgatttagtgagtcagtaagggggagtcagtctcagtcaggacacagcatggacatgagggtccccgntcagctccgtggggctcctgctactctggctccgaggtgccagatgtgacatccagatcgacccagtctccatccctcctgtctgcatctgtacgacacagacgtcacctatcacgttggccggacaagtcagagctattagcctaacttaatttaagtggtatacgagacgtaactaccgaacgggtaaacctaccctaaactccgtagtactacgtagtagatcgactactctacttgaacgtaacggtcggtaccagtacgtaagttcgaggtcggactaggtgtagtcggagtactagttacttacnctctacactagtcagctacgtcgactactacgtagtaagttactttagacttaacgttctaacgtagtaacgaactagtacgtaactcgccgtacccgtagtaaccgtcggaacgacggtaacgtaggtaaagtaacgaacgaacgtacgtcggtaccgtactacgaacccttacncgttcgtac

SEQ ID NO: 287699 - DNA, 688 bp, Homo sapiens
  misc_feature: GYAE6OF01BEPWZ.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatgacccagtctccatccctccctgtctgcatctgtagacacagacgtacaccatcacgttcggcccgggacaagtcagagctaattagacctaacctttaattttaaacgttggtaatacgaaggaacgaactaccggaaacgggaaaccgacccccttaaaactccgtagaacttactatgactcgactacttcctaacgtttggaacgtaaacgggtccgggtaccctaagttaccgtaaggttccaggtcggacgtaggttaggtacttacggtacgggactagttactttacctacgttcctactacctactaccgagtcgtaacgtctacgtacctaaccgttaagtaacgtttatttacgtaaccttaactttactacttacgaactaacgtaggtacgttacgaccgttccgtaccccggtacggtaccggttaccggaacggtaaaccgggaacgtaacggtaacgtaaactaaccggtaaacgtaccgtagggtacgtcgtaaccgtacctaccgtgttcgttaccg

SEQ ID NO: 287700 - DNA, 627 bp, Homo sapiens
  misc_feature: GYAE6OF01ACCS8.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtcctccatcctccctgtctgcatctgtaggacacagacgtccaccatcacgttcggccgggcaagtcagagcattacgcaccttatttaaatggtatcgagagaactccgaaggaaccgacccctaaactcctgactctatgatgcactccactttgacgtaaaggtcgggtacctagtacgtaacggttcgaggtcggacgtaggtcggtatcgtagggactagtactttccgaacctcgtaccaccgtatcacgtcctagtcctacgaccgtaaccgtagtaacgttagttttacgaaccttaaactttacctaacgttacgtaacctaacgtaacggtacgttaccgacgttccggtaccccgttacgggtaccggttccgggaaccgtaaacgggaaccgtaaagggtacgtaaacgtaacgaaacgtacgtggtacggtacgtacaccgactgttcgttaccg

SEQ ID NO: 287701 - DNA, 647 bp, Homo sapiens
  misc_feature: GYAE6OF01EW47O.6.19.B08.1.454.CMB.1.raw
  modified_base (221)..(221): a, c, t, g, unknown or other
  misc_feature (221)..(221): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagatcaccatcactgccggcaagtcagngcattagactacttaatttaaattggtaatcgaggaagaatccgaaggaaacgacccctaaatcctgatctatgatcgctactcctatttcgacgtaaaggtcgggtaccctaatacgtaaggttcaaggtggcgaggtgatcgtagggactaagtactttaccacgttctaccaaccctaattaccgaggtacctaacgttactacgtaaccctaaccgtaaggtaaagtttaactttttacggaaccttaaaccttttaacgtacttacgtaaccaaacggtaacgtaagttaccacggttcccgtaccccgttacggtaaccggttaccggaccgtaaaccgggaaccgtaaaggggtaacgtaaaacgtaactaaaacggaacgttagtacgggtactacggacctaacctagtcgttaccg

SEQ ID NO: 287702 - DNA, 711 bp, Homo sapiens
  misc_feature: GYAE6OF01D9JDY.6.19.B08.1.454.CMB.1.raw
tcagatatcgcgagcacgaccggtgctcgatttagtgagtcagtaagggggagtcagtctcagtcaggacacagcatggacatggacgggtcccccgctcagctccgtggggcctcctgctactctggctccgaggtgccagatgtgacatccagatcgacccagtcctcctactcccgtccctgttcctgctacttctaggtaacgaccacgagtacgtccaaccctattccgtacgttcggcccgggactaaggtccaggacgtctaagttacgacctaaccttttaagtttttaaagttggttagttacgaagggtaacgtaaacgtacccggaaacggggaaaccctaacccccttaaaccgtcccgtagtattactagtagacttacgactacttaccttacgtttagaacggtaacggtcggtacctacgtacgtaacggttcgtaggtgtacggtaggttacggacgttcggtacggtactagttactttacccacgttcctaccacctaatccgacgtctacgtccttacgaccgtacgttaggtaattacgtttacaccttaacttactacgtagaacctagtaacgttacgtaccgtacgttccccgtaccgtacggttaccgtcggaacccggtacggtaaccgtaagggtaacgaacgtaacggtaactacggtgacgtcgacgcctaactgttcgttc

SEQ ID NO: 287703 - DNA, 749 bp, Homo sapiens
  misc_feature: GYAE6OF01CDBT6.6.19.B08.1.454.CMB.1.raw
  modified_base (228)..(228): a, c, t, g, unknown or other
  misc_feature (228)..(228): n is a, c, g, or t
tcagatatcgcgagcacgaccggtgctcgatttagtgagtcagtaagggggagtcagtctcagtcaggacacagcatggacatggagggtcccccgctcagctccgtgggctcctgctactcgtggctccgaggtgccagatgtagacatccagatcgacccagtcctccatccctcctgtctgctatctgagacacagtatccacctatctacgttcggaccggganaacgtcgagacgtacctaagttacgacctaaacctttaagttttaaaagttggtattacgaagggtaataacgtcccggaaaggggtaaaccctaccccttaaagtccgtagtcttaccgttagtgactacgacctacttacctacgtttaggacgtaaaacgggttccgggacccttaagtaccggtaaggttcgaaggttcgtacgtaaggtggttaacgtgggtacggataacgttctttaccaccgttcctaacgtaccctactcgtaacgcgttacgtacctacgtaaccgtaacgttacgtaaacgttacttacgtaaccttaacgtttaacctacgtaacttaccgtaacgtagttaacggttaccgacggttacccgtccccggtacggtaaccgttaccccggaaacgggtaaccgggaaacggtaacgggtaaacgtaaaccgtaaacggtaaaccgttaaacgtacggtacggtaacctcggttaacctcgtaaaccgtcgtttaaccgg

SEQ ID NO: 287704 - DNA, 675 bp, Homo sapiens
  misc_feature: GYAE6OF01DU4D8.6.19.B08.1.454.CMB.1.raw
  modified_base (301)..(301): a, c, t, g, unknown or other
  misc_feature (301)..(301): n is a, c, g, or t
tcagatatcgcgagcacgaccggtgctcgatttagtgagtcagtaagggggagtcagtctcagtcaggacacagcatggacatgagggtccccgctcagctcctggggcctcctgctactctggctccgaggtgccagatgtgacatccagatgacccagtctccatacctccctgtctgcatctgtaggacacagagtcaccatcacttggccgggacaagtcagagctattagctaactatttaaattggtatacgagagaactcgaacgggaacgacccctaactctgattctatgangctatccctatttcgacgtaaggtcgggtaccagtcgtaacggttcaggtcgcgtaggtggagtcgtagggactagtactttcaccttactccgacctactcgacgacctagttcctagacctaacgtagtaagtttaacttttcgactttaaaccgttacctaactcgttaaccaacgtagtaaccgttacaccgggttccgtacccccggtacgggttaacccggttaccggaacccggtaaaacggggtacccgttaaacggggtaaaccggtttaaaacggaaaccccggtaaaaccgggttaaccgtacgggttaacccgggttcctaacccgggtaacccctaaaccgtacgtttcccggtttaaccc

SEQ ID NO: 287705 - DNA, 797 bp, Homo sapiens
  misc_feature: GYAE6OF01AC5S8.6.19.B08.1.454.CMB.1.raw
  modified_base (95)..(95): a, c, t, g, unknown or other
  misc_feature (95)..(95): n is a, c, g, or t
  modified_base (218)..(218): a, c, t, g, unknown or other
  misc_feature (218)..(218): n is a, c, g, or t
  modified_base (240)..(240): a, c, t, g, unknown or other
  misc_feature (240)..(240): n is a, c, g, or t
tcagatatcgcgagcacgaccggtgctcgatttagtgagtcagtaaggggagtcagtctcagtcaggacacagcatggacatgacgggtccccgntcagctccgtgggctcctgctactctggctccgaggtcgcagactgtagaccatcccgagactcgacccagtcctccactcctccctgtctgcatcgtagtagaccacgagacgtccaaccgntaccgacgttcggcccgggtanaaacggttccgaaggtactactaagttacgacctaaccgtttaaagttttaaacgtttcggtaacgtacgtaacggggtaactaaccgtaccggtaaacggggtaaaaccccgtacccccgttaaaaaccttccggttaacgtaacttaccgtttaagtccggttaacgtcggtacccgttaacttacccgtttaacggttttaccggaaccgggttaaaaccgggttccggggtacccctaacggttaaccggtaacgggtttacccggtacggtacggggtacgtacgggtacggttacggtcgtaccggggaacttaacggttccttacctaccttaccgacctaaccgtactcgacgtacgttacaccgtacgtaacctaacgttacgtaattaagtccgtaactacgttactccggttaacacctaaactacgtacgtaacgccgtaacggtccccgtacggtccggtacgggtaccgaaccgggtaacgaaaggtacaacggttaacaaccggtacgtgtacgtaccgtactaccgtccgtatcggttacc

SEQ ID NO: 287706 - DNA, 713 bp, Homo sapiens
  misc_feature: GYAE6OF01EK76N.6.19.B08.1.454.CMB.1.raw
  modified_base (287)..(287): a, c, t, g, unknown or other
  misc_feature (287)..(287): n is a, c, g, or t
  modified_base (703)..(703): a, c, t, g, unknown or other
  misc_feature (703)..(703): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccggaggtgccagatgtgacatccagatgacccagtctccatccctcctgtctgcatctgtaggacacagacgtcaccatccacgttcggcccgggcaaagtccagagcctaatttacgacctaacctttaattttaaaagttgggttaatacgtaaggganaaacgttaccgaaaggggaaaaccgtaccccccgtaaaacctccgtagtacttacctaagtcggtaatgtacacttcctacgttttacgaacgtaaacgggttccggggtaccctaagtaccgtaaaggttcgaggttacggactaggtgattcgagggactagtactttacgacttacgtacctaactagtaccaaggtacctaaggttacctacggaacctaacccgttaggtaacgtttaagttttccgaaacctttaacctttaacacgttacgtaccctaaaggttaacgtacgttaaccgtaacggttcccgaccccggttcgggtaaccggttcggaacccgtaaaggggtaacctaaaggggtacaaacgtaaccgtaaacgaacgttgtacggctaagaccctaacncgttctaccg

SEQ ID NO: 287707 - DNA, 770 bp, Homo sapiens
  misc_feature: GYAE6OF01BXU6S.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtcctccatccctccctgtctgctatctaggtacggacacagacgtaccaccatctacgttcggaccgggacaagtcagagtactaattacgactaacctttaagttttaaattggtaatacgaagggtaacgtaaacgtaccggaaaggggaaaccctaccccttaaacgtccgtagtacttacctaagtctatcgacctacttcctaagtttacggaacgtaacgggtccgggtaaccagttacggtaaacggttcgacgggttacggcgtaagggttacggtacgttcgggtaacgggtaactacggttactttaccgaccgtttaccaaccgtaaccctactaacccggtagtacccgttaacgttaccgtacgaacccgtaaacggttaggtaaactttacgttttaccggaacctttaaccgtttaaccttacgttaacgtaacctaacggtaacgttaaccgtttaacgtccggttacccgtaccccggttacgggtaaccgttcccgggaaacggtaccgggtaacggtaaagggtaaccgtaaacaaccggtaaacggcgttacgggtacgacttacggaacctacccgtatccgttacccg

SEQ ID NO: 287708 - DNA, 608 bp, Homo sapiens
  misc_feature: GYAE6OF01CQL8J.6.19.B08.1.454.CMB.1.raw
  modified_base (599)..(599): a, c, t, g, unknown or other
  misc_feature (599)..(599): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctcctgtctgctatctgtaggacacagtagtacaccatcacttcggccggacaagtcagagcattagctacctattaaatggtaatcgaaggtagaatccgaagggaaacgacccctaaaacgtccttagactctaatgatcgcagttcctactttcgaacgtaaacggtcgggtacccattacggaaaggttcaaggttggaacgagtaggtaatcgtagggtacagtattacactactaccgtacactcagtactagtactacgactaacccgtagtaaacgtatttacgacttaaacttactaacgtagttaaccaatacggtaagtaaccttaggtccgtacccgtggaccgttcggtaaccgaacggaacgaacggttacgtaaacgtacgaaaacgtacgtacgttaggcctaggacctaaccgngttcgtacg

SEQ ID NO: 287709 - DNA, 820 bp, Homo sapiens
  misc_feature: GYAE6OF01DMZFW.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatcgacccagtcctccactccctccctgtctgctatcgtgtacggaccacgagacgtccaacctatcctacgttcgggacccgggacaacggtcaaggacgactattaacgaccctaaacgtttaagttttaaacgtttggtaactacggaaggaacgtaaccgtaccggaaacggggaaacccctaccccgttaaacttccgtaagtacttacttagtagacgttcgacctaacttacccgttaacgtttacggaacggttaaacggggttccgggtaaccctaagtttaccggtaaacgggtttcgaacgggttcggacgtaacgggtcggtaacgttccgggtaggtaacgtacgtttaccttaccaccgtttacctaccgaacccttacgtacgaaaccggttcccgtaaggttaccgtaaccgtaacccgttaacgttaaggttaaccgttttacgtttaaccgaaccttttaactttaccgtaacgtaactaaccgtaacgtaacggttacccgtttaacgacccgggttccccgttaccccgggttaggtacccgggttaacccggaaccgggtaaaccgggaaccgtaaaagggtaacgtaaactaaccggtaaacggtaccgttggtaacccggtcacggtaccctactcgtttcgtacg

SEQ ID NO: 287710 - DNA, 657 bp, Homo sapiens
  misc_feature: GYAE6OF01DOJE9.6.19.B08.1.454.CMB.1.raw
tcagatatcgcgagcacgaccggtgctcgatttagtgagtcagtaagggggagtcagtctcagtcaggacacagcatggacatgagggtcccccgctcagctccgtggggcctcctgctactctggcctccggaggtgccagatgtgacatccagatgacccagtcctccactccctccctgtctgcatctgtaggacacagagtccaccatcacgttggccgggacaagtcagagctattacgctaaccttaatttaaagttggtatacgaaggagaacgtaccgaacgggaacctaccccttaaactcctagacttctagtgattcgactacttccctacgtttacgaacgtaacggtcggtaccacgttacgtaaggttcaggtggacgtaggtacggacttacggtacggaactagttacgttcaccttctaccaccgtatcgaacgtctcgtacacgactaacgtgtaagttactttacaaccttaactttactacgtacgtaacaacgtagttacgttaacgtccggtcccgtaccccggtacggtaccggtaccggtaaccggaacgggtaaaccgtaaggggtaaactaaaggtaacctaaacggtacgtggtaccgtaccgttacaccgtaccttcgttcggtttacc

SEQ ID NO: 287711 - DNA, 748 bp, Homo sapiens
  misc_feature: GYAE6OF01EO2J7.6.19.B08.1.454.CMB.1.raw
  modified_base (95)..(95): a, c, t, g, unknown or other
  misc_feature (95)..(95): n is a, c, g, or t
  modified_base (201)..(201): a, c, t, g, unknown or other
  misc_feature (201)..(201): n is a, c, g, or t
tcagatatcgcgagcacgaccggtgctcgatttagtgagtcagtaagggggagtcagtctcagtcaggacacagcatggacatgagggtccccgntcagctcctggggcctcctgctactctggctccgaggtgccagatgtgacatccagatcgacccagtcctccatccctccctgtctgcatcgtgtacggacacagngtaccaccatcacgttcggccggacaagtcgagagctattacgacaccttaattttaaagtgtactcgaaggtaagaacgtaccgaaggaaacccgtacccctaaactccgtagtaacttctaagttagactcggacctaacttacccgttaacgttttacggaacgtaaacgggttccggggtaacccctaacgttaccggttaaacgggtttcccggaagggttacgggtacgtaggggttacggacgtttaccgggtagggtaacgtaagtttacgtttaccctaccttaccttaccaaccgtatacgacgtcgtaagttccgtaacgaccctaacgttagttaaacgttacttttacgaacctttaacgtttaactactagtaacgaagtacggttaattaccgacggttccccgacccggttaccggaccggttacggaacccggtaaaccggggaacgttaaacgggtaacgaaaaccgttacggaaaacggttacgtgggtaacggtacctacggaaccttacctcggttccttacccgg

SEQ ID NO: 287712 - DNA, 777 bp, Homo sapiens
  misc_feature: GYAE6OF01C9VF5.6.19.B08.1.454.CMB.1.raw
  modified_base (179)..(179): a, c, t, g, unknown or other
  misc_feature (179)..(179): n is a, c, g, or t
  modified_base (231)..(231): a, c, t, g, unknown or other
  misc_feature (231)..(231): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctcgaggtgccagatgtgacatccagatcgacccagtcctccactccctccctgtcngcatctgtacggacacagactccaacatcacgttggccgggacaagtcaagngtactaagttacgactaaccgtttaatttaacgttaggtactacgaaggaacgtaacgtacccggaaagggtaaaccgtaacccccgttaaacctacccgtagtaacttaccgtagttacggaagttcgacctaacgttaccctaacgtttacgaaccggtaaacggtttaccggggtacccttagtaaccggtaacgggtttcgaggtttacgggacgtaagggtacggtaacgttcgggttaacggaacgttagttacgtttacaacccctttccgttaacctacccgtaataccgtaacgtaccgttacggttacgttaccgaacccgtttaacgttacggttaaaccgtttacgttttacgtaaacccgtttaaacctttaacgttaccgttaacggttaaaccaaacggttacgttaacgttaccgtacggttccccggtacccgtttacggtaacccggttaccgggtaccgaacgggtacggtaacggtaagaactaccgaaacgtacgtgacgtactacgacctcctagtccgttacg

SEQ ID NO: 287713 - DNA, 691 bp, Homo sapiens
  misc_feature: GYAE6OF01DZOUH.6.19.B08.1.454.CMB.1.raw
  modified_base (94)..(94): a, c, t, g, unknown or other
  misc_feature (94)..(94): n is a, c, g, or t
  modified_base (204)..(204): a, c, t, g, unknown or other
  misc_feature (204)..(204): n is a, c, g, or t
  modified_base (228)..(228): a, c, t, g, unknown or other
  misc_feature (228)..(228): n is a, c, g, or t
  modified_base (236)..(236): a, c, t, g, unknown or other
  misc_feature (236)..(236): n is a, c, g, or t
tcagatatcgcgagcacgaccggtgctcgatttagtgagtcagtaagggggagtcagtctcagtcaggacacagcatggacatgagggtccccntcagctccgtgggctcctgctactctggctccgaggtcgccagatgtgacactccagatcgacccagtcctccattccctcctgtctgctatcgtagtacggacacgagngtccaccatcacgttcgccggganaagtcagntactattagacctaacttaatttaagttggtaatacgaaggaagaactaccggaaagggtaaccctaaccccttaaactcctagtactttactacgtagtatcgtactacttaccctaaggtttacgaacgtaaacgggttccgggtaccctaagttaccgtaacggttcgaggttggacgttaaggtggtacgtcggtacgggaactaaggttactttaaccgaccttctaaccaacctacgtaacgacgtacctgtaccgtacgtaccgtaacgttaggtaacgtttatttaccgaacttaacgttaactacgtacgtaacaaccgttagtaacgttcgtaccggttccgtaccccggttaggtacgtacccggaaccggtacggtaacggaaggtaaacggaaactacggaaacgtacgtagaccgtagtcaaccggtacttcgtcttaccg

SEQ ID NO: 287714 - DNA, 611 bp, Homo sapiens
  misc_feature: GYAE6OF01DTJR0.6.19.B08.1.454.CMB.1.raw
  modified_base (225)..(225): a, c, t, g, unknown or other
  misc_feature (225)..(225): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctcatcctccctgtctgcatctgtaggacacagacgtcaccatctacttcgccgggacaagtcagngcattagctactaatttaatgtatcaggagaatcgaaggaacgtaccctaactcctagtatctatgatgactactcctaacttcgacgtaaacggtcggtaccagttacgtaaggttcacggtgagtaggtgtatcgtagggactagtacttcactctacacatcagtctagtctgacctaacgtagtaagtttactttcgaaccttaacttaccttaacgtcgtaaccaacgtacgtaacgttaccgtacggttcccgtacccggtagggtacccggttccggtaaccggaaacgggtaaccgtaaacgggtaacgtaaaacggtaacgaaaacccgttacgttacgggtacgtacgtacgacccgtaacgtcgttaccgttccg

SEQ ID NO: 287715 - DNA, 658 bp, Homo sapiens
  misc_feature: GYAE6OF01AP78L.6.19.B08.1.454.CMB.1.raw
  modified_base (149)..(149): a, c, t, g, unknown or other
  misc_feature (149)..(149): n is a, c, g, or t
  modified_base (241)..(241): a, c, t, g, unknown or other
  misc_feature (241)..(241): n is a, c, g, or t
  modified_base (407)..(407): a, c, t, g, unknown or other
  misc_feature (407)..(407): n is a, c, g, or t
  modified_base (607)..(607): a, c, t, g, unknown or other
  misc_feature (607)..(607): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccggaggtgccagtatgtagacntccagtatcgacccagtcctccatcctccctgtctgctatctgtacggacacagacgtctacactctacgttggccggataagtacaggacnctaagttacgaccttaccgttaatttaagttaggtaatccgaaggactaacgtaccgtaacgggaaacctaccccgttaaactccgttagacttacgaggttccatcgactacgttcctaacgtttcgaacgtaacggttccgggtaaccagttacgtaacggttnaggttacgacgtaggtcggaacgtttgaacggtactagtacttccggaccttcaccgtactactccgagtcaggttacagtaccacgttagactttggtacaatacgtttaactgacttacaacgttagtaccgtacgtaccggtcgacccgttaggtaaccgttcgggaaccgtaacgggtacgtaacggttacgaaanaccggtaaacgtcgtgtacgggtcctaccgacgacttccgttaacgttccg

SEQ ID NO: 287716 - DNA, 705 bp, Homo sapiens
  misc_feature: GYAE6OF01BE375.6.19.B08.1.454.CMB.1.raw
  modified_base (690)..(690): a, c, t, g, unknown or other
  misc_feature (690)..(690): n is a, c, g, or t
  modified_base (695)..(695): a, c, t, g, unknown or other
  misc_feature (695)..(695): n is a, c, g, or t
tcagatatcgcgagcacgaccggtgctcgatttagtgagtcagtaagggggagtcagtctcagtcaggacacagcatggacatggacgggtccccgctcagctccgtggggctcctgctactctggctccggaggtcgccagatgtgaccatccgagactcgaccctagtcctccactccctccctgtctgacctatcgtaggacggacacgagtcgcaccatcgacgttggccgggtacaagtcaaggactactaacgttacgcctaaactttaatttttaaagttcgggtaattaccggaaggggtaacgtaacgtaacccgggtaaaggggaaaccctaacccctttaaaacgtccgtagtacttaccgtatggattcgaccttatacccgttacgtttagaacggttaaacgggccgggttacccagttaaccggtaacggtttcgaacgggttcgacgaacggtgggtaactaccggtaagggtaccgtacttaacgttcctaccttactaaccgtactacgacgtacgtaccgtacgtactcggtaaccctacgttaacggtacgttaacgtttactaaccgtaactttacgtaactagtaacaacgtacgtaacgtcgtacgcgtacccgtcgaccgtggaaccgacgtaaccgaggtaagaagtacgaagccgagcgtacgngaccnctagtcgtac

SEQ ID NO: 287717 - DNA, 834 bp, Homo sapiens
  misc_feature: GYAE6OF01AXYG2.6.19.B08.1.454.CMB.1.raw
  modified_base (367)..(367): a, c, t, g, unknown or other
  misc_feature (367)..(367): n is a, c, g, or t
tcagatatcgcgagcacgaccggtgctcgatttagtgagtcagtaagggggagtcagtctcagtcaggacacagcatggacatgagggtccccgctcagctcctggggcctcctgctactctggctccgaggtgccagatgtgacatccagatcgacccagtctccactccctcctgtctgctactcgtagtacggacacgagacgtaccacctattccgacgttaccggcccgggactaaagtccgaaggtacgtaccgtaattacgaccttaacctttaaagttttaaagttggtaactacggaaggtaacgtaactaccggaacgggaaacccgtaccctaaacgtccgtagtactacttaagngtaactcggtactacgttacccttacgttaacggaacgttaaacggtccgggtacccttaaagtaaccggtaacgggtttcgaacgggtacggtaccggtaagggttacgtaccgttacggtttacgggaacctaaaggtttactttacccgtacctacctaccgtaccttaacgtaccgtactacgtacgttacccgtaacgaacccgttaaaccgttaggtaaactttaccgttacggtaaccctttaaccgtttaacttaccgttagttaaacccaagtaaccggttaacgtaaacggtcccggtcgttaaccccggtacgggtaaccccggtttacgggaaacccggtaaacgggtaaccgggtaacggtaacggtaaaccgggttaaaccgaaaccggttaacggttacgggtaaccggttccttaacgggtaccccttaaccgggtattccgttaacccgg

SEQ ID NO: 287718 - DNA, 747 bp, Homo sapiens
  misc_feature: GYAE6OF01BD7K1.6.19.B08.1.454.CMB.1.raw
tcagatatcgcgagcacgaccggtgctcgatttagtgagtcagtaagggggagtcagtctcagtcaggacacagcatggacatgacgggtccccgctcagctccgtggggctcctgctactctggctccgaggtcgccagatgtgacatccagactcgacccagtctccactccctcctgtctgcatcgtgtagacagagagtccaccatcacgttcggccggacagtcagagctattacgacctaaccttaagttttaaagttggtatacgaaggaagtaacgtaccggaaagggtaaacccgtacccctaaacgtccgtagtacttctagtgtactcgacctactacccgttaacgttcggaaccgtaacgggttccgggtaccctaagtacgttaaacgggttcgtaggtcggacgtaggtacggacgttcggtacggactacgttactttccgaccttctaccgtaacctacgtacgacggtcctacgttacgtaccgtacccttaacggtagtaaacggtttacgttttacgaaccctttaacgtttaacctaccgtttaacgtaaccgtaacgtaacgtttaccgtaccggtaccgttaccccgtaccccggttacgggtacccggtacggaacccggtaaacggggtaacccgttaaaggggtaaaccgtaaaccgttaaccggtaaaccggttacggtacggtacggtactaccggaacctccgttacgtcgtttaccg

SEQ ID NO: 287719 - DNA, 600 bp, Homo sapiens
  misc_feature: GYAE6OF01CSU22.6.19.B08.1.454.CMB.1.raw
  modified_base (94)..(94): a, c, t, g, unknown or other
  misc_feature (94)..(94): n is a, c, g, or t
  modified_base (226)..(226): a, c, t, g, unknown or other
  misc_feature (226)..(226): n is a, c, g, or t
  modified_base (234)..(234): a, c, t, g, unknown or other
  misc_feature (234)..(234): n is a, c, g, or t
  modified_base (262)..(262): a, c, t, g, unknown or other
  misc_feature (262)..(262): n is a, c, g, or t
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (352)..(352): a, c, t, g, unknown or other
  misc_feature (352)..(352): n is a, c, g, or t
tcagatatcgcgagcacgaccggtgctcgatttagtgagtcagtaagggggagtcagtctcagtcaggacacagcatggacatgagggtccccntcagctccgtgggcctcctgctactctggcctccggaggtcgccagatgtgacatccagatcgacccagtcctccatccctcctgtctgctatctggaggacagagacgtccacgtatcacgttggccgganaagtcagnctatacgctacttattaatgatcgaganatacgaggaaccaccctaancctnactntagtgatcgctactctacgttgacgtaaggtcgtaccatacgtaaggtcagtcggcgtaggngtacgtcgtacggactaagtttcgtttaccactacctacactatacggatacgtacgttacacgtaccgtagtaacgttagtttacgtactaccgttaacttacgtacgttacgaacgtaagttacgtaaccgttcgtacgtccccgtaacgggtcggtaaccgtaccgggaaacgtacgggtaacgtaaggtacgtaacgtaaacgacggtagtcggtctacgtaccgactacgttagtcgttaccg

SEQ ID NO: 287720 - DNA, 760 bp, Homo sapiens
  misc_feature: GYAE6OF01CG3YI.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctcctgctactctggctccggaggtgccagatgtgacatccagatcgacccagtcctccactccctcctgtctgctatcgtgtaggacacgagacgtcaccatccacgttcggccgggacaagtcgagagacattacgcctaaccttaattttaaaagttggtatacgaaggaagaactaccgaagggtaaaccgacccccttaaacctccgtagtacttactagtgtactcgactacttaccctacgtttacgaacgtaaacggtcgggttacccctagttaccgtaacgggtttacgaggtcggacgtaggtacggtacgtcggtagggtaactagttacgtttaccaccttccgtacccaacgtacgtacgaacgtctaagttccgtaccgacgtaacccgtaggtaaacgtttacgttttacggaaccctttaacgtttaacttaaccgttcgaaccttaaacggtacgttaacgtttacgtccggttaccccgttaccccggtacgggttaccccggttaacgggaccgggtaaaccgggtaaaccggtaggggttaaaaccggaaacttaaaccggtaaaccgggtaacgtttacgggaccggttaaccgtacgtaaccccgaccttacgttccgtttaacccgg

SEQ ID NO: 287721 - DNA, 686 bp, Homo sapiens
  misc_feature: GYAE6OF01B71DF.6.19.B08.1.454.CMB.1.raw
  modified_base (95)..(95): a, c, t, g, unknown or other
  misc_feature (95)..(95): n is a, c, g, or t
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
tcagatatcgcgagcacgaccggtgctcgatttagtgagtcagtaagggggagtcagtctcagtcaggacacagcatggacatgagggtccccgntcagctccgtgggctcctgctactctggctccgaggtgccagatgtgacatccagatcgacccagtcctccatccctcctgtctgctatcgtggtagacacgagacgtccaccatccacgttcggcccggganaagtcaaganctaatacgactaaccttaagtttaattggtatcgaaggagaacgtaccgaaggggtaaaccctaccccttaaacgtccgtagtacttactagtagactcgtacctacttccgttaacttcggaacgttaacggtcgggtacctagtacggtaaggtcaggtgtacgtaggtagtactcggtaggaactacggttattccactcctaccaacgtcacgtagtccgtacgtcgacgtaccgtaacttaggtaacgttactttaacgaccttaacgtttaacgtacgttacgtaaccgtaaacgtacgtaaccgtttaacgccggttcccgtacccggttacggtacccggttaccgaacgggtaaaccggtaacggtaacgggtaactaaacccggtacgtaaaccggttcgtaggtacgtcgaaccggactaaccggtgttcgtacccg

SEQ ID NO: 287722 - DNA, 675 bp, Homo sapiens
  misc_feature: GYAE6OF01C0QQL.6.19.B08.1.454.CMB.1.raw
  modified_base (194)..(194): a, c, t, g, unknown or other
  misc_feature (194)..(194): n is a, c, g, or t
tcagatatcgcgagcacgaccggtgctcgatttagtgagtcagtaaggggggagtcagtctcagtcaggacacagcatggacatgacgggtccccgctcacgctccgtcggggctcctgctactctggctccgaggtgcagtatgtgacatccgagactacgacccacgtcctccacttccctcccttgtcgtnactactcgttagacggacacgacgactaccacctatcctacggttcggccggactaacgtcgagacgactaactacgtactaacttttaatttaaaggttgtactacgaacggacgtaacgtaccggaaacggaaacccgtacccttaaactccgttaagacttacgtatcggtactcgctacttacttacgtacgtaacggtacgggtcgtacctacgtacgtagttacggcgttcggactggtacggtacgttaggacggtactagttctaccgactcctacgactacgtacacgtactacgtataacgtacctacgtagtacgttactactacttacgtactacgtacgtacctaagtacggtagtactcggtaccgtaccggtacggtaccgtacccgggtaaggaaaccggtaacggtaaggtaacgtaagtaacccgaagtcggtacgtctacgtacgactacctcgtacttccg

SEQ ID NO: 287723 - DNA, 1083 bp, Homo sapiens
  misc_feature: GYAE6OF01D2UBQ.6.19.B08.1.454.CMB.1.raw
  modified_base (94)..(94): a, c, t, g, unknown or other
  misc_feature (94)..(94): n is a, c, g, or t
tcagatatcgcgagcacgaccggtgctcgatttagtgagtcagtaagggggagtcagtctcagtcaggacacagcatggacatgagggtccccntcagctccgtggggctcctgctactctggctccggaggtgccagatgtgacatccagatcgacccagtcctccacttccctccctgtctcgcatcgtaggtacggaccacgaaggtacgtaccaacccgtattccgtaaccgtttcgggaccccggggaactaaacggtaccaagggacgtacctaacgtttaacgaccctttaaacccgtttaaagttttttaaaaacgtttgggttaaactaccggtaaagggtaaagtaaaccgttaacccggaaacgggggaaaaacccctaacccccccgtttaaaaaccgttccccggtttaaggttaacctttaaccgttaacgttagggtaacttacggaccttaacctttaccccgtttaaccgttttacggaaaccgggttaaaacggggttccggggttaaccccttaacggttaccggttaaaacgggtttccggtaacggggttagggtaccgtaaggggtttacgtaacggttaccgggttacgggggtaaccgttaacgtttaacgttttacccgttaaccgtttacccttaaccccgtaaaacccttaccgtttaacccggtaaacgttaacccgttacgttacccggtaaccgtaaaccccgttaaacccgtttaaggtttaaccggttttacgttttttacccggaacccttttaaaacccgtttttaaccgtttaaacgttacccggttaaaccttaaaaccggttaacgggtttaacccggtttaaacccggttacccgttaccccggggttaaccccccggttaccgggggtttaaccgggttaacccccggggtaaaaccggttaaacccgggggggaaaacccgttaaacgggggtttaaaaaccggtaaacccgttaaaccgggtaaaaaacccggttaccgggttacggggtccggttaacccggtaccggtaacccgtaacctttccggttaccgtttacccg

SEQ ID NO: 287724 - DNA, 809 bp, Homo sapiens
  misc_feature: GYAE6OF01B03MC.6.19.B08.1.454.CMB.1.raw
tcagatatcgcgagcacgaccggtgctcgatttagtgagtcagtaagggggagtcagtctcagtcaggacacagcatggacatggacgggtccccgctcagctccgtgggctcctgctactctggctccggaggtcgccagatgtacgactactccgagatcgaccctagtccctcctactccctccctgtcctgactattcgtaggtacggaccaacgtacggtaacgtccaacctactaccgtaaccggttcgggacccggggtactaacggtacaaggtacgacgttaacgttacgacccttaaccttttaaagtttttaaacggttcggtaactacgaaaggggtaacgtaaaccgtaacccgggaaacgggtaaacccgtacccctaaaccgtccgtagtactacgtagtagctcgtactacttaccctgttacgacgtagggtccgacctagtacgtaacgtcgaggtcgtacgtaggttgacgtacggtacggtaactcgttacttcctactcctacctaacgtcacgtacggtctacggtacttacggaaccgttaacgttaagtaacgtttacttaaccgtaaccgtttaaacttacgtaccgtacgtaacgtaacttaggtaaccgttaccgttaaccggttccccggttaccccggtagggttaaccccggtaacgggtaacccggtaaacgggtaacccggtaaacgggtaacgtaaaccccgttaaacggtaaccgggttacgacggttaccgtaccggttcggaaacccctttcgggttacttccggtttaaacc

SEQ ID NO: 287725 - DNA, 769 bp, Homo sapiens
  misc_feature: GYAE6OF01DUB6E.6.19.B08.1.454.CMB.1.raw
  modified_base (94)..(94): a, c, t, g, unknown or other
  misc_feature (94)..(94): n is a, c, g, or t
tcagatatcgcgagcacgaccggtgctcgatttagtgagtcagtaagggggagtcagtctcagtcaggacacagcatggacatgacggtccccntcagctcctggggctcctgctactctggcctccggaggtcgccagatgtacgactactaccgaagactccgaaccctgtcctcctacttccctcccgtgttcacgtactattcgtaggtaacgacctacgaggacgtacccactacgtcctacggttccgggaccggtaactaagtacgaagacgtactaagtaccaccttaaactttaagtttaagttcggtaactacgaaggtaacgaacctaccggaaacggtaaaccctacccctaaactccgtaagtacgttactagtagtacgtacgtcctactaccgttagttaacgaacgggtaacggtccggtacctaacggtaacggttagtacggtacggtcggaacgtaggttcgtacgtcggtacggtaacgtaacgttacttaccgtacgtccttaacccgactacgtaccggcgtacgttaccgtacgtactaacccggtacgttaagtaacggttttacttaacgaacccgtttaacttacgtagtaactaacgtaaccgtagttacgtacgccggttcccgtaaccggtccgggtacgttacccggaacggtaacggtaacggtaagtaaacggtaaacctaagggtaaccaacgggtgtacccgtacgtaacctcccttaaagtccgtttacgtccc

SEQ ID NO: 287726 - DNA, 891 bp, Homo sapiens
  misc_feature: GYAE6OF01CSCVQ.6.19.B08.1.454.CMB.1.raw
tcagatatcgcgagcacgaccggtgctcgatttagtgagtcagtaagggggagtcagtctcagtcaggacacagcatggacatgagggtccccgctcagcctccgtggggctcctgctactctggctccggaggtgccagatgtgacactccagactcgaccctagtcctccactccctccctgtctgcatctgtacgacacagacgtcacatcacgttcggccgggacaagtcagagtcattacgctacctttaagttaaagttggtaatacgaaggaagtacgtacgaacgggtaaacccgtaccccttaaaacctccgttaagcttacctaagttacgtatacgtcctaacttacccgttactttcggaacgtaaacgggttcgggtaccctaacgttacggtaacgggttacgacggttacgggtacgtacgggtacggttaaccggtcggtaacggggaacgttacgtttactttaccgtacccttaccgttaacccaaccgtacgttacccgaaggtaccccgttaaggtcccgttaaacgtacccttaaaccgggttaagggttaaaccgttttacgttttaaccggaaccctttaaaccttttaccggttaaccgttaacggttaaaccaaaccgggtttacgttaaaccgggttccgtaaacccgggttccccggtaacccccgggttacgggggtttaacccggttaacccccggggtaaaccggggtaaacccgggggttaacggtaaaacgggggtttaaacccggtaaaaccggtttaaaacccggtaaccgggtttaaaacccggtggggtttaacccgacgggttaaacccccgggtgttaaaacccccttcccggggtttattttaacccccggg

SEQ ID NO: 287727 - DNA, 854 bp, Homo sapiens
  misc_feature: GYAE6OF01B33TG.6.19.B08.1.454.CMB.1.raw
  modified_base (95)..(95): a, c, t, g, unknown or other
  misc_feature (95)..(95): n is a, c, g, or t
tcagatatcgcgagcacgaccggtgctcgatttagtgagtcagtaagggggagtcagtctcagtcaggacacagcatggacatgagggtccccgntcagctccgtgggctcctgctactctggctccgaggtgccagatgtcgacatccagatcgacccagtcctccatccctcctgtctgctatcgtagtacggacacgagacgtccaacctagtcctacgttcggaccgggactaagtccgaggacgactagttacgactaacctttaattttaaagttggtaacttacgaaggtaactaacgtaccggaaacggggtaaacctacccccgttaaacgtccgttagtacttacgtagtacgacgttacgactaaccgttacctaacgttttacggaaccggttaaacgggttcccggggtaaccctaggttaaccgggtaaacgggtttcgtaaggggttacggtaccggttagggttacggtaacggttaccggttacggggaacttaaggtttaaccgttttaccgtacccgttaccgttaaccgaccctttaacgtaccggacgttaacccgttaccggttacgtacccgtaaacccgttaaccggttaggttaaacttttacgttttaccggtaaaccctttaaacgttaacccttacgttaacgtaacctaacggttaaccggtaacgtttaaccggttaccggtccccggtaccccggttacgggtacccggttacccgggtaaccgggaaacgggtaaaccgttaaggggtaaaccgttaaaccgtaacggttaaaaccgtcggttaggtaccgtaccgttacgaaccgtactccgttcgtaccg

SEQ ID NO: 287728 - DNA, 802 bp, Homo sapiens
  misc_feature: GYAE6OF01A14LH.6.19.B08.1.454.CMB.1.raw
  modified_base (603)..(603): a, c, t, g, unknown or other
  misc_feature (603)..(603): n is a, c, g, or t
tcagatatcgcgagcacgaccggtgctcgatttagtgagtcagtaagggggagtcagtctcagtcaggacacagcatggacatgagggtccccgctcagctcgtgggctcctgctactctggcctccggaggtgccagatggtcgactactccaggtataccgaccctagtccctcctaccttcccctcccgttgttcctcgactacgttcgtggtaacggacctagacgtacgacctacccattacctacggttccgggacccggggtacctaaggtaccgacggaactaccgttaattaaccggtaccttaaacccgttttaaaagtttttaaaacggtttagttaacggtaccggtaaaacgggtaacgttaaacccgttaacccggggaaaaccgggtaaaacccccggttaccccccttaaaaaccgttccttaacggtaccttaacgttagtacgtaacgttacgaccttaccgttaccttagttacgtaaccggtacgggtaccggttaccgaacgtcgtaagggtaccgaggtcgacgtaggcgtagtacggaggtaactagttacttactaccgttactacgaacctcacgtanacttcgtcgtacactacgtacgtaattacgtcctaactacttacgtaactacgtaactaacgtagttaaccgttaacggccttaccggtaccggtacgttacccggtacgaccgggtaaaccgtaacggtaaaggtaccgtaaagtaacggttaacgaacgttcggtaccgttcgaacctgaccttaccgtgttacccg

SEQ ID NO: 287729 - DNA, 742 bp, Homo sapiens
  misc_feature: GYAE6OF01DDA3Q.6.19.B08.1.454.CMB.1.raw
  modified_base (97)..(97): a, c, t, g, unknown or other
  misc_feature (97)..(97): n is a, c, g, or t
  modified_base (123)..(123): a, c, t, g, unknown or other
  misc_feature (123)..(123): n is a, c, g, or t
tcagatatcgcgagcacgaccggtgctcgatttagtgagtcagtaagggggagtcagtctcagtcaggacacagcatggacatggacgggtccccgntcagctccgtgggctcctgctactcnggctccggaggtcgaccagatgtgacatccagatcgacccagtcctccactccctccctgtctcgactactcgtacggtacggaccacgaacgtacgtcccaacctacttacctacgtttccgggaccggggtacctaaaggttcaacggacgtactaacgtttaacgaccttaaaccgttttaagttttaaaacggtttcggttaacgttaccggaaagggtaaacgtaaaccgttaaccggaaaacggggtaaaccccgtaacccccttaaaacgtccgtagtaacgtactaagtacgtacgtcgaccttactccgtaacgtttacgaaccgtaacggtcgggtacctactacgaagttcgagtacgtagtacggtgtacgtcggtagggtaactaacgtttacgtacctaaccgtcctaaccgtaccctagtaccacgtactcgtactacgacccgttaagtagtaacgtttacttcgtaacttacttacttactaacgtacaacgtagtacgttacacgtacccgtccgtacgtaccggtacgtaaccgagggtaactaagggaactaacgtacgaaacggtacgtggacgactaccgctaacgtgttcttaccg

SEQ ID NO: 287730 - DNA, 838 bp, Homo sapiens
  misc_feature: GYAE6OF01AQDK8.6.19.B08.1.454.CMB.1.raw
  modified_base (401)..(401): a, c, t, g, unknown or other
  misc_feature (401)..(401): n is a, c, g, or t
tcagatatcgcgagcacgaccggtgctcgatttagtgagtcagtaagggggagtcagtctcagtcaggacacagcatggacatggagggtccccgctcagctccgtggggctcctgctactctggctccggaggtgccagatgtcgacatccaagatcgacccagtcctccactccctcctgtctgctacttcgtagtacggacacgagtacgtaccacctacgttccaccgttcgggaccccggggtactaacggtccgaaggtacgtaacgtaacgtttaacgacccttaaaccttttaagttttaaaacgttcggggtaactacggaaaggtaacgtaacggtacccggaaacggggtaaacccctacccccttaaactccgtagtacttacgttagngtactcgacctactaccttagttcgaacgtaacggtccggtacctagtacgtaacggttcgaggtcggacgtaggtacgtacgttacggacgggtaactactttacgttccgacttacctaccgtaacctacgtacgtacgtacgtaccgtccgtaacggaacccgtaacgttaaggttaactttaaccgtttacgtaaaccgtttaccctaacgttaaccgttaacgtaaccgttaaacggtacgtttaaaccggttacccgttaccgggttcccggtaacccccgggtaccggttccccgggttaaaccggaaacccggggttaaaccggtaaaccgggtaacgggttaaaccgtaaaccggtaaccgttaaaacggtcccgttaaggtcccgttaaccgccgaaacccttccggttaaccgttcgttaacccgg

SEQ ID NO: 287731 - DNA, 802 bp, Homo sapiens
  misc_feature: GYAE6OF01B7YWR.6.19.B08.1.454.CMB.1.raw
tcagatatcgcgagcacgaccggtgctcgatttagtgagtcagtaagggggagtcagtctcagtcaggacacagcatggacatgagggtcccccgctcagctccgtggggctcctgctactctggctccggaggtgccagatgtgacatccagatcgacccagtcctccactccctccctgtctgctatctgtacgacacagacgtccaacctatacctaccgttcggcccgggactaagtcgaggagactattacgacctaacctttaaattttaaagtttggtaactacgaaggaacgtaacgtaccggaacgggaaacctacccctaaacctcctagtactactatagtactcgacctactacctagtttacgacgtaacgggttccgggtacctagtacgtaacgttcgaggtcgcgtaggtggtagtacggtaggaacgtacgttactttaccaccttcctaccgtacctacgtacacgtctacgttccgtacgtaaccgtaaccgttagtaaacgtttcgtttaaccgacctttaaacctttacgtaacctttaacgtaacctaaacggttaacggttaaccgttacgtaccccgggttacccgtaaccccccgggtttacggggtaaacccggttaccccggggtaaaccggaaaacccgggtaaaccggggtaaacggtttaaaccgggtaaaaccccgttaaaccgggaaaacccgtttaccggttaggggtaacccgggttacccgtaaacccggtaccctaaccggtttccggtttaaccctttacccggg

SEQ ID NO: 287732 - DNA, 865 bp, Homo sapiens
  misc_feature: GYAE6OF01E185A.6.19.B08.1.454.CMB.1.raw
tcagatatcgcgagcacgaccggtgctcgatttagtgagtcagtaagggggagtcagtctcagtcaggacacagcatggacatggacgggtcccccgctcagctccgtggggctcctgctactctggcctccggagggtcgccagtatgtggaccactacccaagtatcggaaccccagtcctcccacttcccgtcccttgtctgaccatccgtgtaacggacaacgagacgtcaccatcacgtcgccggacagtcgagacgctacttacgaccaaccttaagttttaaaacgtttggtaacgttaccgaagggaacgtaaaccgtacccggaaacggggtaaaaccccgtacccccttaaaaaccgttcccgtacggtaacttaccgtaagtagtaacgttcggacctaacgtaccccttaaaccgtttacggaaaccggtaaaacgggttaccgggggtacccctaaacgttaccgtaaacgggtttaccgtaaggttacggggaacttacgggtacggacgttacgggtagggggtaacctaacggttactttaccctacctacctacccgtaaccacgttaacgaaccgtcgtaaccggttaccgtacgtaaacccgtaaccgaacgttaaacgtttacttttaaccggaaccctttaaccgtttaacctacgtttaaccgaaccgtaaaacggagttaaccggtttaaaccgtcgttaccccggtccccggttaggaacccgggtttaccggaacccgggtaaaccgggaacctaaacggggtaagtaaacccaaacggtaaaccgggtaacgtacggttaccggaccgtacgaaccccgtaccgtacttacggttaccg

SEQ ID NO: 287733 - DNA, 624 bp, Homo sapiens
  misc_feature: GYAE6OF01AIN9J.6.19.B08.1.454.CMB.1.raw
  modified_base (272)..(272): a, c, t, g, unknown or other
  misc_feature (272)..(272): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcaccttatttaaattggtatcaggagaatccgaagggaaacncccctaaaactcctgactctatgatgcatccactttgacgtaaaggtcgggtcccatcgaaggttcagtggcagtggatcgtagggactagtatttcacttctacacctatcagcagtctcgactaacctgaacttcttttacgaccttaaactttactaaccttacgtacctaaacgtagtaacgtttaaccgacggttcccgtacccccgttacgggtaccggtttaccgggaacccggtaaacggggtaacccgtaaaggggttaacggtaaaacgtaacccgtaaaaccggtaaacgttagggttacgggtaccttaccggtaccgaacccgtagttccgtttaccgg

SEQ ID NO: 287734 - DNA, 909 bp, Homo sapiens
  misc_feature: GYAE6OF01BX1PJ.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctcctgctactctggctccggaggtgccagatgtgacatccagatgacccagtcctccatccctccctgtctgctatctggtaggacagtagacgtaccaacccattcctaccgttcgggacccggggtactaaacgggttacaaggacgtaccgtaagtttaacggaccctaaacccttttaaagtttttaaaacgtttgggttaacttacggaaaggggtaaacgtaaacgttacccggaaaacgggggtaaaacccctacccccgttaaaacctcccgttaagtacttaccgttagttagtaacgttcgtacctaactttacccgttaacgttttacggaaaccgttaaacggggtttccggggttaacccctaacgttaccggtaaacggggtttcccggaaggttacgggacggttaagggttaggtaacgttccgggttacggggtaaactacgggtttaaccttttaccgaacctttaccgttaaccctaccctaacgtaccgtacggtacccgtaacggttccgtaccgtaaccccgttaaccggtagttaaacgtttcgttttaacctaacctttaaccctttaacgttaaccgttacgtaacctaaacgtacggttaaaccgtttacggtaccggttaccccggtccccgttaacgggtaccgggttaacccggaaccgggaaacgggtaaccgggtaaacggggtaaacgtaaacggtaaaccgtaaacggtacggttacgggtcggtaaccgttcgaaccccgttacgttaccgttccgtttaacccg

SEQ ID NO: 287735 - DNA, 894 bp, Homo sapiens
  misc_feature: GYAE6OF01EK1WV.6.19.B08.1.454.CMB.1.raw
  modified_base (224)..(224): a, c, t, g, unknown or other
  misc_feature (224)..(224): n is a, c, g, or t
tcagatatcgcgagcacgaccggtgctcgatttagtgagtcagtaagggggagtcagtctcagtcaggacacagcatggacatgacgggtccccgctcagcctccgtggggtcctcctgctactcgtggctaccgaggttcgccaggattgtagacatccgagtactacgaccctagtcctacccagttcccctccctgtcctagcacttcgtagaaggaccanagactaccacctatcctacgttcgggaccgggactaacggtacaacgacgcttaacgttacgaacctaaccgtttaatttaaaagttacgtactacgaaagtacgaacgtacccgaacggaacctaccccgtaacgtacctagtactactaagttcgtaagtcgtacctactacccgttacgtttaacggccgtttaaacgggtcccggtacgtaaaccgttacggtaacggtccgttaggtacgggacgtacgggtagtaccggtagacgggtaactacggttaactttacgtaccctttagacccctaactacgacgtaccgtactacgtacggacctaaacgtaaccgtagttaaccgttaacgtttacgtaacccttaacgtttaaccgtaaccgttaacgtaccgtaacgttaaaccgggtacgtttaaccccggtacggttacccccggttaaccccgggttaacccggggttaacccggtaacccccgggttaaaccgggtaaaacccgggggttaacccgtaaaccgggggtaaaccgtaaaaaaccggttaaaacccgtaaaccggggtttaaccccaaacccggggttccgggtaaacccgttaaacccggaaccccgtttaacccgggttaacccggttcccggttttaaacccccggg

SEQ ID NO: 287736 - DNA, 698 bp, Homo sapiens
  misc_feature: GYAE6OF01A0B2B.6.19.B08.1.454.CMB.1.raw
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (462)..(462): a, c, t, g, unknown or other
  misc_feature (462)..(462): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccggaggtgccagatgtgacatccagatcgaccagtcctccactcctccctgtctgcatctgtaggacacagacgtccaccatacactggccggganaagtcaggacnctatacgcctaacttaatttaaatggtatcgaggtacgaataccgaggaaaccgacccctaaacgtcctagtactactatgatcgactactcctacgtttcgaacgtaaacggttccggggtacctaagtaccgtaaacggttcgaaggtcggacggtaggttaggacggtttacggtagggtaaccttacggttacctttaccgtaacctttccgtacctaaaccgtntaaccgcgtacgtaccgttcgtaacgaccctaacgttagtaaacgtttatttacgtacccgttaaactttcctaagtacgttaacctaacgaggttaaccttacgtccggtacccgtacccgtacgggtacccggtacgggaacccgtagggtaaacccgaaagggtaccgtaaaggttacccgaaacgtacggtacggtacggtaccgttagacctacgttacggttctaaccgg

SEQ ID NO: 287737 - DNA, 783 bp, Homo sapiens
  misc_feature: GYAE6OF01BRB0N.6.19.B08.1.454.CMB.1.raw
  modified_base (245)..(245): a, c, t, g, unknown or other
  misc_feature (245)..(245): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccggaggtgccaggatgtgacatccagatcgaccctagtctccactccctcctgtctgctatcgtggtagactacgagtacgtaccacgatcctacgttcggccggaactagtacaagngactagttacgaccttaacgttaattttaagttggtactacgaaggtaacgtaactaccggaaacgggtaaaccctaccccttaaacgtccgtagtacttactaagtagtactcgactacgttaccttagttacgaacgtaacgggtccggtacctagtaaccgtaggtcgaggtagtcgtaggttcgacgttcggaggtacgtaattaccgttacaccttacctaccgactagtaaccgtacggtacgtacgtacgtaaccgtaacctaacgttacgttaagttacgtttaactaaccgttaaactttacgtaaccgtacgtaaaccgtaacggttaacgtacggtttacccgtagggtacccccgttaccccgggtacggttaccggtaccggtaaacccggggttacggaaacccggtttaaaacggaaccggttaaaacggttaaaccccggttaaagggttaaccggttacgggttacccggtaacgttacccgaacccgtttaaacgtccgtttaacccggtttaaacccgg

SEQ ID NO: 287738 - DNA, 721 bp, Homo sapiens
  misc_feature: GYAE6OF01A1NTC.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccggaggtgccagatgtgacactccagatcgacccagtctccactccctccctgtctgctatctgtacggacacagacgtcaccatcacttcggccgggcaagtcagagctagttagacctaccttaatttaaacttggtatacgaaggagaacgtaccgaagggaaacctacccctaactcctagactctagtgatcgactactaccttacgttacgacgtaaacgggtcgggtaccctagttaccgtaacggttcgtaggtggacgtaggtacgtacgtacggtacgggaactacggttacttttaccgacccgtttaccacctaaccgttactacccgtaacgtacccgtacggttactaccggtaaccctaaacccggtttaggttaaacgttttacgttttaaccgtaaccctttaaaccgtttaccgttaccttaacggtaacctaaacgtacgttaacgtaccgtaccggtacccgtaccccggttacggttacccggtcggtaaccggtaacggtaaccgtaagggtaacgtaacgtaaccgtaaacggtacgttcgacggtctacggtacctacgtgttccgttacg

SEQ ID NO: 287739 - DNA, 729 bp, Homo sapiens
  misc_feature: GYAE6OF01EXHBZ.6.19.B08.1.454.CMB.1.raw
tcagatatcgcgagcacgaccggtgctcgatttagtgagtcagtaagggggagtcagtctcagtcaggacacagcatggacatgacgggtccccgctcagctccgtggggcctcctgctactctggctccgaggtgccagatgtgacatccagatcgacccagtcctccactccctcctgtctgactatctggtacggacagagacgtccacctatcctacgttcggaccgggacaagtcagacgtactaagttacgacctaacctttaatttaaacgttggtactacgaaggtaacgtaaacgtaccgggaaacggggtaaaccctacccccgttaaacgtcccgttagtacttaccgtaagtcggtatccgactacttacccgtacgtttacgacggtaaaggttccgggtaccctaaggtaccgtaagggttcgaggtcggcgtaagggtcgtacgttcggacggtattacgtactttacacctttccgacctacatacgcgactacggtctacgtaacgtaacggtatacgtttacgtttacaaccttaaacgtttaccgacgttaagtaccgtaacgtacggtagttacccgtacggtaccccgtcccggtacggttacccggtaacggaccggtaaacgggacgtaaaacgggtacgtaaacgaaccggtaaacggtcgttccgggtaagtaccggtacgaaccttccaggttcttaacccgg

SEQ ID NO: 287740 - DNA, 820 bp, Homo sapiens
  misc_feature: GYAE6OF01D74MR.6.19.B08.1.454.CMB.1.raw
  modified_base (95)..(95): a, c, t, g, unknown or other
  misc_feature (95)..(95): n is a, c, g, or t
  modified_base (811)..(811): a, c, t, g, unknown or other
  misc_feature (811)..(811): n is a, c, g, or t
tcagatatcgcgagcacgaccggtgctcgatttagtgagtcagtaagggggagtcagtctcagtcaggacacagcatggacatgacgggtccccntcagctccgtgggcctcctgctactctggcctccggaggtcgaccagtagttcgtacgactattcccgaagtattccgaaccctagttcctaccctacttccctcccgttgttcctgcctaattcgtacgtaaggaccaacgaacgtacgtaccaccctattaccgtaccgttcgggacccgggtactaacgtcgaacggtacgtacctaagtttaacgaccctttaaactttaacgtttttaaaggtcggttactacggaaaggaactaacgtacggaaacggggtaaacccttacccctaaccgtctaagtacttacgtagtgaactccgtaactaccgtttaacgttcgtttaccggaaaccggtaacggggtttccggaacccttaacgtaccggttaacggttggaaccgggtgtaccggtagggtcggtaaccgttcgggtacgggaaacctttagttacttttaacccgccttaccgtccgtaacctacgtaacgtaccggtaccttacggtaccgtacgtaaccgtaaccggttagtaacgtttttacgtacccttaacgttaacctttacgacctttagtaaccgtaagtacgttacgtaaccgtccggttaccgtacccgttacggtacccggtcgtaaacccgggagtaaccggaaggtaacgttaaccaacggtaacgtcggtacacgtcgtactaacctcgtnttcccgtac

SEQ ID NO: 287741 - DNA, 942 bp, Homo sapiens
  misc_feature: GYAE6OF01ACUL8.6.19.B08.1.454.CMB.1.raw
  modified_base (95)..(95): a, c, t, g, unknown or other
  misc_feature (95)..(95): n is a, c, g, or t
tcagatatcgcgagcacgaccggtgctcgatttagtgagtcagtaagggggagtcagtctcagtcaggacacagcatggacatgagggtccccgntcagctcctggggctcctgctactctggctccgaggtgccagatgtgacatccagatgacccagtctccatcctccctgtctgcatcgtgtacggacacgacgacgtcaccatcacttggccgggactaagtcagacgctacttacgctaccttaagttttaaacgtggttaactacgtaaggtacgaacttcccgaaaggggtaaacctaccccccgttaaaacttccccggtaagtaccgtttacttaacgtacggtagtaccggtacctaaccgttacccggttaaccttttacggaaacggttaaaccggggttccggggtacccctaaagttaccggtaaacgggttttcgaacgggtacgggtaccggtaggtacggtacggttaccgtaaggggtaaccacggtttactttacccgtaaccttaccggtacccaaccgttaccggtacgtaacggaccccttacggtaccttacggtaaacccggttaaccggtttaaacgtaacggggttttaaccttttaaccggaacccttttttaaaccccggttagtttaaaaccccgttccgggtttaaaccaaacggtttaaccgggtaaccgtttttaaaccccgggtaccggtttaaccccgggtaaccccccgggtttcggggtaaacccggtttaacccgggggaacccgggtaaaaaccggggggttaacccgtaaaaccgggggttaaacgtaaaaccccggtttaaaccggtaaaacggggttcccgttaaaccgggttcgggttaaacccccggtttcgggaaaacccctccccggttttaaacgtttccccggggtttaaaccg

SEQ ID NO: 287742 - DNA, 802 bp, Homo sapiens
  misc_feature: GYAE6OF01BA9QA.6.19.B08.1.454.CMB.1.raw
  modified_base (95)..(95): a, c, t, g, unknown or other
  misc_feature (95)..(95): n is a, c, g, or t
tcagatatcgcgagcacgaccggtgctcgatttagtgagtcagtaagggggagtcagtctcagtcaggacacagcatggacatgagggtccccgntcagctccgtgggctcctgctactctggcctccggaggtgccagatgtgacatccgagatcgacccagtcctcctactccctcccttgtctcgctattcgtaggtacggacaagtagacgtccaacctatcctacgttccggacccgggactaagtccgaggtacgtactaagttacgtaccttaacgtttaaagtttttaaagttggttaacgtacgaaagggaactaaacgtacccggaaacgggtaaacccgtacccccttaaactccgtagtacgttacttagttagactcgactaccttaccgttacgtttcggaaccgttaacgggtccgggtacccttaagtacggtaacggttcgaaggttcggaacgttaggtacggtacgttacgggtacgggtaacttaacggttacttttaccgacctttaaccgacctaacctacgttacgacgtaccgtacggtactacgtaccttaacggtaaggttaacgtttacgttaccgaacctttaacgttacgttaacgttacgtaaccgtaacgttaacggttaccgttaacgtaccgttccccggtacccgggttaaccggtaccgggttaccgaaccgggtaaacggtaaccggttaaagggaacggtaaacctaaaccggtaaaccggagttaccggacgttccgaccgaacttccttacggttacccttcg

SEQ ID NO: 287743 - DNA, 791 bp, Homo sapiens
  misc_feature: GYAE6OF01C5Z91.6.19.B08.1.454.CMB.1.raw
tcagatatcgcgagcacgaccggtgctcgatttagtgagtcagtaagggggagtcagtctcagtcaggacacagcatggacatggacgggtcccccgctcagcctccgtggggcctccctgctactctggcctccggaggtcgccagatgtgacatccagactcgaccctagtcctccacttccctccctgtctgctactcgtagtacggacacgagcgtaccaccattcctacggttccgggaccggtacaagtacgagacgacttaacttacgacctaaccttttaaagttaaatttcggtaactacgaagggaacgtaacgtaaccggaaacgggtaaaccccgtaccccttaaaccgtcttaacgtactactaagtacgtatcgtacctaacttccgttaacgttacggaacggttaacgggttccgggtacctacggttaacggttaaacgggtcgtacggtcggtaacggttagggtcgttaacgtcgggtaacgggtacttaagttaccttactaaccgttcctaccgaaccttgacgacggtactgtacctacgaacgttaactgttaagtttaccgtctaacccgtttaattaaccgttacttaacgtaaacctaacggttaagtttaacgtacccggttaccgtaccccggttcccggttacgggttaacccggacccgggtaaacggaaccggtaaacggacggtaaacggtaaccaaaccggggtaactagggtaccggtcccgtagtaacccgccgtttaaaccttggttcccgttcg

SEQ ID NO: 287744 - DNA, 704 bp, Homo sapiens
  misc_feature: GYAE6OF01AOWOF.6.19.B08.1.454.CMB.1.raw
  modified_base (96)..(96): a, c, t, g, unknown or other
  misc_feature (96)..(96): n is a, c, g, or t
  modified_base (222)..(222): a, c, t, g, unknown or other
  misc_feature (222)..(222): n is a, c, g, or t
  modified_base (580)..(580): a, c, t, g, unknown or other
  misc_feature (580)..(580): n is a, c, g, or t
  modified_base (675)..(675): a, c, t, g, unknown or other
  misc_feature (675)..(675): n is a, c, g, or t
  modified_base (697)..(697): a, c, t, g, unknown or other
  misc_feature (697)..(697): n is a, c, g, or t
tcagatatcgcgagcacgaccggtgctcgatttagtgagtcagtaagggggagtcagtctcagtcaggacacagcatggacatgagggtcccccgntcagctccgtggggctcctgctactctggctccgaggtgccagatgtgacatccagatcgacccagtcctccatccctccctgtctgcatctgtaggaccacagactcaccatcactcggccgganagtcagtagactagttacgacctaacctttaattttaaacgttggtaacttacgaagggaacgtaaacgttacccggaaagggggtaaaaccctaccccccgtaaaacctttccgtagtacttaccgttagtacgtatacgtacctacgttaccctacgtttacggaacggtaaacgggttccgggtaccctaacgtacgtaaacggttcgaggtacggtacgtaggtaggtacgtacgggtagggaaccttaggtacctttaccgactttacccgtaactaccgtactacggtactacgtacgtactacgaaccttaacgtagttacttacgtttacgacctaacttataccgtaanaccgtaaactcggtacgtaccgtcggtaccccgtccgtacgggaccgtacgacggaacggaccggtaagtacgaaaccgttacgaacggttacgngtacccgtactacggactcctnttcgtcg

SEQ ID NO: 287745 - DNA, 702 bp, Homo sapiens
  misc_feature: GYAE6OF01AG4FT.6.19.B08.1.454.CMB.1.raw
  modified_base (285)..(285): a, c, t, g, unknown or other
  misc_feature (285)..(285): n is a, c, g, or t
  modified_base (326)..(326): a, c, t, g, unknown or other
  misc_feature (326)..(326): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtcgccagatgtgacatccagatgacccagtctccatccctccctgtctgcctatctgtaggacacagagtccacatcacgttcggcccggacaagtcagacgactaattacggacctaacctttaattttaaacgttgggtactccgaaggaanaactaccggtaacgggaaacctaccccttaaacctccgtanacttactatggaactcgtacctacttccctaacgttagaccgtaaagggtcgggtacccagttacgtaagggttcagggtcgacgtagggtcggtagtcgggtacgggtaatacggttactttaccgaacccttctaaccacctcaccgtagacgtaacgtcctaccggaaccctaaccgttagtaaaccgtttagttttacccaacttaacctttacgttaccctaagttaccaaacgtaacggtacgtaaccgtccggtacccgtcccccgggtaacgggtaccgtaccgggaccggtaaaacgggtacgaaagggtacgaaacgtaactaaacggacgttaggacgtacgaccgtaccaaccgtcttcgtacg

SEQ ID NO: 287746 - DNA, 796 bp, Homo sapiens
  misc_feature: GYAE6OF01EOP7K.6.19.B08.1.454.CMB.1.raw
  modified_base (232)..(232): a, c, t, g, unknown or other
  misc_feature (232)..(232): n is a, c, g, or t
tcagatatcgcgagcacgaccggtgctcgatttagtgagtcagtaagggggagtcagtctcagtcaggacacagcatggacatgagggtccccgctcagctcctggggcctcctgctactctggctccgaggtgccagatgtgacactccagatcgaccctagtcctccactccctcctgtctgctatcgtgtaggacacgagtacgtcaccatccacgttcggacccgganaagtcagacgctaattcgactaactttaatttaagtggtatacgaggtaacgtaacgtaccggaaacgggtaaaccctaaccccctaaacttcccgtagtaactttacgtaacgtgaacttcggtaactaccgttacccttacgttacggaacggtaacgggttccggtaacctacgtacggttaacggtcgtaggtcggaacgtaggtacggtacgttcgggtacggtaactagtttaaccgtttacctaccgttctaaccctaaccgtacgtacccaaggtcccgtaacgttaccgaccgtaaaccgtaaccgttaaggttaaaccttttacgtttaacccgtaacctttaaacccgtttaccgttaacgttaacccggtaaaccttaacgtaacggtttaccgtaaccggttaccggtaccccccgtacccgggttacccgggttaaccggtacccgggaaccgggttaaaccggtaaacggtaaccgggtaaacgtaaacccgtaaccgtaaagggccggttaggaccggtgtaaccccgactccttagttccgttaccg

SEQ ID NO: 287747 - DNA, 701 bp, Homo sapiens
  misc_feature: GYAE6OF01ALU6D.6.19.B08.1.454.CMB.1.raw
  modified_base (95)..(95): a, c, t, g, unknown or other
  misc_feature (95)..(95): n is a, c, g, or t
  modified_base (247)..(247): a, c, t, g, unknown or other
  misc_feature (247)..(247): n is a, c, g, or t
  modified_base (279)..(279): a, c, t, g, unknown or other
  misc_feature (279)..(279): n is a, c, g, or t
tcagatatcgcgagcacgaccggtgctcgatttagtgagtcagtaagggggagtcagtctcagtcaggacacagcatggacatgagggtccccgntcagctccgtggggctcctgctactcgtggctccggaggtgccagatgtgacatccagatcgaccccagtcctccactccctccgtgtctcgcattctggtacgactacgagactccaccagtccgacgttcgggccggacaagtcaggacnctaattacgctaacgtttaattaaagttgtancgaggaagtaactcggaaacggaaccaccccttaaagtccgtatactcttaatggacttgacctacgtacctacgtttacggacgtaaacggtccgggtacctaaggaccgttaaagggtcgtaggtcggtaccgtagggtacggtactacgggtacggtaacgtacgtactttacccgaccgttactaccgacgttcgtacgacgtacgttactccgtagtaacccgtacgtaagtaactttaacgtttccaaacgtttacgtaacttaccgtactaacgtaacggtacgttacgttaccgtccggtccgtcccgtaccgggtacggaccggtacgggaaaccggtaacggtagggtaaacccgtaagaaacgtacccgtaagtcgggtacgtacccgtacgacctacggttcctggttcc

SEQ ID NO: 287748 - DNA, 488 bp, Homo sapiens
  misc_feature: GYAE6OF02H3JK0.6.19.B08.1.454.CMB.1.raw
tcagatatcgcgagcacgaccggtgctcgatttagtgagtcagtaaggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaaagccctaaactcctgatctatgatgcatccactttgcaaagtgggtcccatcaaggtttcagtggcagtggatctgggacagattttcactctcaccatcagcagtctgcaacctgaagattttgctaacttactaactgtcaacagagttacagttgccctcggacgttcgccaagggaccgaaggtggaaatacaaacgaactagtaggctgcaccatctcg

SEQ ID NO: 287749 - DNA, 489 bp, Homo sapiens
  misc_feature: GYAE6OF02F4GVI.6.19.B08.1.454.CMB.1.raw
tcagatatcgcgagcacgaccggtgctcgatttagtgagtcagtaaggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtattcaggagaatccagggaaagcccctaaaactcctgatctatgatgcatccactttgcaaagtgggtcccatcaaggttcagtggcagtggatctgggacagatttcactctcaccatcagcagtctgcaacctgaagattttgctaacttactactgtcaacagagttacagtcgccctcggacgttcgccaggaccaaggtggaaagtacaaacgaactagtaggcgtagcaccatctcg

SEQ ID NO: 287750 - DNA, 499 bp, Homo sapiens
  misc_feature: GYAE6OF02GM01R.6.19.B08.1.454.CMB.1.raw
tcagatatcgcgagcacgaccggtgctcgatttagtgagtcagtaaggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaaagcccctaaatcctgatctatgatgcatccatttgcaaagtgggtcccatcaaggttcagtggcagtggatctgggacagatttcactctcaccatcagcagtctgcaacctgaagtattttgctaacttactactgtacaaactagagttacagttcgcccctcggaacgttccggaccaaggggaccaaggtggaaactacgaaacgaactggtaggcgtagacaccatctacg

SEQ ID NO: 287751 - DNA, 488 bp, Homo sapiens
  misc_feature: GYAE6OF02H8Z4M.6.19.B08.1.454.CMB.1.raw
tcagatatcgcgagcacgaccggtgctcgatttagtgagtcagtaagggggagtcagtctcagttaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaatcctgatctatgatgcatccactttgcaaagtgggtccatcaaggttcagtggcagtggatctgggacagatttcactctcaccatcagcagtctgcaacctgaagattttgcaacttactactgtcaacagagttacagtgccccttggacgttcggccaagggaccaaggtaggaaatacaaacgaactgtaggctgcaccatctgtcc

SEQ ID NO: 287752 - DNA, 484 bp, Homo sapiens
  misc_feature: GYAE6OF02GUD6H.6.19.B08.1.454.CMB.1.raw
tcagatatcgcgagcacgaccggtgctcgatttagtgagtcagtaaggggagtcagtctcagtcaggacacagcatggacatgagggtcccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaatcctgatctatgatgcatccatttgcaaagtgggtcccatcaaggttcagtggcagtggatctgggacagatttcactctcaccatcagcagtctgcaacctgaagattttgcaacttactactgtcaacagattacagtgcccctggacgttcggcctaagggaccaagggtggaaattcaaacgaactgtaggctagcaccatctcg

SEQ ID NO: 287753 - DNA, 480 bp, Homo sapiens
  misc_feature: GYAE6OF02G992U.6.19.B08.1.454.CMB.1.raw
tcagatatcgcgagcacgaccggtgctcgatttagtgagtcagtaaggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtgggtccatcaaggttcagtgcagtggatctgggacagatttcactctcaccatcagcagtctgcaacctgaagattttgcaacttactactgtcaacagagttacagtcgcccctggacgttcgaccagggaccaaggtggaaatcgaaacgactgtggctgcaccatctcg

SEQ ID NO: 287754 - DNA, 501 bp, Homo sapiens
  misc_feature: GYAE6OF02GWSFC.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagccctaaactcctgatctatgatgcatccactttgcaaagtggggtcccatcaaggttcagtggcagtggatctgggacagattttcactctcaccatcagcagtctgcaacctgaagattttgctaacttactactgtcaacagtagttacagttcgccctcggacgttcggaccgagggaccaaggtggaaactacgaaacgaacgtagtcggactcggacacctatactcg

SEQ ID NO: 287755 - DNA, 499 bp, Homo sapiens
  misc_feature: GYAE6OF02G1L49.6.19.B08.1.454.CMB.1.raw
  modified_base (268)..(268): a, c, t, g, unknown or other
  misc_feature (268)..(268): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaaacncccctaaactcctgatctatgatgaatccactttgcaaagtgggtcccatcaaggttcagtggcagtggatcgtgggacagtatttcactctcaccatcagcagtctgaccaacctgaagtattttgactaactttactactgtacaacagagttacagtcgccctggacttcggccaagggaccaaggtaggaaactcaaacgaactgtagctgaccaccattctgttac

SEQ ID NO: 287756 - DNA, 483 bp, Homo sapiens
  misc_feature: GYAE6OF02GYJ9S.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtgggtcccatcaaggttcagtggcagtggatctgggacagatttcactctcaccatcagcagtctgcaacctgaagattttgctaacttactactgtacaacagagttacagtcgccctcggacgttcggccaggaccaaggtggaaatcaaacgactgtcggctgcacatctcg

SEQ ID NO: 287757 - DNA, 506 bp, Homo sapiens
  misc_feature: GYAE6OF02I8YQD.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtgggtcccatcaaggttcagtggcagtggatctgggacagatttcactctcaccatcagcagtctgcaacctgaagtattttgactaactttactacttgtacaacagtaagttacaagtcgcccctcggaccgttcggaccagggaccaaggtcggaaactacgaaacgtaactgtaggcgtagccactatccgtcg

SEQ ID NO: 287758 - DNA, 502 bp, Homo sapiens
  misc_feature: GYAE6OF02FK94Q.6.19.B08.1.454.CMB.1.raw
tcagatatcgcgagcacgaccggtgctcgatttagtgagtcagtaaggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaactcctgatctatgatgcatccactttgcaaagtggggtcccatcaaggttcagtggcagtggatcgtggacagtatttcactctcaccatcagcagtctgaccaacctgaacgtattttgactaacttactactgtacaacagtagttacagtcgcccgtcggacgttcgaccgacggaccgaaggtaggaaatacgaaacgaacgtgtacggctgacacatctcg

SEQ ID NO: 287759 - DNA, 509 bp, Homo sapiens
  misc_feature: GYAE6OF02G2UIZ.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccaggaaagcccctaaactcctgatctatgatgcatccactttgcaaagtgggtccatcaagttcagtggcagtgatcgtgggacagtatttcactctcaccatcagcagtctgacaacctgaagtattttgactaacttactactgtacaacagtagttacagtcgcccgtcggacgttccggaccaacgggaccgaagggtacggaaataccgaaacgaacgtagtacggctacgacacctatcttacg

SEQ ID NO: 287760 - DNA, 485 bp, Homo sapiens
  misc_feature: GYAE6OF02GZLO0.6.19.B08.1.454.CMB.1.raw
  modified_base (426)..(426): a, c, t, g, unknown or other
  misc_feature (426)..(426): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtgggtcccatcaaggttcagtggcagtggatcgtgggacagatttcactctcaccatcagcagtctgcaacctgaagtattttgactaacttactactgtacaacagagttacagtcnccctcggacgttcgaccaggaccaaggtgaatacaaacgactagtgctgacacatctcg

SEQ ID NO: 287761 - DNA, 521 bp, Homo sapiens
  misc_feature: GYAE6OF02JE9JR.6.19.B08.1.454.CMB.1.raw
tcagatatcgcgagcacgaccggtgctcgatttagtgagtcagtaaggggaggtcgagtctcagtcaggacacagcatggacatgagggtcccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattgtatcaggagaatccagggaaagcccctaaactcctgatctatgatgcatcactttgcaaagtgggtcccatcaaggttcagtgcagtggatcgtgggacagatttcactctcacatcagcagtctagcaaacctgaacgtattttgactaactttactacttgtactaactagtagttacaaggtcaccccgtcggacgtttcggaccgacgggtaaccgaaggtaacgggaaatacaaaccgtaacgtgtacggtactcggacaccgtactctcg

SEQ ID NO: 287762 - DNA, 622 bp, Homo sapiens
  misc_feature: GYAE6OF02IXL4B.6.19.B08.1.454.CMB.1.raw
tcagatatcgcgagcacgaccggtgctcgatttagtgagtcagtaaggggagtcagtctcagtcaggacacagcatggacatgagggtcccgctcagctcctgggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacgcccctaaactcctgatctatgatgcatcctactttgactaaggtcgggtacccatacgtaagttcaggtgacgagtggatcgtagggacagtatttcacttctacaccatcagctagtctcgacctaacgtagtaagttattttcgaccttaaactttactactacgtaaccaaacgtagtaagttaaccgacggttcccgtaccccggttacgggttaaccgttacccgggaacccgtaaacggggtaacccgtaaacggggtaacggtaaaccgttaaaccggtaaaaaccggtaacgttacgggtacgggttaccgtaccggaacccgtaacccgtaccgtttacgttaccgg

SEQ ID NO: 287763 - DNA, 487 bp, Homo sapiens
  misc_feature: GYAE6OF02GIHLW.6.19.B08.1.454.CMB.1.raw
tcagatatcgcgagcacgaccggtgctcgatttagtgagtcagtaaggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtgggtcccatcaaggttcagtggcagtggatctgggacagatttcactctcaccatcagcagtctgcaacctgaagtattttgctaactttactactgtacaacagaagttacagttcgcccctggacgttcgaccagggaccaaggtgaaatcaaacgaactgtggctgacaccatctcg

SEQ ID NO: 287764 - DNA, 522 bp, Homo sapiens
  misc_feature: GYAE6OF02G70XT.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaactcctgatctatgatgcatccactttgcaaagtggggtcccatcaaggttcagtggcagtggatcgtgggacagatttcactctcaccatcagcagtctgcaacctgaagtattttgactaacttactactgtacaacagtagttaacagttcgccccgtcggaccgttcggaccgaacgggaccaacgggtaggaaacgtacgaaacgaacgtaggtacggacgtcgaccaacctagttctacg

SEQ ID NO: 287765 - DNA, 486 bp, Homo sapiens
  misc_feature: GYAE6OF02GBFEC.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaactcctgatctatgatgcatccactttgcaaagtgggtcccatcaaggttcagtgcagtggatctggacagatttcactctcaccatcagcagtctgcaacctgaagattttgactaacttactactgtacaacagagttacagtcgccctcggacgttcgccaggaccaaggtggaaatcgaaacgaactagtcggctgcaccatctcg

SEQ ID NO: 287766 - DNA, 487 bp, Homo sapiens
  misc_feature: GYAE6OF02IBH1W.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagccctaaactcctgatctatgatgcatccactttgcaaagtgggtcccatcaaggttcagtgcagtggatctgggacagatttcactctcaccatcagcagtctgcaacctgaagattttgctaacttactactgtcaacagagttacagtgcccctcggacgttcgccgagggaccgaaggtggaatacaaacgaactagtaggcgtgccacactctcg

SEQ ID NO: 287767 - DNA, 507 bp, Homo sapiens
  misc_feature: GYAE6OF02GMOWN.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaactcctgatctatgatgcatccactttgcaaagtgggtcccatcaaggttcagtggcagtggatctggggacagatttcactctcaccatcagcagtctgcaacctgaagattttgactaacttactactgtcaacagtagttacagttcgccctcggaccgttcgacctaagggacctaagggtacggaaatacgaaacgtaactagtacggcgtagaccactatctacg

SEQ ID NO: 287768 - DNA, 513 bp, Homo sapiens
  misc_feature: GYAE6OF02HJUW6.6.19.B08.1.454.CMB.1.raw
  modified_base (384)..(384): a, c, t, g, unknown or other
  misc_feature (384)..(384): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaatcctgatctatgatgcatccactttgcaaagtgggtcccatcaagttcagtggcagtggatcgtgggacagatttcactctcaccatcagcagtctgacaacctgaanattttgactaacttactactgtacaacagtagttacagttcgccccgtaggaccgtttccggaccaaggggaccctaagggtcggaaatacgaaaccggtaacgttgtacggctagcaaccattctacg

SEQ ID NO: 287769 - DNA, 503 bp, Homo sapiens
  misc_feature: GYAE6OF02FZKZS.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacgcccctaaaactcctgatctatgatgcatccactttgcaaagtcggggtcccatcaaggttcagtggcagtggatcgtgggacagtatttcactctcaccatcagcagtctgccaacctgaagtattttgactaactttactactgttacaacagtagttacagtcgcccctcggacgttcggaccgagggaccgaaggtagaaactacaaacgtactgtacgctgcacatctcg

SEQ ID NO: 287770 - DNA, 486 bp, Homo sapiens
  misc_feature: GYAE6OF02F4KXP.6.19.B08.1.454.CMB.1.raw
tcagatatcgcgagcacgaccggtgctcgatttagtgagtcagtaaggggagtcagtctcagtcaggacacagcatggacatgagggtcccgctcagctcctgggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccatttgcaaagtgggtcccatcaaggttcagtggcagtgatctgggacagatttcactctcaccatcagcagtctgcaacctgaagattttgctaacttactactgtcaacagagttacagtgccctcggacgttcgaccagggaccaagggtaggaaactacgaaacgaactagtggctgcacctatctacg

SEQ ID NO: 287771 - DNA, 506 bp, Homo sapiens
  misc_feature: GYAE6OF02HNU5P.6.19.B08.1.454.CMB.1.raw
tcagatatcgcgagcacgaccggtgctcgatttagtgagtcagtaaggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcagagaatcaggaaagcccctaaatcctgatctatgatgcatccactttgcaaagtcgggtccatcgaagttcagtggcagtggatcgtgggacagtatttcactctcaccatcagcagtctgcaactgaagattttgctaaacttactacttgtacaagagattacaagtcgccccgtggtaccgttcgaccgaacgggaccaagggtagtaaagtacaaacgtaacgtagtacggacgtcgtacaccgtatcgtacg

SEQ ID NO: 287772 - DNA, 546 bp, Homo sapiens
  misc_feature: GYAE6OF02HRJWN.6.19.B08.1.454.CMB.1.raw
  modified_base (251)..(251): a, c, t, g, unknown or other
  misc_feature (251)..(251): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagagcattagcactatttaaatgtatcagganaatccagggaaacgccctaaactcctgatctatgatgcatccatttgactaaaggtcgggtccagtcaaggttcagtggacagtggatcgtggacagtattttcactctcacatcagcagtctgacaacctgaagtatttgacttaacttactactgtacaacgtagtagttacagttcgaccccgtacggtaccgttccggacccgaacgggtacccgtaagggtacggtaaacgtacgaaaaccgtaacgtacggttacgggaccgtacgaccgtaacctacgttacgtacgg

SEQ ID NO: 287773 - DNA, 486 bp, Homo sapiens
  misc_feature: GYAE6OF02GFKON.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaactcctgatctatgatgcatccactttgcaaagtgggtcccatcaaggttcagtggcagtggatctgggacagatttcactctcaccatcagcagtctgcaacctgaagattttgctaacttactactgtcaacagagttacagtcgccctcggacgttcggccagggaccaaggtggaaatacaaacgactagtggctgcaccatctcg

SEQ ID NO: 287774 - DNA, 501 bp, Homo sapiens
  misc_feature: GYAE6OF02G49Y0.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccatttgcaaagtgggtcccatcaaggttcagtggcagtggatctgggacagatttcactctcaccatcagcagtctgcaacctgaagtattttgactaacttactactgtacaacagtagttacagtcgccccgtaggaccgttcggaccgaagggaccaagggtggaaactacgaaacgaacgtgtacggctagcactatctcg

SEQ ID NO: 287775 - DNA, 492 bp, Homo sapiens
  misc_feature: GYAE6OF02G9R2R.6.19.B08.1.454.CMB.1.raw
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctattaaatgtatcaganatcaggaaacnccctaaactcctgatctatgatgcatccactttgcaaagtcgggtccatcaaggttcagtgcagtgatcgtgggacagtatttcactctcaccatcagcagtctgacaacctgaagtattttgactaacttactactgtacaacagtagttacagtcgcccgtcggacgttcgaccgtagggaccgtaaggtaggaactacaaacgacgtgtcggtctgacaccatctcg

SEQ ID NO: 287776 - DNA, 525 bp, Homo sapiens
  misc_feature: GYAE6OF02IVGM2.6.19.B08.1.454.CMB.1.raw
  modified_base (254)..(254): a, c, t, g, unknown or other
  misc_feature (254)..(254): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctattaaattggtatcagganaatccgaggaaagcccctaaaatcctagatctatgatgcatccactttgacaaaggtgggtccatcaagttcagtgacagtggatctaggacagtatttcactctacactatcagctagtctcgacaaccgtagtaacgtattttcgactaaacctttactacttgtacaactagtaattacagttcgcccgtcgtaacgttcgacccgaagggaccgtaaggtcggaaactacgaaacgtacgtagtacggctacgctaccgatcttacg

SEQ ID NO: 287777 - DNA, 494 bp, Homo sapiens
  misc_feature: GYAE6OF02IFVL0.6.19.B08.1.454.CMB.1.raw
  modified_base (423)..(423): a, c, t, g, unknown or other
  misc_feature (423)..(423): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcactatttaaattggtatcaggagaatccagggaaagcccctaaactcctgatctatgatgcatcactttgacaaagtgggtccatcaaggttcagtggcagtggatcgtggacagatttcactctcaccatcagcagtctgcaactgaacgtattttgacctaattactactgtacaacagagttacagtcncccgtaggacgttcgaccgacgggacgaaggtaggaaatacgaaacgtaactaggtgactgacacatctcg

SEQ ID NO: 287778 - DNA, 514 bp, Homo sapiens
  misc_feature: GYAE6OF02I9YOP.6.19.B08.1.454.CMB.1.raw
tcagatatcgcgagcacgaccggtgctcgatttagtgagtcagtaagggggaggtcgagtctcagtcaggacacagcatggacatgagggtcccgctcagctcctgggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagccccgtaaactcctgatctatgatgcatccactttgacaaacgtggggtcccagtcaaggttcagtgcagtggatcgtgggacagtatttcactctcaccatcagcagtctgaccacctgaactattttgactaacttactactgtacaacagagttactagtcgtcccctcggacgttcggaccgtaggaccgtaaggtaggaaactacgaaacgaacgtagtcggcgtagccacctagtcctcg

SEQ ID NO: 287779 - DNA, 483 bp, Homo sapiens
  misc_feature: GYAE6OF02G03MR.6.19.B08.1.454.CMB.1.raw
  modified_base (478)..(478): a, c, t, g, unknown or other
  misc_feature (478)..(478): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaactcctgatctatgatgcatccactttgcaaagtgggtccatcaagttcagtgcagtggatctggacagatttcactctcaccatcagcagtctgcaacctgaagtattttgctaacttactactgtacaacagtagttacagtcgcccctcggacgttcggaccagggaccaaggtggaaatcaaacgactgtgctgcacntctcg

SEQ ID NO: 287780 - DNA, 496 bp, Homo sapiens
  misc_feature: GYAE6OF02GWFN8.6.19.B08.1.454.CMB.1.raw
tcagatatcgcgagcacgaccggtgctcgatttagtgagtcagtaaggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtgggtcccatcaaggttcagtggcagtggatctgggacagatttcactctcaccatcagcagtctgccaacctgaagtattttgactaactttactactgtacaacagtacgttacagttcgccccgtcggacgttcggaccaagggaccaagggtggaaatcgaaacgacgtgtggctgcacatctcg

SEQ ID NO: 287781 - DNA, 497 bp, Homo sapiens
  misc_feature: GYAE6OF02HBU6F.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaactcctgatctatgatgcatccactttgcaaagtcgggtcccatcaagttcagtgcagtggatctgggacagatttcactctcaccatcagcagtctgcaacctgaagtattttagactaactttactactgtacaacagagttacagttcgcccctggtaccgttcgaccagggaccaaggtaggaaatcgaaacgacgtgtacggctgacactatctcg

SEQ ID NO: 287782 - DNA, 549 bp, Homo sapiens
  misc_feature: GYAE6OF02I45J5.6.19.B08.1.454.CMB.1.raw
  modified_base (266)..(266): a, c, t, g, unknown or other
  misc_feature (266)..(266): n is a, c, g, or t
  modified_base (363)..(363): a, c, t, g, unknown or other
  misc_feature (363)..(363): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccggcaagtcagagcattagctacctatttaaatggtatcaggagaatccaagggaancccctaaatcctagatctatgatgcatccatttgacaaagtcgggccatcaagttcagtggcaggtgatcgtggacagtatttcactctactaaccntacagtctacgtctcgaccaacgtagtaagttacgtttacgaccttaacttactacgtactaacgaaactagtacgttacgacgttccgtaccccgtaggtaccgttcggaaccgtacgggaccgtaaggtaacggtaaactacgtaaacgtacgttacgacggtccacgacctacgtacgtctcg

SEQ ID NO: 287783 - DNA, 486 bp, Homo sapiens
  misc_feature: GYAE6OF02HR4QF.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtgggtcccatcaaggttcagtggcagtggatctgggacagatttcactctcaccatcagcagtctgcaacctgaagtattttgacaacttactactgtacaacagattacagtcgcccctggacgttcgccaagggaccaaggtggaaatcaaacgtaactggtgctgcaccatctcg

SEQ ID NO: 287784 - DNA, 484 bp, Homo sapiens
  misc_feature: GYAE6OF02GF692.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtgggtcccatcaaggttcagtggcagtggatctgggacagatttcactctcaccatcagcagtctgcaacctgaagattttgactaacttactactgtcaacagagttacagtcgccctcggacgttcgccagggaccaaggtcggaaatcgaaacgactgtgctgcacatctacg

SEQ ID NO: 287785 - DNA, 499 bp, Homo sapiens
  misc_feature: GYAE6OF02FK5NE.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtgggtccatcaaggttcagtggcagtgatcgtggacagatttcactctcacatcagcagtctgcactgaagtatttgctaacttactactgtcaaacagtagttacagtcgcccctcggacgttcggacccgaacgggaccaagggtcggaaataccgaaaacgaacgtagtcggctgacacctatctacg

SEQ ID NO: 287786 - DNA, 644 bp, Homo sapiens
  misc_feature: GYAE6OF02JV7G3.6.19.B08.1.454.CMB.1.raw
  modified_base (190)..(190): a, c, t, g, unknown or other
  misc_feature (190)..(190): n is a, c, g, or t
  modified_base (258)..(258): a, c, t, g, unknown or other
  misc_feature (258)..(258): n is a, c, g, or t
  modified_base (268)..(268): a, c, t, g, unknown or other
  misc_feature (268)..(268): n is a, c, g, or t
tcagatatcgcgagcacgaccggtgctcgatttagtgagtcagtaaggggagtcgagtctcagtcaggacacagcatggacatgaggtcccgctcagctcctgggctcctgctactctggctccgaggtgccagatgtgacatccagatgaccctagtctcatcctcctgtctgcatctgtaggacacgngagtcaccgatcacttggccgggcaagtcagacgtctattagcacctatttaatggttatacaggtanatcagggaanccctaaactccgtagactctagtcgagtagactatcctactttacgacgtaaagtcgggtaccctagtacgtaagggttaccaaggttcggacgtacggtaggtactcgttagggactaggtatttaccgacttaccgtctaacccgtacgtacacgtaccaagtcctacgacctaacgtgaaacgtttactttacggaccttaaaccttactaccgttagtaaccgaactagggtaacgtttaccaagggttccaccccggttaggtacccgtttacggaccgtacgggtaacccgtaagggtacggtaataacccggaaacggttaacgtacggtagggtacctacgttaccgaaccgttacgtaccgtttacg

SEQ ID NO: 287787 - DNA, 571 bp, Homo sapiens
  misc_feature: GYAE6OF02I0BKO.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctattaaattggtatcaggagaataccgaagggaaacgcccctaaactcctagactctatgatgcatctactttgacgtaaagtcgggtaccagtacgtaacggttcagtggactagtaggatacgtggacagtacttcgtaactctaccactatcacgctagtctacgaccaaccgtagaacgtattttacgaccttaacgtttactacttagtactaactagtaacgttacgagttccgtaccccgtaggtaccgttacgaccgaacggtaccgtaacgggtagtaaacgtacgaaacgtaacgtaggtcgtacgtcgacgaccgtagtcttaccg

SEQ ID NO: 287788 - DNA, 538 bp, Homo sapiens
  misc_feature: GYAE6OF02F28WC.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtcgggtcccatcaaggttcagtggcaggtggatcgtgggacagtatttcactctcaccatcagcagtctgccaacctgaagtattttgacctaactttactactgtacaactagtagttacagttcgccccgtcggtacgttccggaccgaacgggaccgaagggtacggaaactaccgaaaacggtaacgttggtacggtactacggacctaacccgtattccgttacg

SEQ ID NO: 287789 - DNA, 540 bp, Homo sapiens
  misc_feature: GYAE6OF02GIEG7.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcacctatttaaattggtatcaggagaatccagggaaacgcccctaaaactcctagatctatgatgcactccactttgactaaaggtcgggtacccatcaaggttcagtggcaggtggatcgtagggacagatttcactctacaccatcagtcgcctgcagtctagaagtactttagactaacttattactgtacaactagtattattacgtttcccttaactacgttttggaccgtaaggggtacctaaacgtcggaacgtactaacgtaaacgtaacgttggtacggtcctagaccacctatcttacg

SEQ ID NO: 287790 - DNA, 514 bp, Homo sapiens
  misc_feature: GYAE6OF02HBIG9.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtgggtccatcaaggttcaggtggcagtggatcgtgggacagtatttcactctacacatcagcagtctgccaactgaagtattttgcctaacttactactgtacaacagtattacagtcgcccgtcggtacgttcggtacgaacgggtaccgaaggtaggaaactacgaaacgtaacgtggtacggcgtgacctacctatccgttcg

SEQ ID NO: 287791 - DNA, 518 bp, Homo sapiens
  misc_feature: GYAE6OF02G0KWT.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtgggtcccatcaaggttcagtgcagtgatctgggacagatttcactctcaccatcagcagtctgcaacctgaatatttgactaacttactactgtacaactagagttacagttcgtccccgtggtaccgttccggacctaagggaccaagggtcggaaattaccgaaaacgtaaccgtggtacggacttacggaccacctagtccttacg

SEQ ID NO: 287792 - DNA, 512 bp, Homo sapiens
  misc_feature: GYAE6OF02GEQXE.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaactcctgatctatgatgcatccactttgcaaagtgggtcccatcaaggttcagtgcagtggatcgtgggacagtatttcactctacaccatcagcagtctgcaacctgaagtattttgactaacttactactgtacaacagtagttacagtcgccccgtggaccgttcggaccgaagggaccaagggtacggaaactacgaaacgtaacgtggtacggctacgacaccgtatctcg

SEQ ID NO: 287793 - DNA, 522 bp, Homo sapiens
  misc_feature: GYAE6OF02GCRZ5.6.19.B08.1.454.CMB.1.raw
  modified_base (268)..(268): a, c, t, g, unknown or other
  misc_feature (268)..(268): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaancccctaaaactcctgatctatgatgcatccactttgcaaagtgggtcccatcaaggttcagtggcagtggatctgggacagtatttcactctcaccatcagcagtctgccaacctgaagtattttgacctaaacttacctactgttacaactagtagttacagttcgcccctcggtaccgttcggaccgaacgggaccaagggtaggaaactacgaaaacgtaacgtaggtacggctacgcaacctagtctacg

SEQ ID NO: 287794 - DNA, 544 bp, Homo sapiens
  misc_feature: GYAE6OF02HA3SS.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtgggtcccatcaaggttcagtgcagtggatcgtgggacagtatttcactctcacatcagcagtctgcaacctgaagtatttgactaacttactactgtacaactagtacgttacagttccgtaccccgtcggtaaccgttccggacccgaaggggaacccgtaagggtacggaaaacttaccgaaaacggtaaccgtaggtacggtacttacggaccctaaccgtactccgttacg

SEQ ID NO: 287795 - DNA, 506 bp, Homo sapiens
  misc_feature: GYAE6OF02JA298.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccaggaaagccctaaactcctgatctatgatgcatccactttgcaaagtgggtcccatcaaggttcagtggcagtgatctgggacagatttcactctcaccatcagctagtctgccaacctgaatattttagcctaacttactactcgtacaacagtagttacagtcgccccgtacggtaccgttccggaccgagggaccgaaggtaggaaatacgaaacgtacgtagtcggctcgacacctatctcg

SEQ ID NO: 287796 - DNA, 495 bp, Homo sapiens
  misc_feature: GYAE6OF02FUHUS.6.19.B08.1.454.CMB.1.raw
  modified_base (414)..(414): a, c, t, g, unknown or other
  misc_feature (414)..(414): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaactcctgatctatgatgcatccactttgcaaagtgggtcccatcaaggttcagtgcagtggatcgtgggacagatttcactctcaccatcagcagtctgcaacctgaagattttgactaactttactactgtaccaangtagtttacagttcgcccctggcgttaccggccacgggaccaaggtggaaatcaaacgaacgtgtggactgcaccatctcg

SEQ ID NO: 287797 - DNA, 518 bp, Homo sapiens
  misc_feature: GYAE6OF02G7ROY.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaactcctgatctatgatgcatccactttgcaaagtgggtcccatcaagttcagtggcagtggatcgtgggacagatttcactctcaccatcagcagtctgcaacctgaagtattttgactaacttactactgtacaactagacgttacagtccgcccctcggaccgtttcggaccaacgggaccaagggtaccggaaataccgaaacgtaacgtaggtcggactcgccaacctatccgttacg

SEQ ID NO: 287798 - DNA, 515 bp, Homo sapiens
  misc_feature: GYAE6OF02I29Z4.6.19.B08.1.454.CMB.1.raw
  modified_base (265)..(265): a, c, t, g, unknown or other
  misc_feature (265)..(265): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattgtatcagagatcgaggaaacnccctaaatcctgatctatgatgcatccatttgacaagtgggtcccatcaagttcagtgcagtggatcgtggacagtatttcactctcaccatcagcagtctgacactgaatatttagactaacttactactcgtacaactagacgttacagttcgacccgtcggtaccgttccggaccgacgggacctaagggtacggaaaactacgaaacgtaacgtggtacggtacgttcgaccaccttatcgttacg

SEQ ID NO: 287799 - DNA, 510 bp, Homo sapiens
  misc_feature: GYAE6OF02IBY3O.6.19.B08.1.454.CMB.1.raw
  modified_base (268)..(268): a, c, t, g, unknown or other
  misc_feature (268)..(268): n is a, c, g, or t
  modified_base (388)..(388): a, c, t, g, unknown or other
  misc_feature (388)..(388): n is a, c, g, or t
  modified_base (505)..(505): a, c, t, g, unknown or other
  misc_feature (505)..(505): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaanccctaaactcctgatctatgatgcatccactttgacaaagtgggtccatcaaggttcagtggcagtggatcgtgggacagatttcactctcaccatcagcagtctgctaacctgtaaatnttttgactaacttactactgtacaactagtagttacagtcgtcccgtcggacgttcgccgtaacgggaccgtaagggtcggaaactacgaaacgtaactcggtaggctgacactatnttacg

SEQ ID NO: 287800 - DNA, 526 bp, Homo sapiens
  misc_feature: GYAE6OF02FNVMS.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagagcattagcacctatttaaatggtatcaggagaatccagggaaagcccctaaatcctagatctatgatgcatccatttgcaagtgggtccatcaaggttcagtgcagtggatctggacagtatttcactctcaccatcagcagtctgcaactgaagtattttgactaacttactactcgtacaactagtagttacagttcgccccttacggtacgttaccggacctaagggaccgtaagggtacggaaacttaccgaaaaccgtacgttaggtacggtactacggtaccacctacgtaccttcgg

SEQ ID NO: 287801 - DNA, 712 bp, Homo sapiens
  misc_feature: GYAE6OF02J3HIR.6.19.B08.1.454.CMB.1.raw
  modified_base (213)..(213): a, c, t, g, unknown or other
  misc_feature (213)..(213): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccggnaagtcagagcattagcactatttaaatggtatcaggagaatccagggaacacccctaaactccgtgatctaatgatgcatccactttgacgtaaacgttcggggtacccagtaccgtaaagggtttccaaggttcggacgtaacggtggtaagttcgttaggggactaacggtactttttcccgaactttccttaccgaaccctagttaccaacggtacctacggttaccttacggaaccctaaacccgttaaggtaaacgttaacgttttttacggaacttaaacctttaaccgttaccgtttaacggtaacctaaaccgtaaggttaacgtttaaacccgtacgggttaccgacccccggttacgggtacccgggtttaccgaacccgtaaacggggaaccgtaaagggttaaccggtaaactacccgtaaaaccggtaacgttacggttaccgggtactacccggtaacctaacccgttaacgttccgtttaaccg

SEQ ID NO: 287802 - DNA, 514 bp, Homo sapiens
  misc_feature: GYAE6OF02JH42W.6.19.B08.1.454.CMB.1.raw
  modified_base (251)..(251): a, c, t, g, unknown or other
  misc_feature (251)..(251): n is a, c, g, or t
  modified_base (271)..(271): a, c, t, g, unknown or other
  misc_feature (271)..(271): n is a, c, g, or t
  modified_base (378)..(378): a, c, t, g, unknown or other
  misc_feature (378)..(378): n is a, c, g, or t
  modified_base (415)..(415): a, c, t, g, unknown or other
  misc_feature (415)..(415): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagagcattagcacctattaaatggtatcaganaatcaggaaacgccctaaancctgatctatgatgcatcctacttgactaaagtcgggtacccagtacaaaggttcagtggcagtggatcgtgggactagtatttcgactctacaccatcagcagtcnacaactgaatatttcgactaacttactactgtacaanagtagttacagttacgccctacggtacgttcgaccgaggacctaaggtcggtaaactcgaaacgtacgtagtacggactagccaaccgtatccgttacg

SEQ ID NO: 287803 - DNA, 534 bp, Homo sapiens
  misc_feature: GYAE6OF02HSV2C.6.19.B08.1.454.CMB.1.raw
  modified_base (381)..(381): a, c, t, g, unknown or other
  misc_feature (381)..(381): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagattgacccagtctaccatcctccctgtctgcatctgtaggacacagagtcaccatcacttgccgggcaagtcagagcattagcactatttaaattggtatcaggagaatccaggaaacgccctaaactcctgactctatgatgcatccactttgacaaggtcgggtccatcaaggttcaggtggactagtggatcgtgggtacagtatttcactctcaccatcagcagtcngaccaacctgaaagtatttgacctaaacttactactcgtacaaactagtattaacagtcgaccccgtcggaaccgttcggaccgaacgggaccgaaagggtcggaaacttacgaaaaccgtaacgtggtacggcgtagaccactagtcttacg

SEQ ID NO: 287804 - DNA, 517 bp, Homo sapiens
  misc_feature: GYAE6OF02G7BJO.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatcccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgactaaagtcgggtcccatcaagttcagtggcagtgatcgtgggacagtatttcactctcacatcagcagtctgcctaacctgtaagtattttgactaacttactactgtacaactagagttacagtcgtccctacggtacgttacgaccgaacgggaccgtaaggtcggtaaatacgaaacgtaacgtagtcggactagaccaccgtatcgtc

SEQ ID NO: 287805 - DNA, 495 bp, Homo sapiens
  misc_feature: GYAE6OF02HK5PF.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcactatttaaattggtatcaggagaatccagggaaagcccctaaactcctagatctatgatgcatccactttgcaaagtgggtcccatcaaggttcagtgcagtggatcgtgggacagatttcactctcaccatcagcagtctgacaacctgaagtattttgactaacttactactgtacaactagtagttacagtcgcccctggacgttcggaccagggaccaaggtgaatacgaaacgacgtagtcggctgacactatctacg

SEQ ID NO: 287806 - DNA, 500 bp, Homo sapiens
  misc_feature: GYAE6OF02FHIBC.6.19.B08.1.454.CMB.1.raw
  modified_base (268)..(268): a, c, t, g, unknown or other
  misc_feature (268)..(268): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaancccctaaactcctgatctatgatgcatccactttgcaaagtgggtcccatcaaggttcagtggcagtggatctgggacagatttcactctcaccatcagcagtctgcaacctgaagattttgctaacttactactgtcaacagagttacagtcgcccctcggacgttcggacctagggaccgaagggtacggaaatacgaaacgtaacgtagtacggcgtgcaccatcttcg

SEQ ID NO: 287807 - DNA, 531 bp, Homo sapiens
  misc_feature: GYAE6OF02FV466.6.19.B08.1.454.CMB.1.raw
  modified_base (254)..(254): a, c, t, g, unknown or other
  misc_feature (254)..(254): n is a, c, g, or t
tcagatatcgcgagcacgaccggtgctcgatttagtgagtcagtaagggggagtcagtctcagtcaggacacagcatggacatgatggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattgtatcagganaatccaagggaacgcccctaaactcctgatctatgatgcatcctactttgacaaaggtcggggtcccatcaaggttcagtggcagtgatcgtgggacagtattcactctcaccatcagcagtctgaccaaccgtgaagttattttcgacttaacttactactgtacaactagtacgttacagtccgaccccgtcggtaccgttccggaccgaacgggaaccgtaagggtacggaaacgtaccgaaacgtaacgtggtacggcctagccacctatccg

SEQ ID NO: 287808 - DNA, 513 bp, Homo sapiens
  misc_feature: GYAE6OF02IZ0PC.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagccctaaactcctgatctatgatgcatccactttgcaaagtgggtcccatcaagttcagtggcagtggatctgggacagtatttcactctcaccatcagcagtctgacaacctgaagtattttagctaacttactactgtacaacagtagttacagttcgcccctcggtacgttccggaccgtaacgggaccaagggtggaaactacgaaaacgaacgtaggtacggctcgacaccgtatcttacg

SEQ ID NO: 287809 - DNA, 511 bp, Homo sapiens
  misc_feature: GYAE6OF02IVP80.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctattaaattggtatcaggagaatccagggaaagcccctaaaactcctgatctatgatgcatccactttgcaaagtgggtcccatcaaggttcagtggcagtgatctgggacagtatttcactctcaccatcagcagtctgcaacctgaagtattttgactaactttactactgtacaacagagttacagtcgcccctcggtacgttcggaccaacgggaccgaaagggtcggtaaaatcgaaaccgacgtagtgggcctgaccacctatccttacgg

SEQ ID NO: 287810 - DNA, 511 bp, Homo sapiens
  misc_feature: GYAE6OF02H108X.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctagatctatgatgcatccatttgcaaagtgggtcccatcaaggttcagtggcagtggatcgtgggacagtatttcactctcaccatcagcagtctgccaacctgaagtattttgacttaacttactacttgtacaacagtattacagttcgcccctcggaccgttccggaccgaacgggaccgaagggtaggaaactacgaaacgaacgtgtacggctagacactatctcg

SEQ ID NO: 287811 - DNA, 623 bp, Homo sapiens
  misc_feature: GYAE6OF02JDT51.6.19.B08.1.454.CMB.1.raw
  modified_base (250)..(250): a, c, t, g, unknown or other
  misc_feature (250)..(250): n is a, c, g, or t
  modified_base (261)..(261): a, c, t, g, unknown or other
  misc_feature (261)..(261): n is a, c, g, or t
  modified_base (342)..(342): a, c, t, g, unknown or other
  misc_feature (342)..(342): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagatcaccatcacttgccgggcaagtcagagcattagcactattaatggtatcagganatccaggaacnccctaaactcctgatctaatgatgcatccactttgactaaaggtcgggtacccatcgaagttcagtgcagtgatgtggganagtatttacgactctacacctatacgagtctacgtcgtagaccctaaccgttaggtaaacgttatttttacggacctttaaaacctttactaaccgtttagtaacctaaaaccgtacggttaaacgtttaccgtaaccggttcccggtaacccccgttacgggttaaccccggtacgggtaacccgaacggggtaaacccgtaaaggggtaacggtaaaacgttaaccgaaaaccggtaacgttcgacgggtctaccggacctaacgtacgtccgttacgg

SEQ ID NO: 287812 - DNA, 492 bp, Homo sapiens
  misc_feature: GYAE6OF02JR8V3.6.19.B08.1.454.CMB.1.raw
  modified_base (379)..(379): a, c, t, g, unknown or other
  misc_feature (379)..(379): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagccctaaactcctgatctatgatgcatccatttgcaaagtgggtccatcaagttcagtggcagtggatcgtgggacagatttcactctcacatcagcagtctgcaacctgaanatttgactaacttactactgtacaactagtagttacagttcgccctggacgttcgaccgaggaccgaaggtcggaaactcgaaacgtacgtagtacgactgactacatctacg

SEQ ID NO: 287813 - DNA, 529 bp, Homo sapiens
  misc_feature: GYAE6OF02IJNHM.6.19.B08.1.454.CMB.1.raw
  modified_base (213)..(213): a, c, t, g, unknown or other
  misc_feature (213)..(213): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (525)..(525): a, c, t, g, unknown or other
  misc_feature (525)..(525): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagatcaccatcacttgccggnaagtcagagcattagcactatttaaattggtatcaggagaataccgagggaaacgacccctaactcctagatctatgatgcatccactttgacaaggtcgggtaccatcgtaagttcaaggtgacagtgatcgtggacagtatttcactcncacatcacgntagtctacgacaactagaacttatttcgactaacttactactgttacaactagaacttacgacgtcgcccgtagtaccgttcgaccggtacggaccgtaaggtacggaaactacgaaacgacgttaggtacggactacgaccgacacgttntacg

SEQ ID NO: 287814 - DNA, 491 bp, Homo sapiens
  misc_feature: GYAE6OF02HZEI0.6.19.B08.1.454.CMB.1.raw
  modified_base (370)..(370): a, c, t, g, unknown or other
  misc_feature (370)..(370): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaaagccctaaactcctgatctatgatgcatccatttgcaaagtgggtcccatcaaggttcagtggcagtggatctgggacagatttcactctcaccatcagcagtcngcaacctgaagtattttgctaacttactactgtacaacagagttacagtgcccctcggaccgttcgacccgaagggaccaagggtggaaactcgaaacgactagtggctgcaccatctacg

SEQ ID NO: 287815 - DNA, 521 bp, Homo sapiens
  misc_feature: GYAE6OF02JUI16.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccaagggaaacgcccctaaactcctagatctatgatgcatccactttgacaaaggtcgggtaccatcgtaaaggttcagtggcaggtggatcgtggacagtatttcactctcacatcagcagtctgacaacctgtaagtatttagactaacttactactgtactaacagtagttacagtcgccctacggacgttcgaccgaggaccgtaaggtcggtaaacacgtaaacgtaactggtacggctacggctaacctagttctacg

SEQ ID NO: 287816 - DNA, 563 bp, Homo sapiens
  misc_feature: GYAE6OF02G88ZH.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacgcccctaaactcctgatctatgatgcatccactttgcaaagtgggtcccatcaaggttcagtggcagtggatcgtgggacagtatttcactctcaccatcagcagtctgccaacctgaagtatttcgactaacttactactgtacaacgtagtacgttacagttcgaccccgttcggtaaccgttccgggacccgtaaggggaccctaaggggtaacggtaaaacttaccgaaaacggtaaccgttagggttacgggtaccgttacggacccgtaaccgtacgttaccgttacgg

SEQ ID NO: 287817 - DNA, 502 bp, Homo sapiens
  misc_feature: GYAE6OF02G9O95.6.19.B08.1.454.CMB.1.raw
  modified_base (268)..(268): a, c, t, g, unknown or other
  misc_feature (268)..(268): n is a, c, g, or t
  modified_base (348)..(348): a, c, t, g, unknown or other
  misc_feature (348)..(348): n is a, c, g, or t
  modified_base (368)..(368): a, c, t, g, unknown or other
  misc_feature (368)..(368): n is a, c, g, or t
  modified_base (387)..(387): a, c, t, g, unknown or other
  misc_feature (387)..(387): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaancccctaaatcctagatctatgatgcatccatttgacaaagtgggtcccatcaaggttcagtggcagtggatcgtgggacngtatttcactctcacatcancagtctgacaactgaaatntttgacttaacttactactgtacaactagacgttacagttccgccccgtggaacgttcggaccaagggaccaagggtcgaaatccaaagacttgacggctggaccaccagtctcg

SEQ ID NO: 287818 - DNA, 499 bp, Homo sapiens
  misc_feature: GYAE6OF02GWS0Z.6.19.B08.1.454.CMB.1.raw
  modified_base (268)..(268): a, c, t, g, unknown or other
  misc_feature (268)..(268): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaancccctaaactcctgatctatgatgcatccactttgcaaaggtgggtcccatcaaggttcagtggcagtggatcgtgggacagtatttcactctcaccatcagcagtctgccaactgaacgtattttgactaacttactactgtaccaacagtattacagttcgcccctaggacgttcggaccagggaccagggtcgaaatccgaaacgtactgtcggctgacactatctcg

SEQ ID NO: 287819 - DNA, 547 bp, Homo sapiens
  misc_feature: GYAE6OF02IP4Y1.6.19.B08.1.454.CMB.1.raw
  modified_base (247)..(247): a, c, t, g, unknown or other
  misc_feature (247)..(247): n is a, c, g, or t
  modified_base (327)..(327): a, c, t, g, unknown or other
  misc_feature (327)..(327): n is a, c, g, or t
  modified_base (334)..(334): a, c, t, g, unknown or other
  misc_feature (334)..(334): n is a, c, g, or t
  modified_base (352)..(352): a, c, t, g, unknown or other
  misc_feature (352)..(352): n is a, c, g, or t
tcagatatcgcgagcacgaccggtgctcgatttagtgagtcagtaaggggagtcagtctcagtcaggacacagcatggacatgagggtccccgctcagctcctgggctcctgctactctggctccgagtgccagatgtgacatccagatgacccagtctccatcctccctgtctgcatctgtaggacacagagtcaccatcacttgccggcaagtcagagcattagcactattaattgtatcagganaatcaggaagccctaaactcctgatctatgatgcatccactttgacaaagtcgggtccatcaagttcagtgcagtgatcnggacagntttcgactctcacgactnagcagtctacgacaaccttgaaactattttcgacttaacttactaacttagtacaaacgtacgtaaagttacaagttccgtaccccgtcggaaccgttaccgtaccggaacgggtaacctaacggggtaggaaaacttacggaaaaccgtaacgtacgggttagacctaggtaccctaaccgtacgttacttacg

SEQ ID NO: 287820 - DNA, 535 bp, Homo sapiens
  misc_feature: GYAE6OF02HBOD4.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaaagcccctaaactcctgatctatgatgcatccatttgcaaagtgggtccatcaaggttcagtggcagtgatctgggacagtatttcactctcacatcagcagtctgccaactgaagtattttgactaaacttactactgtacaaactagtacgttaacagttcgcccccttgggaaccgtttccggacccgaaggggaccctaaagggtacggaaaacttaccgaaaacggtacgtggtacgggccttaggaccctaacccgattccgtacg

SEQ ID NO: 287821 - DNA, 516 bp, Homo sapiens
  misc_feature: GYAE6OF02IMTCH.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctattaaaattggtatcagagaatccagggaaagcccctaaatcctgatctatgatgcatccactttgacaaagtgggtccatcaaggttcagtggcaggtgatcgtgggacagtatttcactctcacatcagcagtctgcaacctgaagtatttgactaacttactactgtacaacagtagttacagttccgccccgtaggaccgttcgaccgaacgggaccgaaggtaacggaactacgaaaccgtaacgtaggtcggtacgtacgacacctagtcttacg

SEQ ID NO: 287822 - DNA, 513 bp, Homo sapiens
  misc_feature: GYAE6OF02ISWEF.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaactcctgatctatgatgcatccactttgcaaagtgggtcccatcaaggttcagtggcagtggatcgtgggacagtattttcacttcctcaccatcagcagtctgccaacctgaagtattttcgactaactttactactgtacaactagtagttacagtccgccccgtggaaccgttcggaccgaagggacctaaggtggaaactacgaaacgacgtggtaggctgcaaccatcgtcg

SEQ ID NO: 287823 - DNA, 547 bp, Homo sapiens
  misc_feature: GYAE6OF02I8KS6.6.19.B08.1.454.CMB.1.raw
tcagatatcgcgagcacgaccggtgctcgatttagtgagtcagtaagggggagtcagtctcagtcaggacacagcatggacatgagggtcccgctcagctcctgggctcctgctactctggctccgaggtgccagatgtgacatccagatgacccagtctccatcctccctgtctgcatctgtaggacacagagtcaccatcacttgccgggcaagtcagagcattagcacctatttaaattggtatacaggagaatccgaagggaaacgacccctaaaactcctagatctatgatgcatcactttgacaaagtgggtccatcaaggttcagtggcagtggatgtagggacaggatttcactctacaccatcagtcagtctcgtacaaccgtgaagtattttacgactaaactttaccacttagtcaaactagtagttaacagttacgtaccccgtaggacccgtttacggacctaagggtaccgaaacggtggtaaaactaccgtaaagaacctagttacggactacggtcaaccgtatccttacg

SEQ ID NO: 287824 - DNA, 525 bp, Homo sapiens
  misc_feature: GYAE6OF02F31XT.6.19.B08.1.454.CMB.1.raw
  modified_base (269)..(269): a, c, t, g, unknown or other
  misc_feature (269)..(269): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacncccctaaactcctgatctatgatgcatccactttgactaaagtcggggtcccatacgaaggttcagtggcaggtggatcgtgggacagtatttcactctcaccatcagcagtctgaccaacctgaaagtattttgactaacttactacttgtacaacagtacgttacagtccgccctcggtacgttccggaccgaagggaccgaagggtacggaaactaccgaaacgacgtaggtacggcgtagacacctatctcg

SEQ ID NO: 287825 - DNA, 558 bp, Homo sapiens
  misc_feature: GYAE6OF02JOGK7.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatacttgccggcaagtcagagcatagcacctattaaatgtaatcagtagaatccaggaaagccctaaactcctagactactatgatgacatccactttgactaagtgggtaccagtacaaggttcagtggactaggtggatcgtaggacaggtatttcactctacaccatcagcagtctagaccaacctgaagtattttacgactaacttactaactagtacctaacgtaacgtacgttaactacgttacgaccccgttacggtaccgttacggaccgtaacgggaccgtaacgggtaacggaaacgtacgaaaccgtaacgtagtacggtacgtacgacctaacacgttacgtacg

SEQ ID NO: 287826 - DNA, 505 bp, Homo sapiens
  misc_feature: GYAE6OF02IP944.6.19.B08.1.454.CMB.1.raw
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
  modified_base (366)..(366): a, c, t, g, unknown or other
  misc_feature (366)..(366): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagagcattagcacctatttaaattggatcagganaatcgaggaaancccctaaatcctgatctatgatgcatccctatttgacaaagtcgggccatcaagttcagtgcagtgatcgnggacngatttcactcncacatcagtcatcngacctacgtgaagtattttgactaacttactactgtacaactagtattacgagtccgccctggaaccgttcggacctaacgggcctaaagggtcgaaaatccgtaaacgacgtgtacggcttagacaccgtatcttacg

SEQ ID NO: 287827 - DNA, 563 bp, Homo sapiens
  misc_feature: GYAE6OF02I4TLU.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtagacacagagtcaccatcacttgccggcaagtcagagcattagcacctattaaattggtatcaggagaatcagggaaacgcccctaaactcctgatctatgatgcatcctactttgactaaaggtcgggtacccatacgaaggttcagtggcaggtggactcgtggacagtactttcactctacaccatcagctagtctgacctaaccgtgtaaagtattttagaccttaacttactaacttcgtaactaacgtaagtacgttacagttaccgtccccgtacggtaccgttaccggaccgaacgggtaccgtaaagggtaacggtaaactaacgtaaacgtacgtacggtacgtactcgtaccgacctacgtacttacg

SEQ ID NO: 287828 - DNA, 497 bp, Homo sapiens
  misc_feature: GYAE6OF02JUR9F.6.19.B08.1.454.CMB.1.raw
  modified_base (212)..(212): a, c, t, g, unknown or other
  misc_feature (212)..(212): n is a, c, g, or t
  modified_base (420)..(420): a, c, t, g, unknown or other
  misc_feature (420)..(420): n is a, c, g, or t
tcagatatcgcgagcacgaccggtgctcgatttagtgagtcagtaagggggagtcagtctcagtcaggacacagcatggacatgagggtcccgctcagctcctgggctcctgctactctggctccgaggtgccagatgtgacatccagatgacccagtctccatcctcctgtctgcatctgtaggacacagagtcaccatcacttgccgggnaagtcagagcattagcacctatttaaattggtatcaggtagaatccagggaaagccctaaatcctagatctatgatgcatcactttgacaaagtcgggtccatcagttcagtgcagtgatcgtggacagtatttcactctcacatcagcagtctgcaacctgaagtatttgactaacttactactgtacaactagtagttacagttcncctacggacgttcgccgaggaccgaaggtacggaaactacgaaaccgtacgtagacggtacacgacactatcttacg

SEQ ID NO: 287829 - DNA, 501 bp, Homo sapiens
  misc_feature: GYAE6OF02FZ7OO.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtggggtcccatcaaggttcagtggcagtggatcgtgggacagatttcactctcaccatcagcagtctgcaactgaagtattttgctaacttactactcgtacaacagtagttacagtcgcccctcggaccgttcggaccagggaccaagggtagaaatacgaaacgacgtgtacggctacgacaccatcttcg

SEQ ID NO: 287830 - DNA, 491 bp, Homo sapiens
  misc_feature: GYAE6OF02GHKFZ.6.19.B08.1.454.CMB.1.raw
  modified_base (400)..(400): a, c, t, g, unknown or other
  misc_feature (400)..(400): n is a, c, g, or t
  modified_base (419)..(419): a, c, t, g, unknown or other
  misc_feature (419)..(419): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaatcctgatctatgatgcatccactttgcaaagtgggtccatcaagttcagtgcagtggatctggacagatttcactctcaccatcagcagtctgcaacctgaagtattttgactaacttactactntacaacagtattacagtcncccgtcggacgttcgccagggaccaagggtggaaactacgaaacgacgtgtaggctagcacctatcgttacg

SEQ ID NO: 287831 - DNA, 502 bp, Homo sapiens
  misc_feature: GYAE6OF02HN3HR.6.19.B08.1.454.CMB.1.raw
  modified_base (268)..(268): a, c, t, g, unknown or other
  misc_feature (268)..(268): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaancccctaaaactcctgatctatgatgcatccatttgacaaagtgggtcccatcaaggttcagtggcagtggatctgggacagatttcactctcaccatcagcagtctgcaacctgaagtattttgactaacttactacttgtacaacagagttacagttcgccccgtcggacgttcggaccagggaccaagggtgaaactacaaacgtaactggtacggctgacacctatcttcg

SEQ ID NO: 287832 - DNA, 536 bp, Homo sapiens
  misc_feature: GYAE6OF02HH4AE.6.19.B08.1.454.CMB.1.raw
  modified_base (269)..(269): a, c, t, g, unknown or other
  misc_feature (269)..(269): n is a, c, g, or t
  modified_base (396)..(396): a, c, t, g, unknown or other
  misc_feature (396)..(396): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacncccctaaaactcctagatctatgatgcatccactttgactaaaggtcgggtcccatcaaggttcagtggcagtggatcgtgggacagtatttcactctcaccatcagcagtctgacaacctgaaatnttttagactaaactttactactagtacaaacagtagttaaccagtccgtcccgtcggaccgttcggaccgaagggaccgaagggtacggaaactacgaaacgtaacgtggtacggtacctacgaccaccgtatcgttacg

SEQ ID NO: 287833 - DNA, 602 bp, Homo sapiens
  misc_feature: GYAE6OF02HTDCR.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctcctgtctgcatctgtaggacacagagtcaccatcacgttgccggcaagtcagagcattagcacctattaaatggtatcaggagaatccaagggaaacaccctaactccgtagatctatgatgcactcctactttgacgtaaaggtcggggtaccctaataccgtaaaggtttacaaggttcggactaggtacggatccgtaggggaactacgtatttaccgtacctctaccaaccatacgaacgtctaagtcctgaaccctaaacttggtaaagtttactttacgaactaactttaactacctgtaacaaactagtaacgttacacgttccgaccccgtggtaaccgttacccgggtacgaacgggtaccgtaaagggtacgaaacgttacaaaacgggttaccaggttcggactagactacctatcgttacg

SEQ ID NO: 287834 - DNA, 550 bp, Homo sapiens
  misc_feature: GYAE6OF02GIRXO.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagccctaaaactcctgatctatgatgcatccactttgacaaagtggggtcccatcaaggttcagtggcagtggatcgtgggacaggtatttcactctacaccatcagcagtctgacacctgaagtattttgactaactttactaacttgtacaactagaagttacaagtacgtccccctaggtaccgttcggtacccgaacgggtaccgaacgggtaacggaaacttaccgaaaaccggtaacgttacggtaggaccgttacggacctacccagtaccttacgg

SEQ ID NO: 287835 - DNA, 548 bp, Homo sapiens
  misc_feature: GYAE6OF02FZLZ5.6.19.B08.1.454.CMB.1.raw
  modified_base (388)..(388): a, c, t, g, unknown or other
  misc_feature (388)..(388): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaaagcccctaaatcctgatctatgatgcatcctactttgctaaagtgggtcccatcaaggttcagtggcagtggatcgtgggacagtatttcactctcaccatcagcagtctgacaacctgaatntttagactaacttactactgtacaatagtagttacagttccgaccccgttacggtaccgttaccggaccgtaacggggaacccaaggggtaacggaaaacttaccgaaaaccggtaaccgttaggtacggtacgtacggaccaaccctagttccgttacg

SEQ ID NO: 287836 - DNA, 489 bp, Homo sapiens
  misc_feature: GYAE6OF02G5NL4.6.19.B08.1.454.CMB.1.raw
  modified_base (338)..(338): a, c, t, g, unknown or other
  misc_feature (338)..(338): n is a, c, g, or t
  modified_base (420)..(420): a, c, t, g, unknown or other
  misc_feature (420)..(420): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctattaaatggtatcaggagaatccagggaaagccctaaactcctgatctatgatgcatccactttgacaaagtgggtccatcaaggttcagtgcagtggatcgngggacagatttcactctcacatcagcagtctgcaacctgaagattttgactaacttactactgtacaacagagttacagtcnccctggacgttcgaccgaggaccgaaggtcggaaatacgaaacgaactggtacgactgacactatctcg

SEQ ID NO: 287837 - DNA, 517 bp, Homo sapiens
  misc_feature: GYAE6OF02GNUJD.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtgggtcccatcaaggttcagtggcagtggatcgtgggacagatttcactctcaccatcagcagtctgcaacctgaatattttgactaacttactactgtacaacagtacgttacagttcgcccgtcggaccgttcggaccgaacgggaccgaagggtacggaaactaccgaaacgtaacgtaggtacggctacgaccactacgtctacg

SEQ ID NO: 287838 - DNA, 493 bp, Homo sapiens
  misc_feature: GYAE6OF02FH7ED.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtcgggtcccatcaaggttcagtggcagtggatcgtgggacagtatttcactctcaccatcagcagtctgcaacctgaagtattttgactaacttactactgtacaactagagttacagtcgcccctcggacgttcggccgagggaccaaggtaggaatacgaaacgactgtgctgcactatctcg

SEQ ID NO: 287839 - DNA, 511 bp, Homo sapiens
  misc_feature: GYAE6OF02GIJ0F.6.19.B08.1.454.CMB.1.raw
  modified_base (268)..(268): a, c, t, g, unknown or other
  misc_feature (268)..(268): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaancccctaaactcctgatctatgatgcatccactttgactaaagtcgggtcccatcaaggttcagtggcagtgatcgtgggacagtatttcactctcacatcagcagtctgacaaccgtgtaagtattttacgctaacttactactgtacaacagtagttacagtcgccctcggaccgttcgaccgacggacaagggtaggaaactacgaaacgtaacgtgtacggctagaccacctagtcttcg

SEQ ID NO: 287840 - DNA, 582 bp, Homo sapiens
  misc_feature: GYAE6OF02IN3GB.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacgcccctaaaactcctgatctatgatgcatccactttgcaaaggtgggccatcaagttcagtggcagtggatcgtgggacagtatttcactctcaccatcagctagtctgacaaccgtgaaagtattttagaccttaaactttactacttacgtactaaacgagtaacgttaacgacgtccgtaccccgttcggtaaccggtttccggaaccgtaacggggaaccgtaaaggggtacggtaaaacgttaccgaaaaaccggtaacgttacggttacgggacgttaccggacccgaacccgtacgttccttaccgg

SEQ ID NO: 287841 - DNA, 549 bp, Homo sapiens
  misc_feature: GYAE6OF02HPPZ1.6.19.B08.1.454.CMB.1.raw
  modified_base (361)..(361): a, c, t, g, unknown or other
  misc_feature (361)..(361): n is a, c, g, or t
tcagatatcgcgagcacgaccggtgctcgatttagtgagtcagtaagggggaggtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagagcattagcactatttaaaattggtatcaggagaatccgaggaaacgccctaaactcctagatctatgatgcatccatttgacaaaggtcgggtccatcaagttcagtggcagtgaatgtgggacagtatttcacttcncacatcagctagtctacgacaaccgtgaagttatttagactaaattactatcgtaacaacagtaacgttacagttacgccccgtaggtaaccgttccgaccgaacgggaaccgaacgggtaaggaaacgttacgaaaaccgtaaacgttcggtacggtaccgtagccggtaaacctacgtcgttaccg

SEQ ID NO: 287842 - DNA, 518 bp, Homo sapiens
  misc_feature: GYAE6OF02HKJB7.6.19.B08.1.454.CMB.1.raw
  modified_base (250)..(250): a, c, t, g, unknown or other
  misc_feature (250)..(250): n is a, c, g, or t
  modified_base (382)..(382): a, c, t, g, unknown or other
  misc_feature (382)..(382): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcactattaaatgtatcaganaatccaggaacgcccctaaatcctagatctatgatgcatccatttgacaaaggtcgggtccatcaaggttcagtggcagtgatcgtgggacagtatttcactctcaccatcagcagtctgacaactgaagtntttgacctaactttactacttgtactaacagtagttaacacgttcgaccccgtggaccgttacggaccgaacggggaccaagggtaggaaacttacgaaaacgtacgtaggtacggctacgaccacgtactactcg

SEQ ID NO: 287843 - DNA, 502 bp, Homo sapiens
  misc_feature: GYAE6OF02GUFJ0.6.19.B08.1.454.CMB.1.raw
  modified_base (386)..(386): a, c, t, g, unknown or other
  misc_feature (386)..(386): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaactcctgatctatgatgcatccactttgcaaagtgggtcccatcaaggttcagtggcagtggatctgggacagatttcactctcacatcagcagtctgcaacctgaagtnttttcgactaacttactactgtacaacagtagttaacagttcgcccctcggacgttcggaccagggaccgaagggtacgaaatcgaaaacgactagtcggctgacacctatctacg

SEQ ID NO: 287844 - DNA, 506 bp, Homo sapiens
  misc_feature: GYAE6OF02F60XA.6.19.B08.1.454.CMB.1.raw
  modified_base (413)..(413): a, c, t, g, unknown or other
  misc_feature (413)..(413): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacgcccctaaactcctgatctatgatgcatccactttgactaaaggtcgggtcccatcaaggttcagtggcagtggatcgtgggacagtactttcactctacacatcagcagtctgacaactgaagtattttgactaacttactactntacaacagtagttacagtcgcccgtcggaccgttcgaccgaaggaccgaaggtacggaatacaaacgtacgtagtcgctagcacgtatcgtcg

SEQ ID NO: 287845 - DNA, 514 bp, Homo sapiens
  misc_feature: GYAE6OF02H6JL7.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagccctaaactcctgatctatgatgcatccactttgacaaagtgggtccatcaagttcagtgcagtgatcgtgggacagtatttcactctcaccatcagcagtctgcaacctgaagtatttgactaacttactactgtacaaacagagttacagttcgccccgtacggtaccgttacggaccaacgggaccgaagggtcggaaatacgaaaacgactaggtcggtactcgaccacctactcgttaccg

SEQ ID NO: 287846 - DNA, 529 bp, Homo sapiens
  misc_feature: GYAE6OF02ICE8O.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctattaaatggtatcagagaatcaggaacgccctaaactcctagatctatgatgcatccatttgacaaagtgggtccatacaaggttcagtggcagtggatcgtagggacagatttcactctcaccatcagcagtctagccaacctgaagtatttagttttacaactttactactgtacaacagtaacgttacacgtccgtaccccgtcgggtaccgttcggaccgaacgggacccgaaagggtacggaaatacgaaaacgaacgttaggtacggactacgaccacctagtctacg

SEQ ID NO: 287847 - DNA, 519 bp, Homo sapiens
  misc_feature: GYAE6OF02G8E94.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatcaaggaaacgcccctaaactcctgatctatgatgcatccactttgacaaaggtcgggtcccatcaaggttcagtggcagtggatcgtgggacagtatttcactctcaccatcagcagtctgacctaaccgtgaaagtattttcgactaaacttactactgtacaacagtacttacagttcgcccgtggtaccgttcgaccgacgggaccgaagggtacggaaatacgaaacgacgtagtcggctacgacacctagtctacg

SEQ ID NO: 287848 - DNA, 528 bp, Homo sapiens
  misc_feature: GYAE6OF02G2PLF.6.19.B08.1.454.CMB.1.raw
  modified_base (343)..(343): a, c, t, g, unknown or other
  misc_feature (343)..(343): n is a, c, g, or t
  modified_base (392)..(392): a, c, t, g, unknown or other
  misc_feature (392)..(392): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggacaagtcagagcattagcacctattaaatggtatcagagatcaggaagaccctaaactcctgatctatgatgcatcctactttgacaaaggtcgggtaccagtcaaaggttcagtggcagtggatcgnggacagtatttcgactcgtcactatcagctgtctagccaactagaagtntttagactaacttactactgtacaacgtagtaagtacgagtccgtcccgtacggtacgtcggaccgaacgggacgtaacgggtaggtaaacaaccgaaacgtacgtggtacggcctacggaccaccgtatcgtacg

SEQ ID NO: 287849 - DNA, 539 bp, Homo sapiens
  misc_feature: GYAE6OF02F9QOG.6.19.B08.1.454.CMB.1.raw
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
  modified_base (283)..(283): a, c, t, g, unknown or other
  misc_feature (283)..(283): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctattaaatggtatcagganaatcgaggaanccctaaactcctgatctangatgcatcctactttgacaaaggtcgggtacccatcgaaggttcagtggcaggtggatcgtagggacagtatttcactctcacctatacagcagtctcgacaacctgaagtattttgacctaactttactacttgtacaaacgagtaacgttacgacgtcgtcccgtacggtacgttccggaccgaacggggaccaagggtaacggaaactacgaaacgtaacgtaggtacggcgtacgaccaccgtactcttacg

SEQ ID NO: 287850 - DNA, 524 bp, Homo sapiens
  misc_feature: GYAE6OF02IVGF7.6.19.B08.1.454.CMB.1.raw
  modified_base (416)..(416): a, c, t, g, unknown or other
  misc_feature (416)..(416): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctattaatggtatcagagaatccaggaacgaccctaaactcctagatctatgatgcactcctatttgacgaaagtcgggtacccatacaaggttcaggtgcgagtggatcgtaggacagtatttcactctacaccatcagcagtctgaccaaccgtgaagtatttacgactaacttactactntacaactagtattacgacgtcgcccgtacggtacgttccggacaacgggacgaaggtggaaactacgtaaacgacgtaggtacggtctaggacaaccgtatacttacg

SEQ ID NO: 287851 - DNA, 538 bp, Homo sapiens
  misc_feature: GYAE6OF02FW4WW.6.19.B08.1.454.CMB.1.raw
  modified_base (269)..(269): a, c, t, g, unknown or other
  misc_feature (269)..(269): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacncccctaaactcctgatctatgatgcatccactttgactaaaggtcgggtacccatacgaaggttcagtggcagtggatcgtggacagtatttcactctcaccatcagcagtctgacaacctgaagtatttgactaacttactactgtacaacagtagttacagttcgccccgtacggtacgttccggaccgaacgggaccgtaagggtaacggaaacgtaccgaaacgtaacgtggtacggtcgtacgaccgtaacctagtccttaccg

SEQ ID NO: 287852 - DNA, 513 bp, Homo sapiens
  misc_feature: GYAE6OF02F52X7.6.19.B08.1.454.CMB.1.raw
  modified_base (268)..(268): a, c, t, g, unknown or other
  misc_feature (268)..(268): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaaacncccctaaactcctgatctatgatgcatccactttgacaaaggtcgggtcccatcaaggttcagtggcagtgatcgtgggacagtatttcactctcaccatcagcagtctgaccaacctgaagtattttgactaacttactactgtaccaatagagttacgagtccgtacccgtcggtacgtcgaccgacggaccgaaggtacggaaactacgaaacgaacgtagtcggactcgacactactctcg

SEQ ID NO: 287853 - DNA, 590 bp, Homo sapiens
  misc_feature: GYAE6OF02HEBNS.6.19.B08.1.454.CMB.1.raw
  modified_base (271)..(271): a, c, t, g, unknown or other
  misc_feature (271)..(271): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccaggcaagtcagagcattagcacctatttaaattggtatcaggagaatccgaagggaaacncccctaaactcctagatctatgatgcactcctactttagacgtaaaggtcgggtaccctagtacgtaaggttcaggtcggactaggtggtatcgtgggaactagtactttcacctctaccaacctatacacgtactacgttctacgacctaaccgtaggtaacgttattttacgaccttaacttacttactcgtaacaacgtagtacgttaacgacgtccgaccccgtaggtaccgttccggaccgtaacgggtaaccggtaagggtaacgaaacgtaaccgaaaccgtagtcggtacggctacggaccacctattccg

SEQ ID NO: 287854 - DNA, 521 bp, Homo sapiens
  misc_feature: GYAE6OF02HXGFC.6.19.B08.1.454.CMB.1.raw
  modified_base (391)..(391): a, c, t, g, unknown or other
  misc_feature (391)..(391): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctaatttaaattggtatcaggagaatccaaggaaagcccctaaactcctgatctatgatgcatccactttgactaaagtcgggtccatctaaggttcaggtgacagtggatcgtgggacagtatttcactctcaccatcagctagtctgaccaacctnaaagtattttcgactaacttactacttgtaccaactagaagttacagttcgacccgtcggacgttcgggaccaacgggaccaagggtaggaaactacgaaacgaacgtgtacggctgaccactactctcg

SEQ ID NO: 287855 - DNA, 607 bp, Homo sapiens
  misc_feature: GYAE6OF02G2Y0Z.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcactattaaatgtatcagagaatccgaggaaacgccctaaactcctagactctatgatgctactcctactttagacgtaaaaggtcggggtacccaatcgaaggttcaagtggcaggtggatcgtgggaacagtactttcactctacaccatacacgctaagtcctagacctaacctggaaacgttattttacgaccttaaactttactaacttcgtaacaaactacggtaacgtttacgacggttccgaccccgttacggaaccgtttaccgggaacccgtaaggggtaacccgtaaaggggttaacggtaaaacgtaccgaaaaccgtaacgttggtacgggtacctacggacctaaccgtacgttacttaccgg

SEQ ID NO: 287856 - DNA, 498 bp, Homo sapiens
  misc_feature: GYAE6OF02FWTU5.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggcaagtcagagcattagcacctatttaaatggtatcagagaatccaggaaagccctaaactcctagatctatgatgcatcctactttgactaaagtgggtacccagtcaagttcagtggctagtgatcgtggacagtactttcactctacaccatcagcagtctgccaactagaagtatttcgactaacttactactgtacaactagaagttacagtcgcccctcggtacgtcggaccgacggacaaggtacgaactacgaaacgaactgtgctagcactatctcg

SEQ ID NO: 287857 - DNA, 559 bp, Homo sapiens
  misc_feature: GYAE6OF02J2FMQ.6.19.B08.1.454.CMB.1.raw
  modified_base (401)..(401): a, c, t, g, unknown or other
  misc_feature (401)..(401): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcgaccatcacttgccgggcaagtcagagcattagcacctatttaaatggtatcaggagaatccgagggaaacgcccctaaaactcctaggatctaagtcgatcgacattccactttgacgaaagtcgggtacccatacgaaggttcagtcgcaggtggatcgtaggacagtatttcactcacacatcagcagtcagcaacgtanaagtatttagactaacttacgactgtacaactagtaagttacagttccgacccgttacgggtaaccgttacggaccgtaacgggaacctaacgggtaacggaaacgtaacgtaaaccgtaacgtacggtacggacgtcgacctacgtactacgttacg

SEQ ID NO: 287858 - DNA, 562 bp, Homo sapiens
  misc_feature: GYAE6OF02HYGM9.6.19.B08.1.454.CMB.1.raw
  modified_base (265)..(265): a, c, t, g, unknown or other
  misc_feature (265)..(265): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcactatttaaatggtatcagagaatccagggaaanccctaaactcctagatctatgatgcatcctactttgactaaaggtgggtacccagtacaaggttcagtggcagtggatcgtagggacagtactttcactctacacatcagcagtctgaccaacctagaagtatttagtactaacttctaaaaaactcgtacaactaagtaacgttaacgtacgtacgtccccgtccggtaaccgttacgggtaccgaacgggaaccgtaacgggtaaggtaaacgtaacgaaacgtaaacgtacggtacggacgtacgtaccacctactacgttacg

SEQ ID NO: 287859 - DNA, 543 bp, Homo sapiens
  misc_feature: GYAE6OF02HGSC8.6.19.B08.1.454.CMB.1.raw
  modified_base (267)..(267): a, c, t, g, unknown or other
  misc_feature (267)..(267): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccaggaaanccctaaaactcctgatctatgatgcatccactttgcaaagtgggtcccatacaaggttcagtggacagtggatcgtgggacagtatttcactcccacatcagcatctcgcaacctacgaagtactttacgtactaacttacttactgttacaacacgtaagttactacgtacgcccgtccggtacgtaccggtccgaacgggaccgaacggtacgggaaacgtaacgaaacgtaacgttacgtaggtacgtacgacgaccctacgtactgttaccg

SEQ ID NO: 287860 - DNA, 494 bp, Homo sapiens
  misc_feature: GYAE6OF02GKFKG.6.19.B08.1.454.CMB.1.raw
  modified_base (491)..(491): a, c, t, g, unknown or other
  misc_feature (491)..(491): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaactcctgatctatgatgcatccactttgctaaagtgggtcccatacaagttcagtggcagtggatctgggacagatttcactctcaccatcagcagtctgcaactgaatattttgctaactttactactgtacaacagtagttacagtcgccctcggacgttcggaccaaggaccgaaggtcggaaatacgaaacgactgtaggctagccacatntcg

SEQ ID NO: 287861 - DNA, 763 bp, Homo sapiens
  misc_feature: GYAE6OF02I3E6L.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagatcaccatctacttggccggacaagtcagagctattagcaaccttaatttaaattggtatcgaggagaatccgaagggaaacgacccctaaactcctagatctatgatgcatcctactttgacgtaaaggtcgggtacccagtacgtaaacgggtttcaaggtcggacgtaggttaggaacttcggtacgggaacgtaaggttacttttaccgaaccttcccgttacaacccctaagttacccgaacggtaccttaaacggttccttacggaacccctaaaacccggtttaggtaaaacgtttacggtttttaacgaacccttaaaaccgttttaacccgttaacgtttaacggttaaccctaaaaccggttaacggttaaacgttttaaccggtaaccgtttaccccggtaccccggtttaacccgggggtaccgtttacccggggaacccggttaaacgggggtaacccgtaaacgggggtttaaccggaaaactaaacccggtaaaaccggtaacgttacggtacgggtacccgtacggaccctaaccgtacttcccgttaaccgg

SEQ ID NO: 287862 - DNA, 554 bp, Homo sapiens
  misc_feature: GYAE6OF02HN6S5.6.19.B08.1.454.CMB.1.raw
  modified_base (267)..(267): a, c, t, g, unknown or other
  misc_feature (267)..(267): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcagagaatccagggaaacnccctaaactcctgatctatgatgcatccactttgacaaagtcgggtcccatcaagttcagtggcagtgatcgtggacagtatttcactctcaccatcagcagtctgacaactagaattatttagacctaaacttactacttagtaccaaacgtagtacgttacgaagttccgaccccgttcggaccggtttacccgggaccgtaacggggaccgtaaacggggtacggaaaacgtaccggaaaacgtaaccgtggtacgggtccttacgacctacctatccgttacg

SEQ ID NO: 287863 - DNA, 521 bp, Homo sapiens
  misc_feature: GYAE6OF02HTWOS.6.19.B08.1.454.CMB.1.raw
  modified_base (268)..(268): a, c, t, g, unknown or other
  misc_feature (268)..(268): n is a, c, g, or t
tcagatatcgcgagcacgaccggtgctcgatttagtgagtcagtaagggggagccagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaancccctaaactcctgatctatgatgcatccactttgcaagtgggtccatcaaggttcagtggcagtgatctgggacagatttcactctcaccatcagcagtctgcaacctgaacgtattttgactaaacttactactgtacaaacagtagttacacgttcgaccccgtcggaccgttccggaccgaacgggaccgtaaggtacggaaactcgaaaacgtaacgtggtacggactacgaccacctacgtcttacg

SEQ ID NO: 287864 - DNA, 554 bp, Homo sapiens
  misc_feature: GYAE6OF02IPNKQ.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccaagggaaagcccctaaaactcctgatctatgatgcatccatttgacaaaggtcgggtcccatcaaggttcagtggcagtggatctgggacagatttcactctcaaccatcagcagtctagccaacctgaagtatttcgactaactttactactgtacaactagtagttaaccagtccgtaccccgtcggtaaccggttccggacccgtaacggggaaccgtaagggtaggtaaaactaccgaaaacggaaccgttagggtacggtccgtaggacccaaccgtagttccttacgg

SEQ ID NO: 287865 - DNA, 577 bp, Homo sapiens
  misc_feature: GYAE6OF02GB1IE.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatcagggaacgcccctaaactcctgatctatgatgcatcctactttgactaaaggtcggggtcccaagtacaaagggtttcaaggttggacgaggtggatcgtgggacagtatttcactctacacctatcagctagtctcgacacctagaacgtattttagacttaacttactactagtacaacgagtaagttacagttccgaccccgtcggtaaccggttccggacccgtaacgggaaccgtaagggtaacggtaaaacgtaccgaaaaccgtaacgtacggttacggacgttacgaccgtaacctacttccgttaacgg

SEQ ID NO: 287866 - DNA, 542 bp, Homo sapiens
  misc_feature: GYAE6OF02GRF8P.6.19.B08.1.454.CMB.1.raw
  modified_base (253)..(253): a, c, t, g, unknown or other
  misc_feature (253)..(253): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatgtatcagganaatccaagggaaacgcccctaaactcctgatctatgatgcatccactttgacaaaggtgggtcccatcaaggttcagtgcagtgatctgggacagtatttcactctcaccatcagcagtctgaccaacctgaaagtattttgactaacttctaactgtacaacagtagttacagttcgccccgtggaccgttcggaccgtaacgggaccgtaaagggtacggaaaacttaccgaaaacggtaacccgttagggtacggtaccgttcggacctacctacgttccttacgg

SEQ ID NO: 287867 - DNA, 532 bp, Homo sapiens
  misc_feature: GYAE6OF02JD44Y.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctattaaattggtatcaggagaatccaagggaaagcccctaaactcctgatctatgatgcatccactttgcaaagtggggtcccatctaaggttcagtggctagtggatcgtgggacagtacttttcacttccgtcaaccgtatccagtcagtctcggacaacctgaaagtattttcgactaacttactactgtacaactagagttacagtccgacccgtcggaccgttccgaccgtaagggaccgtaagggtaggaaactacgaaacgtaactagtacggtctcgctaccatcgtacg

SEQ ID NO: 287868 - DNA, 566 bp, Homo sapiens
  misc_feature: GYAE6OF02HU27J.6.19.B08.1.454.CMB.1.raw
  modified_base (215)..(215): a, c, t, g, unknown or other
  misc_feature (215)..(215): n is a, c, g, or t
  modified_base (414)..(414): a, c, t, g, unknown or other
  misc_feature (414)..(414): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttggccggnaagtcagagcattagcacctaatttaaatggtatcaggagaatccgaagggaaacgacccctaaactcctagactctatgatgcatcctactttgacgtaaaggtcgggtacccatcgtaaggttcaggtggctaggtggatcgtagggactagtatttcactctacacctatcagctagtctagacaactagaagttntttagacttaacttactactgtacaacgtagtacgttacacgtccgtcccgtacggtaccgttccggaccgaacgggaccgtaagggtaacggtaaacgtaccgaaaacggtaaccgttggtacggacgtacgacctaacctacgttcttcg

SEQ ID NO: 287869 - DNA, 557 bp, Homo sapiens
  misc_feature: GYAE6OF02FVX7D.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcaccttatttaaattggtatcaggagaatccgaagggaaacgcccctaaatcctagatctatgatgcatcctatttgactaaaggtcgggtacccagtacgtaaggttcaggtggctaggtggatcgtagggacagtatttcactctacaccatcagctagtctagacctaacctgtaaacgtattttagacttaacttactactagtacaactagtagttacacgttccgccccgtacggtaccgttaccggaccgtaacgggaaccgaagggtacggaaactaccgaaacgtaacgtggtacggactacgaccacctactctcg

SEQ ID NO: 287870 - DNA, 508 bp, Homo sapiens
  misc_feature: GYAE6OF02G42TU.6.19.B08.1.454.CMB.1.raw
  modified_base (214)..(214): a, c, t, g, unknown or other
  misc_feature (214)..(214): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggnaagtcagagcattagcactatttaaatggtatcagagaatccagggaaagcccctaaatcctagatctatgatgcatcctatttgacaaaggtgggtcccatcaagttcagtgcagtgatctgggacagtatttcactctacacatcagcagtctgacactgaagtattttcgctaacttactactgtaccaactagtaacgttacacgtcgtacccctacggacgttcggacctaacgggaccaaggtcggaaactacgaaacgaactggtacgcgtcgacacctatcttacg

SEQ ID NO: 287871 - DNA, 501 bp, Homo sapiens
  misc_feature: GYAE6OF02ILCY6.6.19.B08.1.454.CMB.1.raw
  modified_base (497)..(497): a, c, t, g, unknown or other
  misc_feature (497)..(497): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaagcccctaaatcctgatctatgatgcatccatttgcaaagtgggtccatcaagttcagtgcagtggatcgtggacagatttcactctcaccatcagcagtctgacaacctgaacgtattttgactaacttactactgtacaacagtagttacagtcgtccctacggtacgttcgaccgacggaccgaaggtacggtaaatacgaaacgaacgtagtcggcgtcgcactactntacg

SEQ ID NO: 287872 - DNA, 549 bp, Homo sapiens
  misc_feature: GYAE6OF02IPLIH.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctcctgtctgcatctgtaggacacagagtcaccatcacttgccgggcaagtcagagcattagcacctattaaatggtatcaggagaatccaagggaaagcccctaaaactcctgatctatgatgcactccactttgcaaagtgggtacccatcgaagttcagtgcagtggatcgtgggacagtatttacactctacacatcagcagtctgacaaccgtagaagtattttcgactaaactttacctatacgtacaacgtaagtagttaacagtccgccccgttacggtaaccgttccgggaccgaacgggaccgtaaagggtcggaaaactacgaaaccgtaacgtaggtacgggccttaggacctaccctagtaccttacgg

SEQ ID NO: 287873 - DNA, 633 bp, Homo sapiens
  misc_feature: GYAE6OF02I70D7.6.19.B08.1.454.CMB.1.raw
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctcctgtctgcatctgtaggacacagagtcaccatcacttgccgggcaagtcagagcattagcaacctatttaaatggtatcagganaatccgaagggaaacncccctaaatcctagatctatgatgacatccctactttgacgtaaaggttcgggtacccagtacgaaggtttcaggttggacaggtgatcgtggacagtatttcactctacacatcacgctagtctcgacctaaccgtagtaaacgttacgttttacgaaccttaaaccgtttacctaacgttacggttaaccaaacgtaagtaacgtttaaccgacgttacccgtaccccgttaccgggtaaccgtttaccgggaacccgtaacggggtaaccgtaaacgggtaacggtaaaactaccggtaaaacggtaacgttacgggttacggtaccgttacggacccgtaaccgtacgttccgttaccg

SEQ ID NO: 287874 - DNA, 529 bp, Homo sapiens
  misc_feature: GYAE6OF02I3C12.6.19.B08.1.454.CMB.1.raw
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctattaaattggtatcaganatccagggaacnccctaaactcctgatctatgatgcatcctactttgactaaaggtcgggtcccatcgaaggttcaggtggcagtggatcgtgggacagtatttcactctacacatcagcagtctgcaacctgaagtattttacgactaacttactactgtacaacgtagtaacgttacagtccgtacccgtacggtacgttccggaccgacgggaccgtaagggtggaaactccgaaaacgtacgtaggtacgtcgtacgcctacctagtctacg

SEQ ID NO: 287875 - DNA, 498 bp, Homo sapiens
  misc_feature: GYAE6OF02FK5W1.6.19.B08.1.454.CMB.1.raw
  modified_base (417)..(417): a, c, t, g, unknown or other
  misc_feature (417)..(417): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaatcctgatctatgatgcatccactttgcaaagtgggtcccatcaaggttcagtggcagtggatcgtgggacagtatttcactctacaccatcagcagtctgcaacctgaagtattttcgactaacttactacttagtcaacngtattacagttcgcccctggaccgttcggacctagggaccaaggtgaaactacaaacgactgacggctagacactatctcg

SEQ ID NO: 287876 - DNA, 547 bp, Homo sapiens
  misc_feature: GYAE6OF02FF19A.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaatcctgatctatgatgcatccactttgcaaagtgggtcccatcaaggttcagtggcagtggatcgtggacagatttcactctcaccatcagcagtctagcaactgaacgattttgcctaacttactaacttcgtacaacgtagacgtttaacacgttcgcccctacggtaccgtttacggacccgtaagggaaccgtaagggtacggaaacgttaccgaaaaccggtaacgtacggtcgggtacctacggtactaacccgagtccgttacg

SEQ ID NO: 287877 - DNA, 489 bp, Homo sapiens
  misc_feature: GYAE6OF02FKMJL.6.19.B08.1.454.CMB.1.raw
  modified_base (417)..(417): a, c, t, g, unknown or other
  misc_feature (417)..(417): n is a, c, g, or t
  modified_base (484)..(484): a, c, t, g, unknown or other
  misc_feature (484)..(484): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaaactcctgatctatgatgcatccactttgacaaagtgggtccatcaaggttcagtggcagtgatctgggacagatttcactctcaccatcagcagtctgcactgaatatttgctaacttactactgtacaacagtagttacngtacgccctggacgttcggacctagggacaaggtaggaatacgaaacgaactgtcggctagcacctntctcg

SEQ ID NO: 287878 - DNA, 524 bp, Homo sapiens
  misc_feature: GYAE6OF02HYL9U.6.19.B08.1.454.CMB.1.raw
  modified_base (255)..(255): a, c, t, g, unknown or other
  misc_feature (255)..(255): n is a, c, g, or t
  modified_base (387)..(387): a, c, t, g, unknown or other
  misc_feature (387)..(387): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctaatttaaatggtatcagganaatccagggaaacgcccctaaactcctagatctatgatgcatcctactttgacaaaggtcgggtccctaatcgaaaggtttcaggtggcaggtggatcgtgggacagtatttcactctcacatcagcagtcncgcaacctgaagtattttagactaaacttactactgtacaacagtagttacagtctcccgtcggacgttcggaccaacgggaccaagggtaggaaactacgaaacgtacgtaggtcggactagaccacctatctacg

SEQ ID NO: 287879 - DNA, 496 bp, Homo sapiens
  misc_feature: GYAE6OF02GCSLK.6.19.B08.1.454.CMB.1.raw
  modified_base (386)..(386): a, c, t, g, unknown or other
  misc_feature (386)..(386): n is a, c, g, or t
  modified_base (493)..(493): a, c, t, g, unknown or other
  misc_feature (493)..(493): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtggggtcccatcaaggttcagtggcagtggatctgggacagatttcactctcaccatcagcagtctgcaacctgaagnttttgctaaacttactactgttacaacagagttaacagttcgcccctcggacgttcggaccgaagggaccaagggtcggaaatcaaacgaactgtggctgcaccatntcg

SEQ ID NO: 287880 - DNA, 543 bp, Homo sapiens
  misc_feature: GYAE6OF02F7HFJ.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaagcccctaaactcctgatctatcgatgcatccaatttgactaaagtcggggtacccagtacgaaggttcagtggcagtggatcgtggggacaggtactttcactctacacctattacagtcaagtctagccaaaccgtgaaagtattttacgactaacttactactgtacaacagtattacgcgttacgcccctaggtaccgttcgaccgtacgggaacctaagggtacgaaaatccgaaaacgacgttcgtcggacttacggcctaccgtatacctcg

SEQ ID NO: 287881 - DNA, 569 bp, Homo sapiens
  misc_feature: GYAE6OF02J0E1O.6.19.B08.1.454.CMB.1.raw
  modified_base (422)..(422): a, c, t, g, unknown or other
  misc_feature (422)..(422): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatccctccctgtctgcatctgtaggacacagagtcaccatcacttgccgggcaagtcagagcattagcacctatttaaattggtatcaggagaatccgaagggaaacgcccctaaaatcctagatactatgactgacatccaatttgacaaaggtcgggtacccagtcgaagtttcgagttggacgtagtggattcgtaggggacaggtatttcgactcctcaaccctatcgagcagtctggccaacctgaaacgtttntttacgacttaacttactacgtagtacaactagtacgttacacgtccgtacccgtggtaaccgttcggaccgacggtaacgtaagggtacggaaactacgaaaaccgtaacgtggtacggacgtacgaccgtaactattaccgtacg

SEQ ID NO: 287882 - DNA, 552 bp, Homo sapiens
  misc_feature: GYAE6OF02HSV4A.6.19.B08.1.454.CMB.1.raw
  modified_base (215)..(215): a, c, t, g, unknown or other
  misc_feature (215)..(215): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttggccggnaagtcagagcattagcacctatttaaattggtatcaggagaatccaagggaaacgacccctaaactcctagatactatgatgcatccactttgactaaagtcggggtaccagtctaaggttcaggtggactaggtaggtagtcgtagggaactagtatttcactactcaccatcacgctagtctgaccaactagtaagtatttgacctaactttactactagtacaactacgtaagttacagttcgcccgtacggtacgttccggaccgaacgggaccaagggtacgaaacgtaccgaaacgaacgtggtaggaccgtagacctaacgtactctacg

SEQ ID NO: 287883 - DNA, 533 bp, Homo sapiens
  misc_feature: GYAE6OF02FPOS8.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtgggtcccatcaaggttcagtggcagtggatctgggacagatttcactctacacatcagcagtctgcacctgagattttgactaacttactactgtacaactagaacgttacacgttcgccccttacggaccgttcgggacccgtaagggaacccgtaagggtaggaaaactccgaaaaccggtaactacggtacggaccttaggacctaccgtatcgttaccgg

SEQ ID NO: 287884 - DNA, 512 bp, Homo sapiens
  misc_feature: GYAE6OF02H1FNO.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccatttgcaaagtgggtcccatcaaggttcagtggcagtggatctgggacagatttcactctcaccatcagcagtctgcaacctgaagtattttgactaacttactactgtacaacagagttacagtcgccccgtcggtacgttccggacctaacgggaaccgtaaggtaggaaactacgaaacgtaacgtagtacggctagaccaacctatctacg

SEQ ID NO: 287885 - DNA, 539 bp, Homo sapiens
  misc_feature: GYAE6OF02FSHD8.6.19.B08.1.454.CMB.1.raw
  modified_base (424)..(424): a, c, t, g, unknown or other
  misc_feature (424)..(424): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagagcattagcaccttatttaaattggtatcaggagaatccgaagggaaacacccctaaactcctagactctatgatgcactcctactttgactaaaggtcgggtacccatacaaggttcagtggcagtggatcgtgggacagtatttcactctcaccatcagcagtctcgaccaacctgaagtattttgactaacttactactntacaacagtagttacacgtcctcccgtacggtaccgttcggaccgaacgggaccgaaggtacggaaactacgaaacgtacgttagtcggtacgtacgaccaaccgtatcgttacg

SEQ ID NO: 287886 - DNA, 553 bp, Homo sapiens
  misc_feature: GYAE6OF02H0Z42.6.19.B08.1.454.CMB.1.raw
  modified_base (401)..(401): a, c, t, g, unknown or other
  misc_feature (401)..(401): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtcctgcatctggtaggacacagagtaccacccatcacttcggccgggacaagtcagagctattagcacctaatttaaatggtatcaggagaatccaagggaaacgaccctaaactcctagatctatgatgcatacctactttgacaaaggttcggggaccctatacgaaggtttcgagtgcaggtgatcgtggacagtatttcactctacacctatcagacattccngaccaaccgtagaagttatttacgactaaactttacctactgtaccaaactagtaacgttacgagttccgtaccccgtggaaccgtttcggactaaccggacgaagggtagaaacgtacaaacgtaactgcggactagcgaacctatctacg

SEQ ID NO: 287887 - DNA, 514 bp, Homo sapiens
  misc_feature: GYAE6OF02IG1JQ.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccgaaggaaacgacccctaaactcctgatctaatgatgcatccatttgacaaagtgggcccatcaaggttcagtgcagtggatctgggacagtatttcactctcaaccatcagctagtctgacaacctgtaaagtattttgactaacttactactgtacaactagagttacagtcgtcccctaggaccgtacgaccgaacggaccgtaaggtacggaaatacgaaacgaacgtagtcggactcgacaccatctacg

SEQ ID NO: 287888 - DNA, 502 bp, Homo sapiens
  misc_feature: GYAE6OF02GN2IU.6.19.B08.1.454.CMB.1.raw
  modified_base (267)..(267): a, c, t, g, unknown or other
  misc_feature (267)..(267): n is a, c, g, or t
  modified_base (420)..(420): a, c, t, g, unknown or other
  misc_feature (420)..(420): n is a, c, g, or t
  modified_base (429)..(429): a, c, t, g, unknown or other
  misc_feature (429)..(429): n is a, c, g, or t
  modified_base (497)..(497): a, c, t, g, unknown or other
  misc_feature (497)..(497): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcacctattaaatggtatcaggagaatccagggaaancccctaaatcctgatctatgatgcatccactttgactaaagtgggtacccatcgaagttcagtggcagtggatcgtaggacagtatttcactctacacctatcagctagtctgaccaactgtaatattttagtaaacttactactagtacaanagtattacngtcgccctggacgtcgaccaggaccaggtaggaaactacgaaacgtacgtgtgactggaccactatcngttcc

SEQ ID NO: 287889 - DNA, 577 bp, Homo sapiens
  misc_feature: GYAE6OF02ICNRI.6.19.B08.1.454.CMB.1.raw
  modified_base (254)..(254): a, c, t, g, unknown or other
  misc_feature (254)..(254): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcactatttaaattggtatcagganaatccagggaaacgccctaaactcctagatctatgatgcatcctactttgacaaaggtcgggtccatcgaaggttcaggtggacaggtggattcgtaggggactagtattttcgacttcgtacacctatccaagtactagtctacgactaaaccctaggtaaacgttacttttaggaccttaaacctttaactactacgtacaaacgtagtacgttaacagtccgtccccgtaggtaccgtccggaccgaacgggtaaccgtaagggtacggtaaactacgaaacgtaacgtgtacggacgtacgaccgactacgtcttaccg

SEQ ID NO: 287890 - DNA, 544 bp, Homo sapiens
  misc_feature: GYAE6OF02HP3AD.6.19.B08.1.454.CMB.1.raw
  modified_base (405)..(405): a, c, t, g, unknown or other
  misc_feature (405)..(405): n is a, c, g, or t
  modified_base (536)..(536): a, c, t, g, unknown or other
  misc_feature (536)..(536): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacttatttaaattggtatcaggagaatccgaagggaacgaccctaaactcctagatctatgatgacatcctactttgactaaaggtcgggtacccatcgtaaggttcagtggactagtggatcgtagggacagtatttcacttcacaccatcagcagtctgacacgtagaagtntttcgactaacttactactacgtacaaacgtagtacgttaacagttccgccccgtcggtaaccgtcgaccgaagggaccaagggtggaaactacgaaaaccggtactaggtcggtacgtacgaccaacgtntcttacgg

SEQ ID NO: 287891 - DNA, 567 bp, Homo sapiens
  misc_feature: GYAE6OF02IMUR4.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatcgaggaaacgccctaaactcctgatctatgatgcatccatttgcaaagtcgggtcccatacaaggttcaggtgcagtggatcgtagggacagtatttcacttctaccaccatcagcagtctgaccaacctgaacgtatttcgaccttaaactttactacttcgtacaaacgtagtagttaacagtccgtccccgttacggtaaccgttccggaccgaacggggtaaccgaaagggtacggtaaaactaaccgtaaaaccgaacgttacggtacgggaccttacggacctaacccgtacgttaccgttaccg

SEQ ID NO: 287892 - DNA, 580 bp, Homo sapiens
  misc_feature: GYAE6OF02IMC0N.6.19.B08.1.454.CMB.1.raw
  modified_base (221)..(221): a, c, t, g, unknown or other
  misc_feature (221)..(221): n is a, c, g, or t
  modified_base (248)..(248): a, c, t, g, unknown or other
  misc_feature (248)..(248): n is a, c, g, or t
  modified_base (399)..(399): a, c, t, g, unknown or other
  misc_feature (399)..(399): n is a, c, g, or t
  modified_base (414)..(414): a, c, t, g, unknown or other
  misc_feature (414)..(414): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctcctgtctgcatctgtaggacacagagtcaccatcacttgccggcaagtcagancattagctactattaatgtatcagtanaatcgaagggaactcccctaaatcctagatctaatgatgacatacctatttgactaaaggtcgggtacccattacgaaggtttcaaggttcggactaggtggacttcgtagggaccagtactttcacgtactacacatcagctacgtctanccaactagtaaagtnttttacgaccttaattaactacttagtaaccaaacgtagtacgttaacgtacgtcggtaccccagggtaaccgttcgaaccgtacgggaacgtaacgggttaagaaacgttaaccgaaacgttaacgtacggttaggacgttacgaccgaaccgtactcttaaccg

SEQ ID NO: 287893 - DNA, 564 bp, Homo sapiens
  misc_feature: GYAE6OF02H4XBV.6.19.B08.1.454.CMB.1.raw
  modified_base (274)..(274): a, c, t, g, unknown or other
  misc_feature (274)..(274): n is a, c, g, or t
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttggccgggcaagtcagagcattagcaccttatttaaattggtaatcaggagaatccgaagggaaacnccctaaactcctagatctatgatgcatcctactttgactaaaggtcgggtacccatacgaagtttcaggtggacaggtgntcgngggactagtactttacactctacacctatcacgactagtctcgacctaaccgttagtaagttattttacgaaccttaacgttacctacttgtacctaaacgtagtacgtttaacacgttccgccccgtaggtaccgttcgaacgacgggacgtaaggtaacgaactaacgaaacgtaacgtggtacgctacgacactactcttacg

SEQ ID NO: 287894 - DNA, 570 bp, Homo sapiens
  misc_feature: GYAE6OF02HI48L.6.19.B08.1.454.CMB.1.raw
  modified_base (223)..(223): a, c, t, g, unknown or other
  misc_feature (223)..(223): n is a, c, g, or t
  modified_base (265)..(265): a, c, t, g, unknown or other
  misc_feature (265)..(265): n is a, c, g, or t
  modified_base (562)..(562): a, c, t, g, unknown or other
  misc_feature (562)..(562): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagngcattagcactatttaaatgtatcagagaatccaaggaaacncccctaaactcctgatctatgatgcactcctactttgactaaaggtcgggtaccagtacgtaaggttcaggtggacgtaggtagactcgtggaactagtactttcactctacacatcagtctagtctcgacctaaacgtagaacgttattttacgaaccttaaacgtttacctaacgttgtaaccaaacgtagtaacgttacacgttcccgtacccgtcggtaccgttaccgaccggaaggtaaccgaaggtacggaaactacgaaacgtacgttaggtacgactacgacctaactnttacgtcg

SEQ ID NO: 287895 - DNA, 622 bp, Homo sapiens
  misc_feature: GYAE6OF02JJTE4.6.19.B08.1.454.CMB.1.raw
  modified_base (251)..(251): a, c, t, g, unknown or other
  misc_feature (251)..(251): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttggccggcaagtcagagcattagcacctattaaatgtatcagganaatccaaggaacaccctaaacgtcctgactctatgatgtacatcctactttgacctaaaggtcggggtacccattacgaaaggtttcaggttacggcgtaaggtggtactcggttagggactaggtacttttacaccgttctaccaacctagtaccaagccgtagttactgaccctaacgtaggtaagtttactttagaccttaaaccgttactacttacgaccgtaaagtacctaacgttaaccgtaagtcccgtaccccgttcggtaaccgttccgggtaaccgaacgggtaaccgtaacgggtacggtaaaactccgaaaacgttacgtacggtacgtccgtaggtacccaccgtattaccgttacgg

SEQ ID NO: 287896 - DNA, 519 bp, Homo sapiens
  misc_feature: GYAE6OF02FNHIX.6.19.B08.1.454.CMB.1.raw
  modified_base (268)..(268): a, c, t, g, unknown or other
  misc_feature (268)..(268): n is a, c, g, or t
  modified_base (387)..(387): a, c, t, g, unknown or other
  misc_feature (387)..(387): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaancccctaaactcctgatctatgatgcatccatttgacaaagtgggtcccatcaaggttcagtggcagtgatctgggacagtatttcactctcacctatcagcagtctgcaacctgaagtnttttagactaacttactactgtacaactagtagttacagttccgccccgtacggaccgttcggaccgaacgggaccaagggtacggaaactaccgaaacgtactaggtacggcgtacgccacctatcgtacg

SEQ ID NO: 287897 - DNA, 538 bp, Homo sapiens
  misc_feature: GYAE6OF02HPDYZ.6.19.B08.1.454.CMB.1.raw
  modified_base (224)..(224): a, c, t, g, unknown or other
  misc_feature (224)..(224): n is a, c, g, or t
tcagatatcgcgagcacgaccggtgctcgatttagtgagtcagtaagggggaggtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagngcattagcacctattaaattggtatcagagaatccagggaaacgccctaaactcctagactctatgatgcatcctactttgacaaaggtcgggtcccatacgtaaggttcagtggacaggtggatctggggactagtattttcaactcctacacctatcagctagtacctgacctaaccgtagaaacgttattttacgactaaactttactactagtacaacagtattacgagtcgcccgtcgacgttcgaccacgggtacaacggtagaactacgaaacgtaacgtgtcgacgtcgaccgtacacgttctacg

SEQ ID NO: 287898 - DNA, 575 bp, Homo sapiens
  misc_feature: GYAE6OF02F97CX.6.19.B08.1.454.CMB.1.raw
  modified_base (268)..(268): a, c, t, g, unknown or other
  misc_feature (268)..(268): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccaagggaaacncccctaaactcctgatctatgatgcactcctactttgactaaaggtcgggtacccagtcaaggttcagtggcaggtggatcgtgggactagtactttcacttctacaccatccagctagtcctagacctaacgtgaacgtattttcgacctaacttactacttagtaccaacgtagtaagtttacgagttccgtaccccgtcggtaaccgttccgggaccgtaacgggtaccgaagggtacggaaacttaaccgaaaccggtaacgttcggtacgtaccgtacggtaccaaccggtactccgttacg

SEQ ID NO: 287899 - DNA, 529 bp, Homo sapiens
  misc_feature: GYAE6OF02HSBT1.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcttgctactctggctccgaggtgccagatgtgacatccagatgacccagtctccatcctccctgtctgcatctgtaggacacagagtcaccatcacttgccggcaagtcagagcattagcacctattaaattgtatcaggagaatccaggaaacgcccctaaactcctagatctaatgatgcatccactttgacaaaggtcggggtcccaagtacaaggtttcaggtggcagtggatcgtgggacagtatttcactctcaccatcagcagtctgacaacctagaagtatttgactaacttactactgtacaatagagttacagttcgcccctcggacgttccggaccgaacggggaacaacgggtaggaaacgtacgaaacgtaaccgttagtacggccgtagccaacctatcgttacg

SEQ ID NO: 287900 - DNA, 568 bp, Homo sapiens
  misc_feature: GYAE6OF02H2CEV.6.19.B08.1.454.CMB.1.raw
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
  modified_base (299)..(299): a, c, t, g, unknown or other
  misc_feature (299)..(299): n is a, c, g, or t
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
  modified_base (396)..(396): a, c, t, g, unknown or other
  misc_feature (396)..(396): n is a, c, g, or t
  modified_base (541)..(541): a, c, t, g, unknown or other
  misc_feature (541)..(541): n is a, c, g, or t
tcagatatcgcgagcacgaccggtgctcgatttagtgagtcagtaaggggaggtcgagtctcagtcaggacacagcatggacatgaggtccccgctccagctcctgggctcctgctactctggctccgaggtgccagatgtgacatccagatgacccagtctccatcctccctgtctgccaatctgtaggacacagagtcaccatcacttgccggcaagtcagancatagcactattaaatgtancagagaatccaggaaagccctaaaactcctgaactctaatgtatcgacataccntttacgacaaaggtacggggtcccaatccaaggttccagtggtacagtggattcagggacagtatttcactcnctaccatcacgtanacgttcgacncgaacctgtaaacgtattttacgacttaacttaactaacttagttaccaaacgtacgaacgtttacgaacgttcgacccccgtggtaaacccgttcggtaccaacgggtacgaacggtacggtaaagtacgaaactaaaccggtntaccgtaggtacgtacacgactatacg

SEQ ID NO: 287901 - DNA, 539 bp, Homo sapiens
  misc_feature: GYAE6OF02IXF33.6.19.B08.1.454.CMB.1.raw
  modified_base (253)..(253): a, c, t, g, unknown or other
  misc_feature (253)..(253): n is a, c, g, or t
  modified_base (536)..(536): a, c, t, g, unknown or other
  misc_feature (536)..(536): n is a, c, g, or t
tcagatatcgcgagcacgaccggtgctcgatttagtgagtcagtaagggggagtcagtctcagtcaggacacagcatggacatgagggtccccactcagctcctggggctcctgctactctggctccgaggtgccagatgtgacatccagatgacccagtctccatcctccctgtctgcatctgtaggacacagagtcaccgatcacttgccgggcaagtcagagcattagcacttattaatggtatcagganatcgagggaacgccctaaactcctgatctatgatgacatcctactttgacgtaaggtcgggtcccagtcgtaaggttcagtcggacgagtggatcgtgggacagtactttcactctcacatcagcagtctcgacactagtaatatttagactaacttactacttacgtacaactagtacgttacacgtccgtacccgtcggtaccgttcgggaccgtacgggaaccgtaagggtaacggtaaacgacgtaaacgtacgtaggtcggtactgacctactacgtntcg

SEQ ID NO: 287902 - DNA, 555 bp, Homo sapiens
  misc_feature: GYAE6OF02G4BLC.6.19.B08.1.454.CMB.1.raw
  modified_base (252)..(252): a, c, t, g, unknown or other
  misc_feature (252)..(252): n is a, c, g, or t
  modified_base (264)..(264): a, c, t, g, unknown or other
  misc_feature (264)..(264): n is a, c, g, or t
  modified_base (376)..(376): a, c, t, g, unknown or other
  misc_feature (376)..(376): n is a, c, g, or t
  modified_base (393)..(393): a, c, t, g, unknown or other
  misc_feature (393)..(393): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatgtatcaganaatcaggaaacnccctaaactcctagatctatgatgcatccatttgacaaaggtcgggtccatcgaaggttcagtggcaggtggatcgtaggacagtatttcactcctacaccatcagcagtcncgacaaccgtgaacttntttacgactaacttactactgtacaacgagtaagttacacgttccgtaccccgtacggtaaccgttccggaaccgtaacgggtaaccgtaaagggtacggtaaactaccgaaaaccgtaacgttaggtacggacctaccgacctaaccgtacttcgttaccg

SEQ ID NO: 287903 - DNA, 528 bp, Homo sapiens
  misc_feature: GYAE6OF02GV84I.6.19.B08.1.454.CMB.1.raw
  modified_base (263)..(263): a, c, t, g, unknown or other
  misc_feature (263)..(263): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcagagaatcaggaancccctaaatcctgatctatgatgcatccatttgactaaaggtcgggtcccatcaaggttcagtggcagtggatcgtgggactagtatttcactcacaccatcagcagtctgacaaccgtgaatatttgactaacgtttactactgtacaactagtacgttacacgttcgaccccgtacggtaccgttcggaccgaagggaccgtaagggtcgaaaacttaccgaaaacgtaacgtggtacggactacgaccacctagtccttacg

SEQ ID NO: 287904 - DNA, 555 bp, Homo sapiens
  misc_feature: GYAE6OF02F2OXI.6.19.B08.1.454.CMB.1.raw
  modified_base (341)..(341): a, c, t, g, unknown or other
  misc_feature (341)..(341): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctagatctatgatgcatccactttgcaaagtgggtccatcaaggttcagtggcagtgatcgnggacagatttcactctcacctatcagcagtctgacaacctgaagtattttagacctaaactttactacttagtaccaactagtacgtttacgagttaccgtccccgtacggtaccgttccgggacccgaacgggaaccgtaagggttacggaaaacgtaccgtaaaacggtaacgtaggtacggacgttacggaccaaccgtacgttcgttacg

SEQ ID NO: 287905 - DNA, 591 bp, Homo sapiens
  misc_feature: GYAE6OF02H7K6X.6.19.B08.1.454.CMB.1.raw
  modified_base (275)..(275): a, c, t, g, unknown or other
  misc_feature (275)..(275): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttcgccgggcaagtcagagcattagctaccttaatttaaattggtatcaggagaatccgaagggaaacncccctaaactcctgatctatgatcgcatcctactttgactaagtcgggtccatcgaagttcagtggacagtggatcgtagggactagtatttaccactcctacacccatccagtacagttcacgaccgtaaccttagtaaacgttattttacgaaccttaacttactaccttcgtaacaacgtagtacttacgtacgtccgtaccccgtagggtacccgtttacggacccgtaacgggtaccgaacgggtaagtaaacgtacggaaaccgtaacgttggtacggtaccgtcgtaaccgaccttacgttcgttaccg

SEQ ID NO: 287906 - DNA, 738 bp, Homo sapiens
  misc_feature: GYAE6OF02IWHRU.6.19.B08.1.454.CMB.1.raw
  modified_base (217)..(217): a, c, t, g, unknown or other
  misc_feature (217)..(217): n is a, c, g, or t
  modified_base (279)..(279): a, c, t, g, unknown or other
  misc_feature (279)..(279): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttggccgganaagtcagagcattagcaaccttaatttaaattggtatcgaaggagaataccgaagggaaacncccctaaaactcctagatctatgatgctatcctatttgacgtaaaggtcggggtacccagtacgtaaaggttccaaggtcggactaggtacggtaatcggtaggggtaactaaggttacttttaccgacgtttacctaccaacccgtataccgtacggactaacggttcctacgtaccgtaaacccgttaggttaaacgtttacgttttacggaaccttaaaccgttttaacctaactttcgttaaaccaaacgttacggttaaacgtttaaccgtacggtacccgttacccccggttacggggtaacccgtttaccgggaacccggtaaaacggggtaacccggttaaaggggtaaacggtaaaacccgttaaacgggtaaaaaccccgttaacgggttacggttaccggttaccgtaaccggtacccgaaaaccccgttgtacccgttttaacccgg

SEQ ID NO: 287907 - DNA, 510 bp, Homo sapiens
  misc_feature: GYAE6OF02FYP5H.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtggggtcccatcaaggttcagtgcagtggatctgggacagatttcactctcacatcagcagtctgacaacctgaatattttgctaacttactactgtacaacagtagttaacagtcgcccctacggacgttccggaccgaacgggaccgaagggtaggaaactacgaaacgtaactaggtacggcgtagcacctactcttcg

SEQ ID NO: 287908 - DNA, 671 bp, Homo sapiens
  misc_feature: GYAE6OF02I1F3A.6.19.B08.1.454.CMB.1.raw
  modified_base (215)..(215): a, c, t, g, unknown or other
  misc_feature (215)..(215): n is a, c, g, or t
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggnaagtcagagcattagcacctatttaaattggtatcagganaatccgagggaaacncccctaaactcctgatctatgatgcatcctactttcgacgtaaaggttcggggtacccctattaccgtaaagggtttcaacggttcgggactaggtggaattcgtaggggaacctaggttacttttccaccgttaccttaccaacctaattaccgaaggcctaggttcctacgacctaaaccgttggtaaacggttacttttttacgaccttaaactttaccttaaccgttacgttaaccgaaactaagttaacgtttaaccgtacggttccgtaccccgttaccgggttaaccgttcggtaacccgaacgggttaaccgaaacgggttacggtaaaactaccgtaaaaccggtacgttcgggttacggaccgttacggacctaaccgtacgttacttacg

SEQ ID NO: 287909 - DNA, 645 bp, Homo sapiens
  misc_feature: GYAE6OF02H10F7.6.19.B08.1.454.CMB.1.raw
tcagatatcgcgagcacgaccggtgctcgatttagtgagtcagtaagggggagtcagtctcagtcaggacacagcatcggacatgagggtccccgctcagctcctggggctcctgctactctggctccgaggtgccagatgtgacatccagatgacccagtctccatccctccctgtctgcatctgtaggacacagagtcaccatcacttggccggacaagtcagagcattagctacttaatttaaatggtaatcgaggagaatccgaagggaaaccaccctaaactcctagtactctatgatcgactactctatttacgacgtaaggtcgggtaccagtacgtaacggttcgaggtgacgtaggtggtactcggtaggaactagttacttttcgaccttctacgaacctatacagtctagtccgtacgtacctaacgtagtaagtttattttacgaaccttaaacttacctacgttagtaacctaaagtacgttaacgttacgacgttcccgtacccggttacggtaacccggttaccggaaccggtaaccgggtaaccggtaaacgggtaacggtaaacctaacggtaaaaccggtacgttcggtacgtaccgtacgtaccctaaccgttacttccgttacgg

SEQ ID NO: 287910 - DNA, 841 bp, Homo sapiens
  misc_feature: GYAE6OF02JMGF4.6.19.B08.1.454.CMB.1.raw
tcagatatcgcgagcacgaccggtgctcgatttagtgagtcagtaaggggaggtcgagtctcagtcaggacacagcatggacatgagggtccccgctcagctcctgggctcctgctactctggctcgaggtgccagatgtgacatccagatgacccagtctccactccctcctgtctgcactctgtaggacacagagtccaccatccacgttcggcccgggacaacgtaccgagacgccaagttacgcaaccttaagttttaaaagttgggttaactacgaagggtaacgtaaaagttacccggaaacggggtaaaaaccgtccccccctaaaaacgttccttacggtaaattaccccgttaagttcggtaaatccggtacctaacttaccccgtagttttacggaacgtaaaacggggttccggggtaacccctaactttacgggtaaacgggttttccgaacggggttacggtcgtaaacggggttttagggaagttacccgggttagggggtaaacccgttaagggttaacctttttaccgaacgtttaccccgttaccaaacccggtaaattcccccgaaaaggtccccgttaaggtcccttaacggaccccctaaaacggttgaaaacccggtttgttttaccacgttaaaccttacgtactacgttaacaaacctggttaacttaccgtaacggtccctaccccgggtcggtaaacccggtttccgaaaccggaacgggttaacccgtaaacggggttacgggtaaaacttcccgggaaaacctttaacccgggttgtaacccggtcggaccgaactcccgggtacttacggtcg

SEQ ID NO: 287911 - DNA, 519 bp, Homo sapiens
  misc_feature: GYAE6OF02ILZH0.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacgcccctaaactcctgatctatgatgcatccatttgcaaagtgggtccatcaaggttcagtggcagtgatctgggacagatttcactctcaccatcagcagtctgacaacctgaagtattttagactaacttactacttgtacaactagtaattacagtcgccccgtcggacgttcggaccgaacgggaccgaacggtggtaaactacgtaaaccgaacgtagtcggacgtacgaccaacgtactcgttacg

SEQ ID NO: 287912 - DNA, 707 bp, Homo sapiens
  misc_feature: GYAE6OF02I8QXY.6.19.B08.1.454.CMB.1.raw
  modified_base (390)..(390): a, c, t, g, unknown or other
  misc_feature (390)..(390): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcattctgtaggacacagagtcaccatcacttggccgggcaagtcagagctatacgacctaacttaatttaattggtactagaaggagtaactacggaaacggaaaccgtaacccctaaactaccgtagtacttactagtagtactacgactactaccttacgtttacgaacgtaacggttccgggtacctaacgtacgtaaggttaaccgnggtacggagtaggtagtacgtacggtacgggaactaagttacgtttacctaccgttactacctaacctacgtactaacggtacctaacgttacgtaaccgtaacccgttaacgtaacggttaacgtttaacgttttaccgaaccttaaccttaacgttacccttaaggtaaccctaagtaacgttacgttaaccgtacgttacccgtacccggacgttaaccgggtaccgaccgtaacgggaacggtaacggtaacggtaaacctaaccgtaagtaaccgttaggacggttacctaggaccctaactacgtcttacg

SEQ ID NO: 287913 - DNA, 684 bp, Homo sapiens
  misc_feature: GYAE6OF02HE9FV.6.19.B08.1.454.CMB.1.raw
  modified_base (219)..(219): a, c, t, g, unknown or other
  misc_feature (219)..(219): n is a, c, g, or t
  modified_base (247)..(247): a, c, t, g, unknown or other
  misc_feature (247)..(247): n is a, c, g, or t
  modified_base (678)..(678): a, c, t, g, unknown or other
  misc_feature (678)..(678): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctcctgtctgcatctgtaggacacagagtcacatcacttgccggcaagtcagngcattagcactattaaattgtatcaganaatcaagggaacaccctaaactcctagactctaagtgaatgactactcctactttagactaaaacgggttcggggtaccctaagttaccgtaaagggtttcaacggttagggtacctaagggttacggtacgttaccggttacgggaaacgtacggttaacttttccgtaaccttccgtacctaaccgtaacttccgaacgtccgtaaaggttccttaacggtaccctaaaccgttaggaaaacgttttacgttttacgacccgttaaactttaaccttacggtttacgtaaccaaacgttacgtaacgtttaacgacgttccgtacccccggtacggtaccgttacggaccgtaacgggtaaccgtaacgggtaacgaaaccgtaacgaaaccggtaacgttagacggtacctaaggtccaactaccgtnttaccg

SEQ ID NO: 287914 - DNA, 693 bp, Homo sapiens
  misc_feature: GYAE6OF02INUPS.6.19.B08.1.454.CMB.1.raw
  modified_base (264)..(264): a, c, t, g, unknown or other
  misc_feature (264)..(264): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatcgtgtaggacacagatcaccatcacttcggccggacaagtcagagtcagttagctacctaatttaaattggtatacgaagganaagtccgaagggaaacgaccccctaaactcctagatactaatgtaatcgctactcctaactttgaacgaaaggttcgggtaccaagtacgtaaggtttcaaggtcggcaggtacggaatcgtagggactaaggtacttttccgactctaccaccaattcaagtcgaagttccgttacaccgtaaacctaggtaaatttacgttttaagaccctaaaacttttacgtacccgtttagtaaccctaaacgttagtaaacggtttaaccaacgggtttcccgaaccccccggtttaggttaaccggtttccgggaaccccgtaacggtaaacccgggtaacgggttaacggtaaacgttaaacccggaaaaaccgttacccggtaggttaccggtaccgtttacgacccgtaacccgttataccggtttacc

SEQ ID NO: 287915 - DNA, 634 bp, Homo sapiens
  misc_feature: GYAE6OF02J2GWR.6.19.B08.1.454.CMB.1.raw
  modified_base (397)..(397): a, c, t, g, unknown or other
  misc_feature (397)..(397): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
  modified_base (515)..(515): a, c, t, g, unknown or other
  misc_feature (515)..(515): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccggaggtgccagatgtgacatccagatcgacccagtcctccactccctcctgtctgcatctgtaggacacagacgtccaccatctacgttggcccgggacaacgtcaagtacgctacgttagacctaaccttaattttaaaagttggtaactcgaaggataaacgtccgaaaggggtaaacctaccccgttaaaactcgtacgattactaagtgtactgcctactaccctatttcgaagtaacgggtccggtcccaagtcgtaagggttnaggtacggactacggtagagttcgtcggtaacgagttactttcgactttcaccgtacnctanacgtctacgtctcgactaacgtgtagtatttcgacttaacttactactcgtacaanacgttacgtaactcgtaccgcccgtacggtaacgtccggaaccgtacgggaaccgtaaggtacggaaactacggtaaaacgtaccgtaggtcgtaccgcgtaccaaccgtacttctcgg

SEQ ID NO: 287916 - DNA, 543 bp, Homo sapiens
  misc_feature: GYAE6OF02HL9MT.6.19.B08.1.454.CMB.1.raw
  modified_base (270)..(270): a, c, t, g, unknown or other
  misc_feature (270)..(270): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccaagggaaacnccctaaactcctagatctatgatgcatccatttgactaaaggtcgggtcccatcaaggttcagtggcaggtggatcgtggacagtatttcactctacacatcagcagtctgacaacctagaagttatttgactaactttactacttgactaacagtacgttacacgttccgccccgttaggtaccgttaccgggaccgtaacgggaccgtaaggtacggaaacttaccgaaaacggtacgtaggtcggactacgacctaacctagttcttacg

SEQ ID NO: 287917 - DNA, 536 bp, Homo sapiens
  misc_feature: GYAE6OF02ILECX.6.19.B08.1.454.CMB.1.raw
  modified_base (255)..(255): a, c, t, g, unknown or other
  misc_feature (255)..(255): n is a, c, g, or t
  modified_base (343)..(343): a, c, t, g, unknown or other
  misc_feature (343)..(343): n is a, c, g, or t
  modified_base (396)..(396): a, c, t, g, unknown or other
  misc_feature (396)..(396): n is a, c, g, or t
  modified_base (425)..(425): a, c, t, g, unknown or other
  misc_feature (425)..(425): n is a, c, g, or t
  modified_base (530)..(530): a, c, t, g, unknown or other
  misc_feature (530)..(530): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttggccggcaagtcagagcattagctacctatttaaatggtatcagganaatcaaggaaagcccctaaatcctgatctatgatgacatcctattgactaaaggtcgggtccagtcaaggttcagtggcaggtgatcngggacagtatttcactctacacctatcagctagtctcgactaactgaaagttntttacgactaaacttatactgactaaacngtaagttactacgtcgtccccgtaggtaaccgttcgaccggtaacgggaaccggtaaggtaacggaactacgaaaacgtacgtggtacgtcgagtaccactactnttaccg

SEQ ID NO: 287918 - DNA, 514 bp, Homo sapiens
  misc_feature: GYAE6OF02H8WXJ.6.19.B08.1.454.CMB.1.raw
tcagatatcgcgagcacgaccggtgctcgatttagtgagtcagtaagggggagtcagtatcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacgccctaaactcctgatctatgatgcatcctatttgacaaagtcgggtccatcaaggttcagtggcaggtggatcgtgggacagtatttcactctcacatcagcagtctgcaacctgaatatttgactaacttactactgtacaacgagtacgttacagtccgtccccgtcggaaccgtttcggaccgtaacgggaccaagggtaggaaactacgaaaacgtacgtagtacggctgcctacatctcg

SEQ ID NO: 287919 - DNA, 565 bp, Homo sapiens
  misc_feature: GYAE6OF02GFRWN.6.19.B08.1.454.CMB.1.raw
  modified_base (269)..(269): a, c, t, g, unknown or other
  misc_feature (269)..(269): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagagcattagcacctatttaaatggtatcaggagaatccgaagggaaacncccctaaactcctagatctatgatgcatcctactttgactaaaggtcgggtacccagtactaaggttcaggtcggacgtaggtggatcgtagggaccagtactttcactctacacctatcagctagtctcgaccaactgtaacttatttacgactaacttactactataccaatagtacgttacgagttccgtccccgtaggtaccgttcggaccgacgggaacgtaagggtaacggaaacgttaccgaaacggtaacgtggttacggccgtacggacctaaccgtattccttacg

SEQ ID NO: 287920 - DNA, 524 bp, Homo sapiens
  misc_feature: GYAE6OF02ISHBK.6.19.B08.1.454.CMB.1.raw
  modified_base (255)..(255): a, c, t, g, unknown or other
  misc_feature (255)..(255): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagagcattagcaccttatttaaattggtatcagganaatcagggaaagcccctaaaactcctgatctatgatgcatccactttgctaaagtgggtcccatacaagttcagtgacagtgatcgtaggacagtatttcactctccaactatcagtcagtctgaccaacctgaagtattttcgactaaactttactactgtacaacagtaagttacagtcgtaccccgtcggtaaccgttcggaccgacgggaccgaacgggtaggaaactacgaaacgacgtagtacggctgaccacctatcttacg

SEQ ID NO: 287921 - DNA, 565 bp, Homo sapiens
  misc_feature: GYAE6OF02HK7AV.6.19.B08.1.454.CMB.1.raw
  modified_base (216)..(216): a, c, t, g, unknown or other
  misc_feature (216)..(216): n is a, c, g, or t
  modified_base (334)..(334): a, c, t, g, unknown or other
  misc_feature (334)..(334): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggnaagtcagagcattagcacctatttaaattggtatcaggagaatccagggaaacgccctaaactcctgatctatgatgcatccatttgactaagtcggggtccatcaagttcgagtggnagtggatcgtgggacagatttcactctccaccatcagcagtctgcaactgaagtatttacgacctaacgttacctacttcgtaccaactagtaacgtttacgacgttccgtccccgtacggtaccggttacggacccgaacggggtaaccgaacgggttaacggaaactaccgtaaaaaccgaaccgtaggttacggaccttacggaccctaaccgtagttcccgttacgg

SEQ ID NO: 287922 - DNA, 547 bp, Homo sapiens
  misc_feature: GYAE6OF02GHIMF.6.19.B08.1.454.CMB.1.raw
  modified_base (269)..(269): a, c, t, g, unknown or other
  misc_feature (269)..(269): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacncccctaaactcctgatctatgatgcatcctactttcgactaaaggtcggggtacccagtcgtaaaggttcaaggttggcgtaggtggtatcgtggggactagtactttcactctacaccatcagcagtctgacactgaatatttacgactaacttactactgtactaactagtacgttacacgtccgtacccgtcggtaccgttccggaccgaacgggtaccgtaagggtacgaaacgtacgaaacgtacgtagtcggactgaccactactcgttacg

SEQ ID NO: 287923 - DNA, 585 bp, Homo sapiens
  misc_feature: GYAE6OF02IBP8T.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctattaattggtatcagagaatcagggaatccctaaactcctgatctatgatgcatcctacttttgacgtaaaaggtcgggtacccatacgaaagggtttcaaggtggactaggtggatcgtaggggacaggtacttttcactctcaaccatcgagcagtctcgaccaaacttgaaagttattttcgaccttaaactttacctacttacgacaaacgtagtaacgtttacacgtccgtacccccgtaggttacccgttcgggaccgaaaggggtacccgaaagggtcgtaaacgtaaccgaaacgtaaccgttgttcgggtaccttacggacctaacccgtattccgttacg

SEQ ID NO: 287924 - DNA, 717 bp, Homo sapiens
  misc_feature: GYAE6OF02I1M2D.6.19.B08.1.454.CMB.1.raw
  modified_base (248)..(248): a, c, t, g, unknown or other
  misc_feature (248)..(248): n is a, c, g, or t
  modified_base (261)..(261): a, c, t, g, unknown or other
  misc_feature (261)..(261): n is a, c, g, or t
  modified_base (281)..(281): a, c, t, g, unknown or other
  misc_feature (281)..(281): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttggccggcaagtcagagcattagcactattaatgtatcaganaatccgaggaacnccctaaatcctagatctatnatcgctatccactttgacgtaaaacggttcgggtaccctaagttacgtaaacgggtttcaaggttggaccgtaaggtcggtaaactcgtaggggaacctaagtacttttacaacgttcctacgaaccctaatcgaacgtactacgttctacgaacctaaaccgttaggtaaagttacttttacggaaaccttaaaccttttaaacccgtacttaacgttaaccgtaaaaccgttaaggtaaccgttttaaccgtaacggtttcccggtacccccggtttaccggggtaaccggtttaccccgggtacccgtaaaccggggtaacccggtaaaggggtttaaccggaaaaccggttaaccctaaaaaccgggtaaaccggttaggttaccgggactttaccgggaacccaaacccgttcgggttacctttacccggg

SEQ ID NO: 287925 - DNA, 504 bp, Homo sapiens
  misc_feature: GYAE6OF02FWL7F.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtgggtccatcaaggttcagtggcagtggatcgtgggacagatttcactctcaccatcagcagtctgcaacctgtaagtattttgactaacttactactgtacaacagagttacagttcgccccgtcggtacgttccggaccgagggaccaagggtaggaactacgaaacgacgtagtacggctggcacctatctcg

SEQ ID NO: 287926 - DNA, 560 bp, Homo sapiens
  misc_feature: GYAE6OF02GN6HV.6.19.B08.1.454.CMB.1.raw
  modified_base (268)..(268): a, c, t, g, unknown or other
  misc_feature (268)..(268): n is a, c, g, or t
  modified_base (397)..(397): a, c, t, g, unknown or other
  misc_feature (397)..(397): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaancccctaaactcctgatctatgatgcatccactttgcaaagtggggtcccatcaaggttcagtggcagtggatcgtgggacagtactttcactctacacctatcagcagtctgacctaaccgtgaaagtnttttagactaaatttacctacttaggtaccaaacgtagtacttaacaggttccgtaccccgtcggtaaccgttcggacccgaacgggtaaccaaggggtaacgaaacgtaccgtaaaacgaaccgttgtacggtaccgtagacccaaccgtactacttaccgg

SEQ ID NO: 287927 - DNA, 558 bp, Homo sapiens
  misc_feature: GYAE6OF02F2MG7.6.19.B08.1.454.CMB.1.raw
  modified_base (214)..(214): a, c, t, g, unknown or other
  misc_feature (214)..(214): n is a, c, g, or t
  modified_base (551)..(551): a, c, t, g, unknown or other
  misc_feature (551)..(551): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatccctccctgtctgcatctgtaggacacagagtcaccatcacttgccggnaagtcagagcattagcacctatttaaattggtatcagagaatcagggaagcccctaaactcctgatctaactgatgcataccactttgacgaaagtcggggtacccagtaccaaggtttcaagtggacgtagtggatcgtagggacaggtatttcactcctcacctatcagctacgtctcgacaaccgtagtaaagtattttacgactaacctttactactacgtaccaaactagtacgttacaacgttcgacccgtcggtacgttaccggaccgtaacggaccgtaagggtaacggaaactaacgaaacgtaacgtcgtagcgtacgacaccgtanacttacg

SEQ ID NO: 287928 - DNA, 525 bp, Homo sapiens
  misc_feature: GYAE6OF02GX0LE.6.19.B08.1.454.CMB.1.raw
  modified_base (355)..(355): a, c, t, g, unknown or other
  misc_feature (355)..(355): n is a, c, g, or t
  modified_base (368)..(368): a, c, t, g, unknown or other
  misc_feature (368)..(368): n is a, c, g, or t
  modified_base (382)..(382): a, c, t, g, unknown or other
  misc_feature (382)..(382): n is a, c, g, or t
  modified_base (436)..(436): a, c, t, g, unknown or other
  misc_feature (436)..(436): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtagacacagagtcaccatcacttgccgggcaagtcagagcattagcaccttatttaaattggtatcaggagaatccgaagggaaacgcccctaaaactcctagatctatgatgcatccatttgacaaaggtcgggtacccatcgaaggttcagtgcagtggatcgtagganagtatttcactcncacatcagcagtcngaccaactgaatatttcgactaacttactactgtacaactagtattacagtccncccgttacggaccgttcggaccgtagggaccgaagggtcgaaacgtacgaaacgacgtcggtacggtacgtacgacctacctatcttcg

SEQ ID NO: 287929 - DNA, 536 bp, Homo sapiens
  misc_feature: GYAE6OF02JKCEF.6.19.B08.1.454.CMB.1.raw
  modified_base (249)..(249): a, c, t, g, unknown or other
  misc_feature (249)..(249): n is a, c, g, or t
  modified_base (262)..(262): a, c, t, g, unknown or other
  misc_feature (262)..(262): n is a, c, g, or t
  modified_base (322)..(322): a, c, t, g, unknown or other
  misc_feature (322)..(322): n is a, c, g, or t
  modified_base (381)..(381): a, c, t, g, unknown or other
  misc_feature (381)..(381): n is a, c, g, or t
tcagatatcgcgagcacgaccggtgctcgatttagtgagtcagtaaggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccggcaagtcagagcattagcactatttaatggtatcgaganaatccaggaaacncccctaaatcctagatctatgatgactatcctattgactaaggtcggtccatcaaggttnagtgcagtgatcgaggacagtattcactcacactatcagcagtctcactactagaagtntttgacttaacttactactgtaaccaagtagtaacgttacgacgttcctacccgtaggtaccgttacgacccgaagggtaacctaacggtaacggaaattcctaaaaccggtactaggtacgggtcctaacgactaacccgttataccggttacg

SEQ ID NO: 287930 - DNA, 513 bp, Homo sapiens
  misc_feature: GYAE6OF02HEPVD.6.19.B08.1.454.CMB.1.raw
  modified_base (268)..(268): a, c, t, g, unknown or other
  misc_feature (268)..(268): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaancccctaaactcctgatctatgatgcatccatttgcaaagtgggtaccatacaaggttcagtggcaggtggatcgtagggacagatttcactctcaccatcagcagtctgcaaccgtgaagtattttcgactaacttactactgtacaacagtaagttacagttccgcccgtcggaccgttcggaccgacgggaaccgaagggtaggaaactacgaaacgacgtgtacggctagcaccagtctacg

SEQ ID NO: 287931 - DNA, 509 bp, Homo sapiens
  misc_feature: GYAE6OF02GY8QM.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctcctgtctgcatctgtaggacacagagtcaccatcacttgccggcaagtcagagcattagcacctatttaaattggtatcaggagaatcaggaaacgccctaaactcctgatctatgatgcatccactttgcaaagtgggtccatcaagttcagtgcagtgatcgtaggacagatttcactctcaccatcagcatctgaccactgaacgtattttgactaacgttactacttgtaccaatagtaacgttacagttccgccccgtggtaaccgttcggaccgtaacgggaccaagggtcgaaacttacgaaacgacgtagtcgactcgacacctactgttac

SEQ ID NO: 287932 - DNA, 684 bp, Homo sapiens
  misc_feature: GYAE6OF02H92ZL.6.19.B08.1.454.CMB.1.raw
  modified_base (215)..(215): a, c, t, g, unknown or other
  misc_feature (215)..(215): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatccacttgccggnaagtcagagcattagcacctaatttaaattggtatacaggagaatccgaagggaaacgtacccctaaactcctagtactctaatcgatgacataccacttttgactaaaggtcggggtaccctaagtcctaaaggttccaggtcggacgaggtaggtatacgtagggacaggtactttacacttcactacctataccaagctacgtacttacgaccaaaccgttagaaacgttacgtttttagacccttaaactttacctaaccttagtaccgtaaaacgtacggtaaagtttaaccgacggttaccgttacccccggtacggtaacccgggtttacccgtacccgggtaaaccggggtaacccggtaagggtaaacgggtaaacgttaaccggtaaaacccggtaaaccgttcggtaaccgggtacggttaacccgtacccgtaacccgtaccgttacgtttaacccg

SEQ ID NO: 287933 - DNA, 551 bp, Homo sapiens
  misc_feature: GYAE6OF02I2CMD.6.19.B08.1.454.CMB.1.raw
  modified_base (249)..(249): a, c, t, g, unknown or other
  misc_feature (249)..(249): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccggcaagtcagagcattagcacctattaatgtatcagganatcaggaacgaccctaaacgtcctgatactatgatagcatccattgactaagtcgggtaccatactaaggttcagtggacagtggatcgtaggactagtactttcactcactacatcagctagtctgaccaactagaagtacttttgacctaaactttactacgttcgtactaaacgagtaacgttacacggtcgtaccccgtggaaccgttccgaaccgtacgggaaccgtaggttaacggaaacgtaccgtaaaacgtacgtaaggtcggtaccgtagaccggtaacctagtcgttaccg

SEQ ID NO: 287934 - DNA, 613 bp, Homo sapiens
  misc_feature: GYAE6OF02GW5M6.6.19.B08.1.454.CMB.1.raw
tcagatatcgcgagcacgaccggtgctcgatttagtgagtcagtaaggggggagtcagtctcagtcaggacacagcatggacatggacgggtccccgctcagctccgtggggctcctgctactctggctccgaggtgccagatgtgacatccagatgacccagtcctccatccctcctgtctgcatctgtaggacacagagtcaccatctacgttcggccgggacaagtcaggacgactattagcctaaccttaattttaaagttggtattacgaagggaagaactccggaaggggaaaccgtacccccttaaaactccgtagacttctaatgtatcgcactcctactttacgacgtaaacgggtcggggtacccatacgtaaggttcaggtggactaggtggatcggtacgggactagtactttacacgttcctaccacctatcacgctagtctcgacctaaccgtagaattagtttcgactaacttactactgtacaacgagtacgttactagtccgtcccgtacggtaccgttcggaccgaacgggtaccgtaagggtacgaaactaccgaaacgtacgtggtacgtcgtacgacctacctagttctacg

SEQ ID NO: 287935 - DNA, 678 bp, Homo sapiens
  misc_feature: GYAE6OF02H5952.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttggccgggcaagtcagagcaattagctaaccttaattttaaaattggttaatcgtaaggaagaactaccgaagggaaaacgtacccctaaaactcctagtactcctatgatgactactcctactttgaccgtaaaggttcggggtaccctaagttaccgtaaaggttttcgaacggttggacgtaggtcggtacgttcgtacggggaactaggtacctttttaccgaaccttcctaccgtaaccctaagtccgaacgtacgtaacgttccgtacggaaccctaaacccgttagttaaacgtttaacgttttacggaacctttaaaccgtttaactaacttacgtaactaaacgtagtaacgttacgtacgtccgtaccccgtcggtaccgttcggaccgtacgggaaccgaaggtaacgtaaacaccgtaaaacggtactaggtcgtacgtacgtacgacctctcgttacg

SEQ ID NO: 287936 - DNA, 574 bp, Homo sapiens
  misc_feature: GYAE6OF02GKQSN.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatccagggaaacgcccctaaactcctagatctatgatgcatccactttgacaaaggtcggggtacccatcgaaggttcagtggcagtggatcgtggacagtatttcactctaccactactcacgctagtctcgacctaaccgtaggtaaacgtatttttacgacttaactttactaccgttagtaccaaacgtagtaacgttaaccgagttccgtccccgtacggtaccggttccggaccgtaacgggaaccgtaagggtaacggaaacgtaccgtaaacgtaacgtacggtacggaccgtagacctactactcttacg

SEQ ID NO: 287937 - DNA, 533 bp, Homo sapiens
  misc_feature: GYAE6OF02GBIFI.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgacaaagtggggtacccatcaagttcagtggcagtggatcgtgggacagtatttcactctcacctatcagctagtctgccaacctgtaagtattttagctaaacttactacttgtacaactagtagttacagttcgccccgttacggaccgttaccggccgtaacgggaccgaaggtacggaaactacgaaaccgaacgtgtacggacttacggacaccgtacgtcttacg

SEQ ID NO: 287938 - DNA, 518 bp, Homo sapiens
  misc_feature: GYAE6OF02GJVS3.6.19.B08.1.454.CMB.1.raw
  modified_base (270)..(270): a, c, t, g, unknown or other
  misc_feature (270)..(270): n is a, c, g, or t
  modified_base (436)..(436): a, c, t, g, unknown or other
  misc_feature (436)..(436): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccaagggaaacncccctaaactcctgatctatgatgcatccactttgacaaagtgggtccatcaaggttcagtggcagtggatcgtgggacagtatttcactctcacctatcagcagtctagaccaaccgtagtaagtacttttagactaactttactactgtacaactagtattacngtcgcccgtcggacgttcggaccgagggaccaagggtacggaaactacgaaacgtaacgtgtaggctcgacacctatcttcg

SEQ ID NO: 287939 - DNA, 569 bp, Homo sapiens
  misc_feature: GYAE6OF02ICKP7.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatcccagatgacccagtctccatcctccctgtctgcatctgtaggacacagagtcaccatcacttgccgggcaagtcagagcattagcacctatttaaatggtatcaggagaatcagggaaacgccctaaactcctgatctatgatgcatccactttgacaaagtcgggtccatcaagtccagtggcagtggatcgtagggacagtattttcacttctaccaccatcagcagtctagacaacctagaaagttattttacgacctaaactttaactaaccttgtaccaaacgtacgtaagtttacacgttaccgcccccgttacgggtaaccgttaccggaccggaacgggtaaccgtaagggtaacggaaactaaccggaaacgtaacgtaggttacggacgtacggaccacctacgtcttaccg

SEQ ID NO: 287940 - DNA, 534 bp, Homo sapiens
  misc_feature: GYAE6OF02GBC9E.6.19.B08.1.454.CMB.1.raw
  modified_base (396)..(396): a, c, t, g, unknown or other
  misc_feature (396)..(396): n is a, c, g, or t
  modified_base (443)..(443): a, c, t, g, unknown or other
  misc_feature (443)..(443): n is a, c, g, or t
  modified_base (449)..(449): a, c, t, g, unknown or other
  misc_feature (449)..(449): n is a, c, g, or t
  modified_base (464)..(464): a, c, t, g, unknown or other
  misc_feature (464)..(464): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgaccccagtctccatcctcctgtctgcatctgtaggacacagagtcaccatcacttcgccgggcaagtcagagcattagcacctatttaaattggtatcaggagaatccgaagggaacgcccctaaactcctagatctatgatgacataccctatttcgacgtaaagggtcggggtaccctagttacgtaagggttcaggtggacgaggtggtactcgtagggacagtatttcactctaccacnctacagctagtctgaccaacgtgtaatatttgactaacttactactntacaangtaactactcgtccncccgtggaccgttcgaccgaggaccgaggtacggaactacgaaacgacgtgcgactgaccactactctcg

SEQ ID NO: 287941 - DNA, 605 bp, Homo sapiens
  misc_feature: GYAE6OF02GL5EA.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatcgaagggaaacgcccctaaactcctagatctatgatgcactcctacttttgactaaaggtcggggtaccctagtacgtaaggtttacaggtggactaggtggatcgtagggactagtactttcacttacctaccacctatcgacgctagttctacgacctaaccgtagtaaagtacgttttacgaccgttaaactttactaactcgtaacaacgtaagtacgttaacgagttaccgcccgttacgggtaacgttccggaccggtaacgggtaaccgtaacgggtaacggtaaacgtaaccgtaaaacgtacgtaggtacggtacctacgacctacgtacgtcttacg

SEQ ID NO: 287942 - DNA, 526 bp, Homo sapiens
  misc_feature: GYAE6OF02FUM4G.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaacgcccctaaactcctgatctatgatgcatcctactttgactaaaggtcggggtacccatacgaaggtttcagtgggctaggtggatcgtgggacagtatttcactctacaccatcagcagtctgacaactgaagtatttagacctaacttactactgtacaactagtagttacagtcgtccctacgggtacgttcgggacctagggaccgtaaggtggaaactacgaaacgtactaggtacggactgacacgtatctacg

SEQ ID NO: 287943 - DNA, 557 bp, Homo sapiens
  misc_feature: GYAE6OF02JBZCF.6.19.B08.1.454.CMB.1.raw
  modified_base (253)..(253): a, c, t, g, unknown or other
  misc_feature (253)..(253): n is a, c, g, or t
  modified_base (269)..(269): a, c, t, g, unknown or other
  misc_feature (269)..(269): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagagcattagcacctattaaattggtatcagganaatccgaagggaaacncccctaaatcctagatctatgatgcatcctatttgacaaaggtgggtcccatcaagttcagtgcagtgatcgtgggacagtactttcactctacacatcacgctagtactcgacaacctagaagtatttcgactaacttactactagtacaacgtagtacgttaactacgtccgtcccgtacggtaccgttccggtaccgacgggtaaccgaagggtaacggtaaacgtaacgtaaaccggtaacgttaaaacggtcggtactacggaccgtacctacgttcttaccg

SEQ ID NO: 287944 - DNA, 849 bp, Homo sapiens
  misc_feature: GYAE6OF02G9D2K.6.19.B08.1.454.CMB.1.raw
tcagatatcgcgagcacgaccggtgctcgatttagtgagtcagtaaggggaggtcagtctcaggtcacggtacaccaggccactagggacctactgagggtccccggctcacgctccgtagggtcgtcctgctactcgttcggtcttccgaggtgtccgaggtatcgtagacagtccgagactacgacccgtaggtcctccgtaggggtcccttacccgtcgtcgtcgcggacttcccgtaggtacggacctacctagtacgtccaaccgacttccgtacgttcggtcccgggactaacgttcgaagacgtctagttacgccgtaccttaagtttaaacgtcggtaatcgtagggaggaactccgaaggggaaaccgtccccgtaaacgtccctagacttacctaagtcgatcgacaacgtccgtacttcgacgtaaggtcggtccagttacggaacgggttccaggtacggactacggtcggacgtcgtacgggaacacggtaactttaccacctacctaccgtaccctacgttaccgacgtcgtaacggttccgtacggtaccctaaccggttaggtaaacggttacgttttacgaacccgttaaaccgtttacccgtaaccgttacgttaaaccctaaacgttaacgtttaaccggttaaccgtaccggttacccgttaacccccggttaccggtaacccgtttaccgggaacccggttaacgggtaaccgttaacggggtaacggtaaaccgttaaccgggtaaacccgggtaaccggttaccggggttacccggtaccggttaaccggtaccccgttaacccgttacggttacccgttacccgg

SEQ ID NO: 287945 - DNA, 628 bp, Homo sapiens
  misc_feature: GYAE6OF02ILMSR.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcaccttatttaaattggtatcaggagaatccaaggaacgaccctaaactcctgatctatgatcgacactcctactttagactaaaggtcggggtacccagtacgaaaggtttcaggtggctaggtggtagtcgtacgggactagtacttttacacttctaccgaacctatcacgcgtagtcctagacctaaccgtaggtaagttacttttacgaccttaaacctttactaccgttacgtaactaaacgtagtaacgttacgtacggttccggtaccccgtaccgggttaccggttaccgggacccggtaacggggtaaccgtaacggggtaacggtaaactaccggtaaacgtaaccgttagggtacggtacgtacgaccgtaacctacgtcgttacg

SEQ ID NO: 287946 - DNA, 488 bp, Homo sapiens
  misc_feature: GYAE6OF02G5UN5.6.19.B08.1.454.CMB.1.raw
  modified_base (268)..(268): a, c, t, g, unknown or other
  misc_feature (268)..(268): n is a, c, g, or t
  modified_base (386)..(386): a, c, t, g, unknown or other
  misc_feature (386)..(386): n is a, c, g, or t
  modified_base (482)..(482): a, c, t, g, unknown or other
  misc_feature (482)..(482): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaancccctaaactcctgatctatgatgcatccactttgcaagtgggtcccatcaagttcagtggcagtggatcgtgggacagtatttcactctcaccatcagcagtctgcaacctgaagtntttgctaacttactactgtcaacagtattacagttcgccctcggaccgttcggccgacggacgaaggtcgaaactcaaacgtactgtgctgccacntctacg

SEQ ID NO: 287947 - DNA, 573 bp, Homo sapiens
  misc_feature: GYAE6OF02IBPDJ.6.19.B08.1.454.CMB.1.raw
  modified_base (271)..(271): a, c, t, g, unknown or other
  misc_feature (271)..(271): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcaccttaatttaaatggtatcaggagaatccaagggaaacnccctaaactcctagatctatgatgcatcctactttgacgaaaggtcgggtacccaatcgaaggtttcaggtggcaggtggtatcgtagggacagtatttccacttctacaaccctatcagtactagtctagacctaacttagtaagttattttacgaccttaacttacctacttgtaccaaacagtacgttaactagtccgtaccccgtcggtaaccgttccgaccgtaagggtactacggtaacggttaaggaaactacgaaacgtacgtggtacggtactacgacctacccgtattaccg

SEQ ID NO: 287948 - DNA, 549 bp, Homo sapiens
  misc_feature: GYAE6OF02HPKWB.6.19.B08.1.454.CMB.1.raw
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
  modified_base (388)..(388): a, c, t, g, unknown or other
  misc_feature (388)..(388): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcactatttaaatggtatcaganaatccagggaacncccctaaactcctagatctatgatgcatccatttgacaaagtgggtccatcaagttcagtgcagtgatcgtgggacagtatttcactctacaccatcagctagtctgacctaactgaaagttntttcgactaactttactactgtaccaaacgtaggtacgtttacacgttccgtaccccgtacgggtaccgtttccgggaccgaacggggaacctaagggtaacggtaaactacgaaaaccggtaacgtaggtacggaccttggaccaccgtacgttcttacg

SEQ ID NO: 287949 - DNA, 549 bp, Homo sapiens
  misc_feature: GYAE6OF02IQ471.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcacctattaaattggtatcagagaataccagggaaacgcccctaaactcctagatctatgatgcatcctactttgacaaaggtcggggtcccaattcgaaggttcaggtggactaggtaggatcgtagggacagtattttcactctacaacctatcagactacgtctagaccaacctgaaagttattttacgactaaccttactactgtacaactagtagttacagttccgcccctacggtaccgttccggaccgaacgggaccgtaagggtaggaaactcgaaaacgtacgtagtcggactgaccacctatcttacg

SEQ ID NO: 287950 - DNA, 690 bp, Homo sapiens
  misc_feature: GYAE6OF02FUN9Z.6.19.B08.1.454.CMB.1.raw
  modified_base (215)..(215): a, c, t, g, unknown or other
  misc_feature (215)..(215): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggnaagtcagagcattagcaccttatttaaattggtatcaggagaatccagggaacgcccctaaactcctgatctatgatgcatccactttgactaaaggtcggggtacccatcgaaggttcagtggcaggtgatcgtggggcagtatttcacgtctcacctatcagcacgtctggactaaccgtagaagttacgttttacgaccttaaacgtttaccttaacgttacggtaacctaaacgtacggttaaacggtttaaacttaacccggttacggtaccccccggtttaccgggtaaaccccgggtttcccggggtaacccgtaaaacgggggtaaccccggtaaaagggggttaaccggggtaaaaaccttaaacccgggtaaaaacccggtaaaaccggtttacggggttaacccggggttaccgtttaaccgggtaacccgtaaaccccgtacgtttaacccggtttaacccgg

SEQ ID NO: 287951 - DNA, 521 bp, Homo sapiens
  misc_feature: GYAE6OF02GOIM0.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctagatctatgatgcatccactttgcaaagtgggtcccatcgaaggttcagtggcagtggatcgtggacagatttcactctcacatcagcatctgaccaactgaatattttacgactaacttactactcgtacaacagtaacgttacagtccgcccctggaccgttccggaccgtaacgggaccgaagggtacgaaactacgaaacgtacgtaggtcggacctggaccaccgtatcgttacg

SEQ ID NO: 287952 - DNA, 643 bp, Homo sapiens
  misc_feature: GYAE6OF02HOQU7.6.19.B08.1.454.CMB.1.raw
  modified_base (260)..(260): a, c, t, g, unknown or other
  misc_feature (260)..(260): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttggccgggcaagtcagagctattagctactaatttaaattggtatcgaagganaactaccgaagggaaaccgacccctaaacttccgtagtactactatgatcgactactacctactttgacgtaaacggtcgggtaccaagttacgtaaggttcgaggtggacgaggtggactacgtagggtaacgtagttactttcacttcctacaacctatacgacgctacgtctacgacctaaaccttaggtaaacgtttactttacgaacctttaaacgttacctaacgttacgtaactaaacgtaagtacttaacgacggttccgaccccgttacgggtaaccggttccggaacccggaacgggtaaccggtaacgggtaacggaaacgtaacgaaaccggtacgtaggtcggtacgacgaccgactacgttacgttacg

SEQ ID NO: 287953 - DNA, 550 bp, Homo sapiens
  misc_feature: GYAE6OF02F21SM.6.19.B08.1.454.CMB.1.raw
  modified_base (267)..(267): a, c, t, g, unknown or other
  misc_feature (267)..(267): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaancccctaaactcctgatctatgatgcatccactttgcaaagtgggtcccatcaagttcagtgcagtgatctgggacagatttcactctcaccatcagcagtctgcaacctgaagtattttgactaactttactacttagtaccaaacgtagaacgttaacagttcgccccctacggtaaccgttccgggaccctaacggggacccgtaaaggggtaggtaaaactaccgaaaacggtaaccgttaggtacgggtacgttacggaccgaccctagtccgttacgg

SEQ ID NO: 287954 - DNA, 578 bp, Homo sapiens
  misc_feature: GYAE6OF02IUH3G.6.19.B08.1.454.CMB.1.raw
  modified_base (215)..(215): a, c, t, g, unknown or other
  misc_feature (215)..(215): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (266)..(266): a, c, t, g, unknown or other
  misc_feature (266)..(266): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttggccggnaagtcagagcattagcacctatttaaattggtatnagganaatcaggaacncccgtaaactcctagatctatgatgctactcctatttgacgtaaacggttcggggtaccctagttaccgtaaagggtttcaacggttggaccgtaggttcgggaattcgtaggggtaacaggttactttacacttactacgtaactatcacgctagttctagacctaacgtagaagttattttacgaactaacttactactgtacaacagtattacgagtccgtacccgtcggtacgttacggaccgtacggaccgtaagggtacgtaacaacgaaacgtacgttacgacgtactcgacacctagtacttcg

SEQ ID NO: 287955 - DNA, 555 bp, Homo sapiens
  misc_feature: GYAE6OF02HWRA3.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcaggagaatcaggaaacgcccctaaactcctgatctatgatgacatcctacttttgactaaaggtcgggtacccaatcgaaggttcaagttggcagtggatcgtgggactagatttcacttctcactatcagcagtctgacctaacctgaagttatttacgacctaactttactacttagtacaactagtaacgttaacacgttcgccccgttaggaccgttccgggaccgtaacggggtaccgaacgggtaggtaaactacgaaaccgtaacgttggtaggtcctacgaccaacctacgttctacg

SEQ ID NO: 287956 - DNA, 641 bp, Homo sapiens
  misc_feature: GYAE6OF02JXFFQ.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtcctccatcctccctgtctgcatctgtaggacacagagtcaccatcacttggcccgggacaagtcagagcaattacgactaaccttaatttaaagttggtatcgaaggtagtaactaccgaacgggaaactacccctaaactccgtagactactatacgatgacatcctacgttacgacgtaacggttcgggtccacgtacgtaaggttcgacgtaggactaggtacgtagtcgtacggatacgtacttcaccgttcactaaccagtaccgagcgtacgtcgtacgacctaacgttagtaacgttgtttacgaccttaacgtttaaccttacttacgtacgaactacgtaacgttacgaccggttccgtccccggtaacggtaccggttaccggaaccgaacgggtaactaacgggtaacggtaaactacgaaaacggtacgttggtaacggtacctaaggtaccctacgtacgttcgtcg

SEQ ID NO: 287957 - DNA, 569 bp, Homo sapiens
  misc_feature: GYAE6OF02IL5Z1.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacgccctaaactcctagatctatgatgcatccatttgacaaaggtcgggtcccatcaaggttcagtggcagtggatcgtgggacagtatttcactctcaaccatcagctagtctagacctaacctgtaagtattttagactaaactttactacttacgtacaaacgtagtaacgttaacgtagtccgtaccccgtacggtaaccgttaccggaccgaacggggtaaccgtaaagggtacggaaaacgtaccgaaaaccggtaacgttaggtacgggactacgaccaaccttactcgttaccgg

SEQ ID NO: 287958 - DNA, 571 bp, Homo sapiens
  misc_feature: GYAE6OF02GHB7H.6.19.B08.1.454.CMB.1.raw
  modified_base (358)..(358): a, c, t, g, unknown or other
  misc_feature (358)..(358): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccgaagggaaacacccctaaactcctagactactatgatgctactcctactttgactaaaggtcgggtacccatacgaaggttcagtggcagtggatcgngggacagtatttcactcacacctatcagtacacgtctgacctaacctagaagttatttagacttaacttactacgtacgtacaacgtagtaacgttacgagttaccgtccccgtacggtaccgttaccggaccggtaacgggaaccgtaacgggtacggtaaaactaccgaaacgtaacgtgtacggtacgtacgaccaccgtatacgttacg

SEQ ID NO: 287959 - DNA, 571 bp, Homo sapiens
  misc_feature: GYAE6OF02HPDX7.6.19.B08.1.454.CMB.1.raw
  modified_base (462)..(462): a, c, t, g, unknown or other
  misc_feature (462)..(462): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggcaagtcagagcattagcactatttaaattggtatcaggagaatccgagggaaacgcccctaaactcctagatctatgatgctatccctacttttgacgtaaaaggtcggggttacccagttaccgtaagggttcaaggtgggacgaggtggatcgtaggggaactagtaacttttcacttctaccacctatccagctagtctgacctaaccgtgaaacgtattttcgactaactttactactgtacaanagtaacgttacagttccgcccgttggaccgttcggacgtaacgggacctaaaggtacggaaactacgaaacgtacgtaggtcggtactacggaccaacctattcttacg

SEQ ID NO: 287960 - DNA, 619 bp, Homo sapiens
  misc_feature: GYAE6OF02I1HKP.6.19.B08.1.454.CMB.1.raw
  modified_base (262)..(262): a, c, t, g, unknown or other
  misc_feature (262)..(262): n is a, c, g, or t
  modified_base (462)..(462): a, c, t, g, unknown or other
  misc_feature (462)..(462): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttggccggacaagtcagagcattagactaccttaatttaaattggtatcgagganaataccgaagggaaacgacccctaaactcctagactctatgatcgctactcctactttacgacgtaaaggttcgggtacccaagttaccgtaaggtttcgaggtcgggactaggtggtagtcgtagggtactagtactttcacttcctaccaacctagtaccagtcctagtcctacggacctaaacctaggttaaacttnttttacgaaccttaaacgtttactacgttacgtaacaaacgtagtacgttactacggttccgtaccccgtggtaccgttaccggaccgaacgggtaccgtaagggtacgaaacgtacgaaacgtacgtggtacgctacgacctaccgtattcgttcg

SEQ ID NO: 287961 - DNA, 499 bp, Homo sapiens
  misc_feature: GYAE6OF02FSES3.6.19.B08.1.454.CMB.1.raw
  modified_base (268)..(268): a, c, t, g, unknown or other
  misc_feature (268)..(268): n is a, c, g, or t
  modified_base (390)..(390): a, c, t, g, unknown or other
  misc_feature (390)..(390): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaancccctaaactcctgatctatgatgcatcctactttgctaaagtgggtcccatcaaggttcagtgcagtggatcgtgggacagtatttcactctcaccatcagcagtctgacaacctgaaatnttttgactaaacttactactgtacaacagtacgttacacgtcgcccctggacgttcgaccgacggaccgaaggtaggaaactacaaacgactagcggctgcacatctcg

SEQ ID NO: 287962 - DNA, 576 bp, Homo sapiens
  misc_feature: GYAE6OF02GS0XI.6.19.B08.1.454.CMB.1.raw
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
  modified_base (371)..(371): a, c, t, g, unknown or other
  misc_feature (371)..(371): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcagganaatccagggaaagcccctaaancctgatctaatgatgcatccactttgacaaagtgggtcccatcaaggttcagtggctagtggatcgtggactagtatttcactcacaccatcancagtctagccaaccgtgtaaagtattttacgactaaactttactacttagtacctaaacgtacgtagttaacgacggttccgtccccgttaccggtaacggtttaccggacccgtaacggggaacccgtaagggttaacggaaacgttaaccgaaaacgtaaccgttaggtacggtacgtacggaccctaccagttaccgttccg

SEQ ID NO: 287963 - DNA, 544 bp, Homo sapiens
  misc_feature: GYAE6OF02GICUV.6.19.B08.1.454.CMB.1.raw
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (267)..(267): a, c, t, g, unknown or other
  misc_feature (267)..(267): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtccaccatcacttgccgggacaagtcagagcattagcacctatttaaattggtatnaganatcgaggaacnccctaaactcctgatctatgatgcactcctactttgactaaaggtcggggtcccatacgaaggttcaggtggcgagtggatcgtgggacagtactttcactctcacatcagcagtctgaccaactagtaagtatttacgacttaacttactactcgtactaactagtacgttacgacgttccgccccgtacggtaccgttcggaccggacgggaacgaacgggtaacggtaaactacgaaacgtaacgtaggtcgctacgacctactactcgttacg

SEQ ID NO: 287964 - DNA, 642 bp, Homo sapiens
  misc_feature: GYAE6OF02IGJUT.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctcctgtctgcatctgtaggacacagagtccaccatcacttggccggacaagtcaagagactattagccaaccttaatttaaaagttggtaatacgaaggaagtaactaccgaagggaaaacgtacccctaaaacgttcctagatactaatgatcgactattccctacgtttagacgtaacggttcgggtaccctagttacgaaaggtttacgaaggttcggacgtaaggttggtatcgtaggggaacaggttatttccactactacaaccatacgacgactacgtctacgacctaaccgtagtaacttattttacgacttaaccttactaacttacgtaacaactagtacgttacgtacgtaccgtcccgtacggtaccgttaccggtaccggacgggaacgtaagggtacggtaaacgtacgaaaacggtacgtacggtaggtaccgtaccggactacctaccgtgttaccg

SEQ ID NO: 287965 - DNA, 550 bp, Homo sapiens
  misc_feature: GYAE6OF02HO2NT.6.19.B08.1.454.CMB.1.raw
  modified_base (216)..(216): a, c, t, g, unknown or other
  misc_feature (216)..(216): n is a, c, g, or t
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggganaagtcagagcattagcacctatttaaatggtatcaganaatcagggaaacnccctaaaactcctgactctatgatgactatccctactttagacgtaaaggtcgggtcccatcgaaggtttcaggtgctagtggatcgtagggacagtatttcactcgtacacctatcacgtctaagttcctagacctaaaccgtagtaacgttattttcgacctaaacttactaactgtacaagtacgtagttacagtccgcccgtacggaccgttcggaccgacggaaccgtaaggtacgaaactcgaaacgtactggtacgcgtacgctaacctctctacg

SEQ ID NO: 287966 - DNA, 637 bp, Homo sapiens
  misc_feature: GYAE6OF02HLIER.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggacaagtcagagactattacgcctaacctttaaattttaaacgttggtaattcgaaggtagtaacgtaccggaagggaaacctaccccctaaaactcctagtactctaatgatcgactactcctacgtttgacgtaaggttcgggtcctagtaccgtaaggttcaggtgtacgtaggtgacgtacgtaggactagtactttctactctaccacctatacgagctagtcctagaaccctaacgtagtaattactttacgaccttaaactttactacgtctaacgtaacgagttaacgttccgacgttaccgtcccggttacggtacgttacccggaccgtaacgggaaccgtaagggtaaacggaacttaaccgaaaccgtaacggttcggtacggaccgtaccgacctaccggtattccgttcg

SEQ ID NO: 287967 - DNA, 542 bp, Homo sapiens
  misc_feature: GYAE6OF02GDKXB.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacgcccctaaaactcctgatctatgatgcatcctactttgcaaagtgggtcccatcaaggttcagtggcagtgatcgtgggacagtatttcactctcaccatcagcagtctgccaacctgaagtattttgacctaactttacctacttcgtacaactagtagttaacagttcgcccctcggtaccgttaccggacccgaacgggaccgtaagggtaacggaaacgttaccgaaaaccgtaacgtaggtacggtactcggacaccgtataccgttcg

SEQ ID NO: 287968 - DNA, 671 bp, Homo sapiens
  misc_feature: GYAE6OF02GRR2I.6.19.B08.1.454.CMB.1.raw
  modified_base (277)..(277): a, c, t, g, unknown or other
  misc_feature (277)..(277): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttggccgggacaagtcagagcattagcaccttaatttaaattggtatcgaggagaactccgaagggaaacncccctaaactcctagactctatgatgctactacctactttgacgtaaacggtcgggtaccctagtacgtaaggttcgaggtcggactaggtaggatcgtagggactagtactttcactctaccacatcgacgctagtctacgacctaacgtagtaaacgttattttacgaccttaaactttacctacttacgtaacctaaacgtaacggttaacgtttaaccgtacggttacccgtacccccgttacgggtaacccggtttacccgggaacccggtaaacggggtaacccgtaaaaggggttaacggtaaaaaccgttaaccggtaaaaaccggttaaccggttacggttacggtaccgttacgaacccgtaacccgttacgttccgttaacgg

SEQ ID NO: 287969 - DNA, 683 bp, Homo sapiens
  misc_feature: GYAE6OF02JP6B4.6.19.B08.1.454.CMB.1.raw
  modified_base (163)..(163): a, c, t, g, unknown or other
  misc_feature (163)..(163): n is a, c, g, or t
tcagatatcgcgagcacgaccggtgctcgatttagtgagtcagtaaggggagtcgagtctcagtcaggacacagcatggacatgagggtccccgctcagctcctgggctccgtgctactctggctccggaggtgccagatgtgacatccagatgacccagtcnccatcctcctagtctgcatctgtagacacagacgtcaccatcacttcggccggcaagtcagagcattgcaccttattaaattgtatcaggagaatcgaaggaacgaccctaaactcctagtactctattgactgctatacctacgtttacgactaaacggtcggggtacctacgtacgtaacgggtttcaggtcgggtactaaggtggtagtaccggttacggggactaacggtatttttaccgacttaccgttactaacccgtattaccgtaaacgccttacggttactacggtacctaaaccgttaggaaactttcgttttacgaaccttaaacgttttacaccgttcgtaacctaacctaggttaaacgttacgaaccgttccgtaaccccgttaggttacccggtcggtacccgaacgggtaaccggtaaacgggttacggaaaccttaccggaaaagttaacccggtaagttacggtaccgttaccgggaccaacccgttcgtaccgtttacccg

SEQ ID NO: 287970 - DNA, 568 bp, Homo sapiens
  misc_feature: GYAE6OF02HHKAN.6.19.B08.1.454.CMB.1.raw
  modified_base (215)..(215): a, c, t, g, unknown or other
  misc_feature (215)..(215): n is a, c, g, or t
  modified_base (419)..(419): a, c, t, g, unknown or other
  misc_feature (419)..(419): n is a, c, g, or t
tcagatatcgcgagcacgaccggtgctcgatttagtgagtcagtaagggggagtcagtatcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggnaagtcagagcatagcactattaattgtatcagagaatcaggaacaccctaactcctgatctatgatgcatcctactttgacgtaaggtcgggtcccagtctaaggttcaggtggacgaggtggatgtcgggacaggtatttcgacttacgtacctaccattacgacgtctagtctgacctaaccgttagtaacgttacgtttanaccgttaacctttactaccttgtaaccgaacgtagtaacgttactacgtccgtacccgtacggtacgttaccggaccgacgggaaccgtaaggtacggaaacgtaccgaaacgtaacgtgtacggactggacctacgtacttcgttacg

SEQ ID NO: 287971 - DNA, 694 bp, Homo sapiens
  misc_feature: GYAE6OF02H3W6L.6.19.B08.1.454.CMB.1.raw
  modified_base (199)..(199): a, c, t, g, unknown or other
  misc_feature (199)..(199): n is a, c, g, or t
  modified_base (317)..(317): a, c, t, g, unknown or other
  misc_feature (317)..(317): n is a, c, g, or t
tcagatatcgcgagcacgaccggtgctcgatttagtgagtcagtaagggggagtcagtctcagtcaggacacagcatggacatgagggtccccggctccagctcctgggctcctgctactctggctccgaggtgccagatgtgacatccagatgacccagtcctccactccctccctgtctgcactctgtaggacacanagtcaaccatcacttggaccgggacaagcagagctagttagcactaatttaaattggtaatacagaagtaatccgaagggaaaccacccctaaacgtacctagaatactatgatgcancctacttgacaaaggtcgggtacccataccgaagtttacgaggtacgcgtaaggtacggtacttacgtacggggaactaaggtattttaccgtaaacgttcctacctaacctacggttactaacgacgaacgttcgtacgaccaaccgtaagtaagttattttaacggactaaacgttaacctacgttataacccgttaaacgaacgtaacgtttaacgaccggtaaccgtcccccggtacggtaccggttaccgtttaccgaaccggggaacctaacgggggtaaaaccggaaagttaaacccggaaaacggttaaaaccccgtaaggtttacgggaacccgttagaacccgttaacaccggtaccctttaacggg

SEQ ID NO: 287972 - DNA, 536 bp, Homo sapiens
  misc_feature: GYAE6OF02FOP1Q.6.19.B08.1.454.CMB.1.raw
  modified_base (270)..(270): a, c, t, g, unknown or other
  misc_feature (270)..(270): n is a, c, g, or t
  modified_base (349)..(349): a, c, t, g, unknown or other
  misc_feature (349)..(349): n is a, c, g, or t
  modified_base (398)..(398): a, c, t, g, unknown or other
  misc_feature (398)..(398): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccgagggaaacncccctaaaactcctagatctatgatgcatccactttgacaaaggtcgggtcccatcaaggttcagtggcaggtgatcgnggacagtatttcactctcaccatcagcagtctgacctaacctgtaagtntttgacctaacttactactgtaccaacgtacgtagttacgagttccgccccgtacggtaccgttccgaccgtaacgggaccgaagggtacgaaactaccgaaaacgtacgtggtacggactacgaccactatcgtacg

SEQ ID NO: 287973 - DNA, 564 bp, Homo sapiens
  misc_feature: GYAE6OF02JD9BT.6.19.B08.1.454.CMB.1.raw
  modified_base (372)..(372): a, c, t, g, unknown or other
  misc_feature (372)..(372): n is a, c, g, or t
  modified_base (380)..(380): a, c, t, g, unknown or other
  misc_feature (380)..(380): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtagacacagagtcaccatcacttggccgggcaagtcagagcattagctaccttaatttaaattggtatcgaggagaatccgaagggaaacgcccctaaatcctgatctatgatgcatcctacttgactaaggtggtccatcaaggttcagtggcagtgatcgtggacagtatttcactcacactatcancagtctanacctagtagattattacgacctaacttacgtacgttacactaacgtacgtaagttacgtaccgtcccgtacccggtaccggtcggttaccgaaccgtacggtaaccggaacggttaacggaaactaaaccggaaaccgttaccggtaggtccggtacttccggacctacgtacgttacgtaccg

SEQ ID NO: 287974 - DNA, 542 bp, Homo sapiens
  misc_feature: GYAE6OF02G27IJ.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctagatctatgatgcatccactttgacaaaggtcggggtcccatcgaaggttcagtggcaggtggatcgtgggacagtatttcactctcaccatcagcagtctgaccaactgtaagtattttacgctaacttactacgtatcaaactagtacgttaactagttcgaccccgttcggaccgttacggaccgtacgggaacgtaacgggtacggaaactaacgaaaccggtaagtacggtaggcgtgaccgtacctatcgttacg

SEQ ID NO: 287975 - DNA, 714 bp, Homo sapiens
  misc_feature: GYAE6OF02JNUT5.6.19.B08.1.454.CMB.1.raw
tcagatatcgcgagcacgaccggtgctcgatttagtgagtcagtaagggggagtcagtctcagtcaggacacagcatggacatgagggtcccgctcagctcctgggctcctgctactctggctccgaggtgccagatgtgacatccagatgacccagtctccatcctcctgtctgcatctgtaggacacagagtcaccatcacttggccgggcaagtcagagcattagctaccttatttaatggtatcaggagaatccgaagggaacgaccctaaactcctagtactctatgatgctatcctactttacgactaaacggtcgggtaccctagtacgtaaaggttctaaggtcgggacgtaggttagggtaacttcggttacggggaactaacggtacttttaccgacttacccgtacctaacctacttaccgaacgtaccgtaacgttccttacggaccctaaaccgttaggtaaaagtttacgtttttacggaacctttaaacctttaccgttacgttacgttaacctaaaccgtagttaacgtttaaccgtacggtacccgtccccgttacggtacccggttaccggaaccggtaaccggggtaaccgtaaacgggttaaccgggtaaacgttaccgggtaaaaacccgtaaccggttagggttaaccgggtaccgtcggtaaaccgtacccgttaattacccggtttaccg

SEQ ID NO: 287976 - DNA, 543 bp, Homo sapiens
  misc_feature: GYAE6OF02H0W30.6.19.B08.1.454.CMB.1.raw
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (381)..(381): a, c, t, g, unknown or other
  misc_feature (381)..(381): n is a, c, g, or t
  modified_base (395)..(395): a, c, t, g, unknown or other
  misc_feature (395)..(395): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctattaaatgtatcagganaatcagggaaacnccctaaactcctagatctatgatgcatccactttgactaaaggtcgggtaccagtacaaggtttcagtggcaggtgatcgtggactagtactttcactcncaccntacagcagtcngaccaactagaatnttttagactaacttactaactgtacaactagtaacgttacacgttcgtccccgtaggtaaccgtcgaccgtaacgggtacgaagggtacgtaaacgtaacgaaaccggtaacgtggtacggtcgtacgaccaaccgttactcgttacg

SEQ ID NO: 287977 - DNA, 508 bp, Homo sapiens
  misc_feature: GYAE6OF02IO4AI.6.19.B08.1.454.CMB.1.raw
  modified_base (504)..(504): a, c, t, g, unknown or other
  misc_feature (504)..(504): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaaattggtatcaggagaatccagggaaagcccctaaaactcctgatctatgatgcatccatttgcaaagtggggtcccatcaaaggttcagtggcagtggatctgggacagattttcactctcaaccatcagcagtctgcaacctgaaagtattttgactaaacttacctacttgtacaaacagagttacagtcgacccctcggacgttcgaccgacgggaaccaaggtaggaaactacaaacgaactgtaggcttgcactatnttcg

SEQ ID NO: 287978 - DNA, 531 bp, Homo sapiens
  misc_feature: GYAE6OF02JGMCE.6.19.B08.1.454.CMB.1.raw
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (410)..(410): a, c, t, g, unknown or other
  misc_feature (410)..(410): n is a, c, g, or t
  modified_base (425)..(425): a, c, t, g, unknown or other
  misc_feature (425)..(425): n is a, c, g, or t
  modified_base (445)..(445): a, c, t, g, unknown or other
  misc_feature (445)..(445): n is a, c, g, or t
  modified_base (450)..(450): a, c, t, g, unknown or other
  misc_feature (450)..(450): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatccacttgccgggcaagtcagagcattagctacctatttaaattggtatcgaggagaatccgaagggaacacccctaaatcctgactctatgatcgctactcctactttgactaaaggtcgggtaccattacgaaaggtttcaggtcggcaggtggatcgngggacagtntttcactctcacatcagcagtctacgcaacctgaattntttcgactacttacncttgacaacgtagtattacngttcnccccgtaggtaccgttcgaccgtacggaccgtaaggtcggaaatccggaaacgtagtcgaggtctcgacacctagtactcg

SEQ ID NO: 287979 - DNA, 578 bp, Homo sapiens
  misc_feature: GYAE6OF02GNGYR.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtagacacagagtcaccatcacttgccgggcaagtcagagcattagcacctatttaaattgtatcaggagatccgaagggaacgacccctaaactcctgatctatgatgcactcctacgtttgacgtaaaggtcggggtacccagtactaaggttcaggtggacaggtggatcgtagggacagtactttcactctaccaccatacagctacgtctacgaccaacctagaacgttatttacgactaaaccttactacgtgtacaacgtagtacgttacacgttccgtaccccgtacggtaccgttaccggaccgacgggtaaccgtaagggtacggtaaacgtaccgaaaaccgtaacgtaggtacggtaccgtacgacctacctacgtcgttacg

SEQ ID NO: 287980 - DNA, 522 bp, Homo sapiens
  misc_feature: GYAE6OF02FH0S4.6.19.B08.1.454.CMB.1.raw
  modified_base (269)..(269): a, c, t, g, unknown or other
  misc_feature (269)..(269): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacncccctaaactcctgatctatgatgcatccactttgactaaaggtcgggtacccagtcgaaggttcagtggacagtggatcgtgggacagtactttcactctcaccatcagcagtctgaccaacgtgaagtattttagacctaacttactactgtacaactacgtagttacgagttccgccctacggtacgttccggaccgacgggacaaggtaggaataccgaaacgtaacgtgtagctagccactagtctcg

SEQ ID NO: 287981 - DNA, 585 bp, Homo sapiens
  misc_feature: GYAE6OF02IG2HA.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaacgacccctaaactcctgatctatgatgcatccactttgactaaaggtgggtcccatacgaaggttcaggtggcgagtggtatcgtggacagtatttcactctcacctatcgacgtcagttcacgactaaccgtgtaacgttattttacgacctaactttactactgttaccaaactgtaacgttaacgacgttcccgtccccgtacgggtaccgttaccgggtacccgaacgggtacccgtaaagggtacggtaaaactacgtaaaaccgtacgttaaggtcggtaccgtgtaacccgtacgtaccgttagttacccgg

SEQ ID NO: 287982 - DNA, 684 bp, Homo sapiens
  misc_feature: GYAE6OF02FFXNJ.6.19.B08.1.454.CMB.1.raw
  modified_base (225)..(225): a, c, t, g, unknown or other
  misc_feature (225)..(225): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtcgacatccagactcgacccagtcctccatccctcctgtctgcatctagtacgacacagcgtcaccgatccacgttcggccggganaacgtcacggagtactaagttacacctaaccttaattttaaacgttggtactaccgaaggtaacgtaacgtaccggtaacggggtaaacctaccccgttaaactccgtagacttactatgactcgtacacttacctacgttacgaacgtaacggtccgggtacctacgtacggtaacgtcgaggtcgacgtacggttacgtacgtacggtacggtaacctacggttaccttaccaccttacacgaacctacgtacgacgtacgtacgttaccgtacgtaaccgtaacgttagtaacttacgtttacaacccttaacttaccgtattacgtaacaacggttacgtacgtacgtaccgtaccgccgttaccggtacgtaccggaacgtaacggtaacgtaagggtaacaacgtaaccgtaacgtcgtacggtacgacgtaccgtcacgttcgtacttaccg

SEQ ID NO: 287983 - DNA, 542 bp, Homo sapiens
  misc_feature: GYAE6OF02G5TQM.6.19.B08.1.454.CMB.1.raw
  modified_base (254)..(254): a, c, t, g, unknown or other
  misc_feature (254)..(254): n is a, c, g, or t
  modified_base (268)..(268): a, c, t, g, unknown or other
  misc_feature (268)..(268): n is a, c, g, or t
  modified_base (408)..(408): a, c, t, g, unknown or other
  misc_feature (408)..(408): n is a, c, g, or t
  modified_base (536)..(536): a, c, t, g, unknown or other
  misc_feature (536)..(536): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaatggtatcagganaatccagggaaacnccctaaactcctgatctatggatgacactccactttgacgaaaggtcgggtaccatactaaggttcaggtggctaggtggatcgtggactagtactttcactctcaccatcagcagtctacgactaaccgtgtaaacgtntttcgactaacttactaatcgtaacaacgtagtacgtaactacgtcgtcccgtacggtaccgttcggaccgtaagggaccgtaagggaacggtaaatacgaaacgtacgtggacgtacgtgacctacntcgtcg

SEQ ID NO: 287984 - DNA, 680 bp, Homo sapiens
  misc_feature: GYAE6OF02HTNUH.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctcctgtctgcatctgtaggacacagagtcaaccatcacgttgccggcaagtcagagctattacgctacttaatttaaattggtatcgaaggtagaatccgaagggaaacgtaccccttaaactccgtagtacttctaagttcgactcgactacttacctactttcgaccgtaaaaggtcggggttaccacgtacgtaaggttacgaggttggacgtaggtacggtaacttcgtagggtaactaaggtactttaccgtaaccgttacctaccgtaaccctaacgttaccacgtacgtacgttaccgttacggaccttaaaccgtaagtaacgtttaactttttacggaacttaaacctttactacgttacgtaacctaacgtacgtaacgttacgacgttaccgtccccgtacggtaccgttacggacgaccgggtaacgtaacgggtaaggtaactaacggaaacggtaaccgtacggtacggtactacgtaccgtactacgttcgttaaccg

SEQ ID NO: 287985 - DNA, 606 bp, Homo sapiens
  misc_feature: GYAE6OF02IC2MP.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccggcaagtcagagcattagcaccttaatttaaattggtatcaggagaatccgaagggaaacgacccctaaactcctagactactatgatgactatcctacttttgacgtaaaggttcgggtacccagtactaaggttcaggtcggactaggtaggactacgtagggactaggtacttttcacttctaccaacctattacacgctagttctacgtacctaaccgttaggaaacgttattttacgaccttaaactttactaaccttagtaaccaaacgtagtaacgttacgacgttcgcccccgtaggtaccgttaccggaccgtaacgggaaccgtaacgggtaaggaaactacgaaacgtaacgtggtacgacgtcgacctaaccgtactcgttacg

SEQ ID NO: 287986 - DNA, 701 bp, Homo sapiens
  misc_feature: GYAE6OF02HZ9RW.6.19.B08.1.454.CMB.1.raw
  modified_base (216)..(216): a, c, t, g, unknown or other
  misc_feature (216)..(216): n is a, c, g, or t
  modified_base (258)..(258): a, c, t, g, unknown or other
  misc_feature (258)..(258): n is a, c, g, or t
tcagatatcgcgagcacgaccggtgctcgatttagtgagtcagtaaagggggagtcagtctcagtcaggacacagcatggacatgagggtccccgctcagctcctgggctcctgctactctggctccgaggtgccagatgtgacatccagatgacccagtcctccatcctccctgtctgcatctgtaggacacagagtcaccatcacttgccgggnaagtcagagcattagcaccttaattaaattggtatcgagganaactccgaagggaaacgcccctaaactcctagactctatgatgctatcctactttgacgtaaaggttcgggtacctaagtactaaaggtttcaggtcggacaggtggtatcgtagggactagtacttttacactctaccgaacctatccagtactagtcgtcgaccgtaaccgtagtaaacgtattttacgaccttaaaacgtttaccaacgttagttaacctaaacgtacgttaacgttaacccgtaacggttacccgtacccccggttacgggttaacccgggtttaccgggtaacccccggtaaacgggggtaaaccccgtaaagggggttaaccggtaaaaccgtttaaaccggaaaaacccggttaacggttacgggttaacccgggtaccgttaccggtaacccgttaaacccgttacgtttacccggtttaaccgg

SEQ ID NO: 287987 - DNA, 508 bp, Homo sapiens
  misc_feature: GYAE6OF02GJP10.6.19.B08.1.454.CMB.1.raw
  modified_base (268)..(268): a, c, t, g, unknown or other
  misc_feature (268)..(268): n is a, c, g, or t
  modified_base (386)..(386): a, c, t, g, unknown or other
  misc_feature (386)..(386): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaancccctaaatcctagatctatgatgcatccactttgcaaagtgggtcccatcaaggttcagtgcagtggatcgtgggacagatttcactctcaccatcagcagtctgcaacctgaagtnttttacgacctaaacttactactgttacaaacagtagttacagtcgcccctacggacgttccggaccgacgggaccaaggtaggaaactacgaaacgaactgtacggctagacaccatctcg

SEQ ID NO: 287988 - DNA, 563 bp, Homo sapiens
  misc_feature: GYAE6OF02JGISY.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccaagggaaacgcccctaaaactcctgatctatgatgcatcctatttgacaaaggtgggtacccatcaaggttcagtggcagtgatcgtggacagtatttcacgtctcacatcagcagtcacgacaacctgaagtatttcgacctaactttactactcgtacaaacgtagtaacgttactaggtacgaccccgttggtaacccggttcggaacccggtaacggggaaccgtaaaggggtacggtaaaactaaccgtaaaacggtacgttacggtacggtaccgtgtaccacctagtccttaccgg

SEQ ID NO: 287989 - DNA, 778 bp, Homo sapiens
  misc_feature: GYAE6OF02JZZMM.6.19.B08.1.454.CMB.1.raw
  modified_base (95)..(95): a, c, t, g, unknown or other
  misc_feature (95)..(95): n is a, c, g, or t
  modified_base (298)..(298): a, c, t, g, unknown or other
  misc_feature (298)..(298): n is a, c, g, or t
tcagatatcgcgagcacgaccggtgctcgatttagtgagtcagtaagggggagtcagtctcagtcaggacacagcatggacatgagggtccccgntcagctcctgggctcctgctactctggctccgaggtgccagatgtgacatccagatgacccagtctccactccctcctgtctcgacatcgtggtaacggaccacgaggtactaccacctatcctacgttcgggcccgggataacgtcaaggacgctaagttacgacctaacctttaatttaaagtggtactacggaaggtaanaacttcccgggaaagggaaaccctacccccttaaagtccgtagtacttacgtagttcgaactcgtacctaaccgtttacccgttagtttacgaaccggttaaacggggttcccgggttacccaagttacccgggttaaacggttgtaacggttcgggactaagggttacggacgtttaccggagggaactagtttacttttaccgaccttaccgtacaacccttataccgagtacctcgtacgtacgaaccctaaaggtgttaaactttcgtttacaaccttaaactttactaccgttacgtaaccaagttacggtaccgtttacaaccgggtttcccgtaaaccccgttcgggtaaccggtttaccgggaacccgggtaacggttaccggtaaagggtaacgttaaaaccgttaacggaaaacccggtttcgtacggggttactccggtaaccgtaccccaatttacccgtcttaccgg

SEQ ID NO: 287990 - DNA, 587 bp, Homo sapiens
  misc_feature: GYAE6OF02GATQC.6.19.B08.1.454.CMB.1.raw
  modified_base (271)..(271): a, c, t, g, unknown or other
  misc_feature (271)..(271): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagagcattagcaccttatttaaattggtatcaggagaatccgaagggaaacncccctaaatcctagatctatgatgcatcctatttgactaaggtcgggtccagtcaaggttcaggtgcagtggatcgtgggactagtatttcgactctcactatcagcagtctgacctaacctggtaagttattttacgaccttaaactttacctaacgttcgttaaccgaaacgtagtaacgtttaacacggttcccgaccccgttacgggtaaccggttccggacccgtaacgggaccggtaagggtaacggtaaaaccgtacgtaaaaccgtacgttggtacggtcctacggtaccaaccttagtccgttaccg

SEQ ID NO: 287991 - DNA, 576 bp, Homo sapiens
  misc_feature: GYAE6OF02G6SZM.6.19.B08.1.454.CMB.1.raw
  modified_base (267)..(267): a, c, t, g, unknown or other
  misc_feature (267)..(267): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttggccggcaagtcagagcatagcactatttaaattggtatcaggagaatccgaggaaacncccctaaactcctagatctatgatgctatcctatttgactaaaggtcgggtacccagtcaaggttcagtgcagtgatcgtgggacagtntttacnctctcacctatcagctagtcagaccaacgttgaaagttattttacgactaactttactactacgtactaacgtagtaacttacgtacgttaccggtcccgttacggtaccggttaccggaccgaacgggtaaccgtaaagggttaacggaaacttaacggaaaaccgtaacgttcggtacggtcctacggaccctaaccgtacgttccttacgg

SEQ ID NO: 287992 - DNA, 520 bp, Homo sapiens
  misc_feature: GYAE6OF02FSQLS.6.19.B08.1.454.CMB.1.raw
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
  modified_base (397)..(397): a, c, t, g, unknown or other
  misc_feature (397)..(397): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccatatgtgacatccagatgacccagtctccatcctccctgtctgcatctgtaggacacagagtcaccatcacttgccgggcaagtcagagcattagcacctatttaaattggtatcagganaatccgagggaaacncccctaaactcctgactctatgatgcatccactttgacaaaggtcgggtcccagtcaaggttcaggtggcaggtggatcgtgggactagtatttcactctcaccatcagcagtctgcaactgaagtntttgactaacttactactgtacaactagtagttacacgtccgtcccgtcggacgttccgaccgacgggaccgaagggtaggaaactaccgaaacgtacgtgtcggacgtacgcacctatctcg

SEQ ID NO: 287993 - DNA, 634 bp, Homo sapiens
  misc_feature: GYAE6OF02JHZUK.6.19.B08.1.454.CMB.1.raw
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagagcattagcacctatttaaatgtatcagganaatccaagggaaancccctaaactcctagactctatgatgcactcctactttgactaaacggttcggggtaccctaagttccgtaaaggttttcaaggttcgggacctaggtggtactcgttaggggaactaggtacttttacacttcgtacctaaccgattccgacgctagttctacgacctaaccgtagtaaacgttattttcgaccttaaactttactacgttcgtaccaaacgtagtaacgttaactaacggttcccgtaccccggttacggtaccggttccgtaacccgaacgggtaaccgtaagggtacgtaaacgtacgtaaaaccggacgttacggttcggacctacggacctaacccgtattaccgttaccgg

SEQ ID NO: 287994 - DNA, 668 bp, Homo sapiens
  misc_feature: GYAE6OF02IV8U7.6.19.B08.1.454.CMB.1.raw
  modified_base (263)..(263): a, c, t, g, unknown or other
  misc_feature (263)..(263): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatctacttcggccgggacaagtcagagcattagacaccttaatttaaattggtatcgagganaataccgaagggaaacgacccctaaactcctagacttctatgaatcgactactaccctagtttcgacgtaaagggttcggggtacccctaatacgtaacggtttacgaggtggactaaggtggtatccggtagggactacggttactttaccgaccttcctaccaacctaagtaccacggtactacggtcctaccgaaccgtaaccgttaggtaaactttagtttaccgaacttaaacctttaccttaccgtagtaaactaacggaagttaacgttaaccgtccggtacccgttccccggtaacggtacccgttaccgggaacggtaaccgggtaacgtaacgggtaaacgaaaccttaaccggaaacgttacggtcggtacgcgtacgactacgtctgttaccg

SEQ ID NO: 287995 - DNA, 588 bp, Homo sapiens
  misc_feature: GYAE6OF02HIPL0.6.19.B08.1.454.CMB.1.raw
  modified_base (253)..(253): a, c, t, g, unknown or other
  misc_feature (253)..(253): n is a, c, g, or t
  modified_base (333)..(333): a, c, t, g, unknown or other
  misc_feature (333)..(333): n is a, c, g, or t
  modified_base (383)..(383): a, c, t, g, unknown or other
  misc_feature (383)..(383): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagagcattagcacctatttaaatggtatcagganaatccagggaaacgcccctaaactcctagatactatgatgcatcctatttgactaaaggtcgggtacccatcgaaggttnagtggcaggtggatcgtagggacagtactttcactctccacctatcagcngtctcgactaacctagtaagttattttcgacctaacttaacgtactacgttaacaaacgtagtaacgttacgacgttacgccccgtacgggtaaccgttaccgggacccggaacgggtaacccgtaaaggggtacggaaaacgttaccgaaaaccgtaaccgtaggttacggaccgttacgacccgtaaccgtattacccgttcg

SEQ ID NO: 287996 - DNA, 548 bp, Homo sapiens
  misc_feature: GYAE6OF02JMMNR.6.19.B08.1.454.CMB.1.raw
  modified_base (222)..(222): a, c, t, g, unknown or other
  misc_feature (222)..(222): n is a, c, g, or t
  modified_base (250)..(250): a, c, t, g, unknown or other
  misc_feature (250)..(250): n is a, c, g, or t
  modified_base (263)..(263): a, c, t, g, unknown or other
  misc_feature (263)..(263): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagngcattagcacctattaatggtatcaganatccagggaaacnccctaaatcctgactctatgatgcatcctacttgacaaaggtcgggtacctagtactaaggttcagtggcagtggatcgtagggacagtattcgactctcaccatcagctagtcagtacaaccgtagaacgtattttacgacttaacttactactagtacgaacagtaacgttacacgttaccgcccgtagtaccggttaccgaccgtaacggaaccgtaacggtacggaaaatccggaaaacgtaaccgtagtacggacttacgacgtacctaacgtccttacg

SEQ ID NO: 287997 - DNA, 533 bp, Homo sapiens
  misc_feature: GYAE6OF02GW2GL.6.19.B08.1.454.CMB.1.raw
  modified_base (270)..(270): a, c, t, g, unknown or other
  misc_feature (270)..(270): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcacctatttaaattggtatcaggagaatccagggaaacncccctaaactcctagatctatgatgcatccactttgacaaaggtcgggtcccatcgaaggttcaggtggcagtggatcgtgggacagtatttcactctacacatcagcagtctgccaactgtaagtattttagactaacttactactgtacaactagtacttacacgttaccctcggtaccgttacggcccaagggtacctaagggtacggaaactaccgaaacggacgttaggtaggacgtcgacacctagttcgtagttcc

SEQ ID NO: 287998 - DNA, 548 bp, Homo sapiens
  misc_feature: GYAE6OF02FV73H.6.19.B08.1.454.CMB.1.raw
  modified_base (371)..(371): a, c, t, g, unknown or other
  misc_feature (371)..(371): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcagagaatccagggaaagcccctaaactcctgatctatgatgcatccactttgactaaagtgggtcccatcaaggttcagtggcagtggatcgtgggacagtatttcactctcaccatcganctagtctgaccaacctgtaatattttcgacttaacttactactcgtacaactagtaacttacagttccgaccccgttcgggtaccgttccggaccgtaacgggaaccgtaagggtacggtaaaactacgaaaaccggtacgtaggtacggccttaggacctacctacgttcgttacg

SEQ ID NO: 287999 - DNA, 648 bp, Homo sapiens
  misc_feature: GYAE6OF02I6M90.6.19.B08.1.454.CMB.1.raw
  modified_base (256)..(256): a, c, t, g, unknown or other
  misc_feature (256)..(256): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttggccgggcaagtcagagcattagcacctatttaaatggtatcgagganaatccgaaggaacgaccctaaactcctagatactatgatgcatccatttgacgtaaggtcgggtacctatacgaacggtttacagtcggactaggtggatacgtagggactaggtactttacgactctacaacctataccgtaagctagtactacgtaacctaaccgtagtaacgttagttttacgaacttaaaccgtttactaaccgttagtaacctaaacgtaagttaacgtttaacgacggttacccgtaccccgttaggtaaacccggttaccggtaacccggaacgggtaacccggtaaaggggttaacggtaaaccgtaacggtaaaaccgaacggttacggtaacgggttccgtacgtaacccgtaaccgttacgttcgttaacg

SEQ ID NO: 288000 - DNA, 563 bp, Homo sapiens
  misc_feature: GYAE6OF02HOVUM.6.19.B08.1.454.CMB.1.raw
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagctaccttatttaaattggtatcagganaatccgaagggaaacncccctaaactcctgactctatgatgcatcctactttgacaaaggtcgggtacccatacgaaggttcagtggcaggtggatcgtgggactagtactttcactctccaccatacagctagtctgacctaaccgtagtaagttattttgaccttaacttactacttgtaccaatagtaagttactacgtccgtccccgtacggtaccgttccggaccgtaacgggaaccgtaagggtacggaaactacgtaaacgtaacgtggtacggacgtacgacctaaccgtatcttacg

SEQ ID NO: 288001 - DNA, 530 bp, Homo sapiens
  misc_feature: GYAE6OF02H90LZ.6.19.B08.1.454.CMB.1.raw
  modified_base (270)..(270): a, c, t, g, unknown or other
  misc_feature (270)..(270): n is a, c, g, or t
  modified_base (342)..(342): a, c, t, g, unknown or other
  misc_feature (342)..(342): n is a, c, g, or t
  modified_base (374)..(374): a, c, t, g, unknown or other
  misc_feature (374)..(374): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccgagggaaacnccctaaactcctagatctatgatgcatccactttgactaaaggtcgggtccatcaagttcagtggcagtggntcgtgggacagtatttcgactctcaccatcancagtctgactaactgaagttatttcgactaacttactactgtaccaactgtagttacagtccgtccccgtaggtaccgttccggaccgaacgggtacgtaagggtacgtaaacctacgaaacgtacgtaggtcggactcgaccactacgtcttacg

SEQ ID NO: 288002 - DNA, 581 bp, Homo sapiens
  misc_feature: GYAE6OF02JHPK7.6.19.B08.1.454.CMB.1.raw
  modified_base (377)..(377): a, c, t, g, unknown or other
  misc_feature (377)..(377): n is a, c, g, or t
  modified_base (425)..(425): a, c, t, g, unknown or other
  misc_feature (425)..(425): n is a, c, g, or t
  modified_base (447)..(447): a, c, t, g, unknown or other
  misc_feature (447)..(447): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtcctccatcctccctgtctgcatctgtaggacacagagtcaccatcacttgccgggacaagtcagagcaattagcaccttatttaaaattggtatcaggagaatccgaagggaaacgtacccctaaactccttagatactatgatgctatccatttgactaaaggtcgggtacccatcgaacggtttcaggtgacagtggatcgtaggacagtacttnactctacacactacacgctagttctagacctaacgttggtaaacgttntttcggaaccttaacgtttaanaccgttataccaaacgtagtacgttacgtacgtccgtccccgtaggtacgttccgaccgagggtaacctaagggtacggtaaactcggaaaaccgacttacggcggtactcggaacctaccctattaccgtccg

SEQ ID NO: 288003 - DNA, 699 bp, Homo sapiens
  misc_feature: GYAE6OF02H3U13.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcaccttaatttaaattggtaatcaggagaatccaagggaaacgccctaaactcctagacttactatgtatgctactcctacgtttcgactaaacggtcgggtaccagtacgtaaaggttcaggtcggtacgtaggtggtacgtcggtacgggaactaggttaacttttaccaacgtttcctaacctaccctattacacgtactaggtcctagtaccctaaacgttaggaagtttaacttttcgaaccttaaactttaccttaaccttacgtaacctaaacgtaacggttaacgtttaaccgtaacgttcccggtacccccgttacgggtaacccgggtttacccggaaccggtaaccgggtaacccggtaaagggttaaacggaaacccgtttaaaccgaaaaccggttaaccggtacgggttaccggtacctaccggtaaccctaacgttccgttacgtttaacccgg

SEQ ID NO: 288004 - DNA, 740 bp, Homo sapiens
  misc_feature: GYAE6OF02IS8Q4.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctcctgtctgcatctgtaggacacagagtcaccatcacttgccgggcaagtcagagcattagcactattaattgtatcagagaataccgaaggaaacgaccctaactacctagactactatacgatgctatacctactttgacgtaaaggtcggggtacctatacgaaggttcaaggtcggacgtagtaggactacgtacgggaacgtaggtacttttaccaacttacctacgtaacccaattccgaaggactagtacgttacgacctaaaccgttagtaaacgttacttttacggaaccttaaacccttaacgttaaccgttacgttaacccgtaaaacgtaacgtaaacggttttaaccgtaaccgtttacccggtacccccggtttaacggggtaaccccgggttttacccggggaaccccggtaaacgggggggtaaacccccgttaaacgggggtaaaccggggtaaaaacccggtttaaaccgtaaaaaacccgggtaaaccgttaaccgggttaacggtacccggtttaacccggaccggttaaccctaccgtttaccgttaccgg

SEQ ID NO: 288005 - DNA, 535 bp, Homo sapiens
  misc_feature: GYAE6OF02GRSRP.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcacctatttaaatggtatcaggagaatccagggaaacgcccctaaactcctagatctatgatgcatcctactttgacgtaaaggtcggggtacccagtacgtaaggttcagtggcagtggatcgtgggacagtactttcactctacacatcagcagtctcgaccaactgaagtatttacgactaacttactactgtacaactagtacgttacacgtcgcccgtcggtacgttacggaccgagggaccgtaagggtacgtaaacgtacgaaacgtacgtggtacggctagaccactactcgtacg

SEQ ID NO: 288006 - DNA, 547 bp, Homo sapiens
  misc_feature: GYAE6OF02GMVQT.6.19.B08.1.454.CMB.1.raw
  modified_base (216)..(216): a, c, t, g, unknown or other
  misc_feature (216)..(216): n is a, c, g, or t
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
  modified_base (429)..(429): a, c, t, g, unknown or other
  misc_feature (429)..(429): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttggccgggnaagtcagagcattagcacctatttaaatggtatcagganatcgagggaacncccctaaatcctgatctatgatgcatccatttgacaaaggtcgggtaccagtacaaggttcagtgcagtggatcgtggacagtactttcgactcncacatcagctacgtcngcaactagtatatttacacttaacttactactgtacaactagtacgttacncgttccgccccgtaggtaccgttaccgggaccgaacgggtaccgtaagggtaacgtaaacgtaaccgtaaacggtaacgttaggtacgtccgtacgacctaactacgtccgttaccgg

SEQ ID NO: 288007 - DNA, 553 bp, Homo sapiens
  misc_feature: GYAE6OF02GFUNZ.6.19.B08.1.454.CMB.1.raw
  modified_base (257)..(257): a, c, t, g, unknown or other
  misc_feature (257)..(257): n is a, c, g, or t
  modified_base (272)..(272): a, c, t, g, unknown or other
  misc_feature (272)..(272): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggacaagtcagagcattagcacctatttaaattggtatcagganaatccgagggaaacncccctaaactcctgatctatgatgcatcctactttgacgtaaaggtcggggtacccagtacgtaaggttcaggtggcgagtggatcgtgggactagtatttcactctcacctatcagcagtctgaccactagtaagtatttcgacttaacttactaactcgtacaactagtacgttacagtccgtcccgtacggtacgttccggaccgacgggaaccgtaagggtaacggtaaactaacgaaacgtaacgtggtacggcgtacgacctactacgtcttacg

SEQ ID NO: 288008 - DNA, 608 bp, Homo sapiens
  misc_feature: GYAE6OF02H1GVO.6.19.B08.1.454.CMB.1.raw
  modified_base (290)..(290): a, c, t, g, unknown or other
  misc_feature (290)..(290): n is a, c, g, or t
  modified_base (381)..(381): a, c, t, g, unknown or other
  misc_feature (381)..(381): n is a, c, g, or t
  modified_base (425)..(425): a, c, t, g, unknown or other
  misc_feature (425)..(425): n is a, c, g, or t
  modified_base (494)..(494): a, c, t, g, unknown or other
  misc_feature (494)..(494): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccggaggtgccagatgtgacatccagatgacccagtctccatccctccctgtctgaccatctgtaggacacgagagtcaaccatcacttggaccggactaacgtcaagacgacaatttacggacctaacctttaaattttaaagttaggttaatccgaagggtaanaaacgtccgaaagggaaacgaccccctaaagtcctagactactatgaatgctaatccgatttgactaaggtacgggtccaatccgtaagtntaagtggactaggcggtagtctagggacagtctttacgcttacnctaaccgatcgagactagtacgacgacctaacgtagtaacgtttattacgacttaacgttactacgtanaacgtaaactagtaacgtactaccgtacgcccgtaaggtctcggaaccgacggtacgaacggtataaacgaacgtaaccgtagtcggtacgacgtacgtaccacgtacgtctag

SEQ ID NO: 288009 - DNA, 570 bp, Homo sapiens
  misc_feature: GYAE6OF02F2M5G.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccgagggaaacgcccctaaatcctgatctatgatgcatccactttgacaaagtcggggtacccatcgaaggttcaggtcggcaggtggtaatcgtagggactaggtatttcactctacaccatcagcagtctagacaacctgtaagtattttcgacctaactttactacttgtactaacgtacgtagttaactacgtcgtccccgtacggtaccgttccggaccgtaacgggaacccgtaagggtaacggaaacgttaaccgaaaccggtaacgttaggtacggacgtcgacctaaccgtataccttaccgg

SEQ ID NO: 288010 - DNA, 801 bp, Homo sapiens
  misc_feature: GYAE6OF02IKO4O.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctcgagtgccagatgtgacatccagatgacccagtctccatcctccctgtctgcatctgtaggacacagatccaccatctacttcggccggacaaagtcaggacgctaagttacgactaaccttaattttaaaagtggttaatcgaaggtaagaactaccgaaagggaaaccgtacccctaaactcctagtacgtctaagtcgaatcgactactcctactttcgaacgtaacggtcgggtccaagtaccgtaaggttcaggtcggactaggtggtaagtcgttaagggacgtagttacttttaccacgttacctaccgtaaccctaagttaccgacggtaccttaacggttaccgttaccggaaccctaaaccgttaccggggttaaaattttaaccgtttttaccgaaccctttaaaaccgtttaccgttaacccgtttagttaaacccgtaaaacgttacggttaaacggtttaaccgttacgggttaaccccgggtaccccccgggtttaaacgggttaaccccgggtttacccggaaaccccgggtaaacccgggtaacccgggttaaaccggggttaaaacgggtaaacccgtaaaccggttaaaaccggaaacggtttacccgggttgggtaaccgtaccgtaacccgtaaccgttaacctcgtttaacccgg

SEQ ID NO: 288011 - DNA, 553 bp, Homo sapiens
  misc_feature: GYAE6OF02ITBIE.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcactatttaaatgtatcagagaatccaagggaaagcccctaaaactcctagatctatgatgacatccactttgacaaagtcgggtaccatcaaggttcagtggacagtggatcgtgggacagtatttcaactctacaccatcgagctagtctagaccaaaccgttgaaagttattttacgacttaaactttactacttgtaccaaactagtaacttacacgttcgccccgttaggacgttaccggaccgaagggaccgtaagggtacgaaacgtaacgaaaaccgaacgttagtacggacctagaccaacctagtacgttacg

SEQ ID NO: 288012 - DNA, 650 bp, Homo sapiens
  misc_feature: GYAE6OF02JVHNV.6.19.B08.1.454.CMB.1.raw
  modified_base (230)..(230): a, c, t, g, unknown or other
  misc_feature (230)..(230): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtctccatcctccctgtctgcatctggtaggacacagagtccaccatcacttggccgggacaagtcagganctattagctactatttaaatggtatcgaggataataccgaagggaaacgacccctaaacgtcctagtactctatgatcgactactacctattcggactaaacggtcgggtaccagtacgtaacggttcaggtcggacgaggtggtaactcggtacgggaactaggttacttttacgaccttaccgtacctaacctacgtaccgaaggtacctaacggttacttacgaacccgtaaaccgtaggttaaacgtttagttttacaaccgttaaacttacgtaactacggtaacctaaagtacgtaaacttacggtaccgttccgaccccgttacggtaccggttaccggacccgtaagggtaccgtaggtaacgaaactacggtaaacgtacgtagtacggctacgacctactagtccgttag

SEQ ID NO: 288013 - DNA, 582 bp, Homo sapiens
  misc_feature: GYAE6OF02F8O0J.6.19.B08.1.454.CMB.1.raw
  modified_base (276)..(276): a, c, t, g, unknown or other
  misc_feature (276)..(276): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctcctgtctgcatctgtaggacacagagtcaccatcacttcgccgggcaagtcagagcattacgcaaccttatttaaattggtatcgaggagaactccgaagggaaacncccctaaatccgtagactctatgatcgctatcctatttcgacgtaaaggtcgggtaccagtacgtaggttcaggtgcgaggtgatcgtggacagtactttcactctacactatcgagcagtctcgaccctaacgttagtaaagttacttttacgaacttaacttaccttaactcgttacaacgtacgttaacgttacctacgtcgtccccgtacggtaccgttaccgaaccggtaggaaccgaagggtaacgtaaacgtaaccgaaacgtacgtaggtcgtaccgtacgacctaccgtatcttacg

SEQ ID NO: 288014 - DNA, 717 bp, Homo sapiens
  misc_feature: GYAE6OF02ISB07.6.19.B08.1.454.CMB.1.raw
  modified_base (159)..(159): a, c, t, g, unknown or other
  misc_feature (159)..(159): n is a, c, g, or t
  modified_base (196)..(196): a, c, t, g, unknown or other
  misc_feature (196)..(196): n is a, c, g, or t
  modified_base (217)..(217): a, c, t, g, unknown or other
  misc_feature (217)..(217): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccngtctccatcctcctgtctgcatctgtaggacacgagngtcaccatcacttggccgganaagtcagacgctattacgcctaacttaatttaaacgttggttaactacgaaggtaacgtaaacgttaccggaacgggtaaaaccgtaccccctaaaacgttccgtagtaacttactagtagagtcgactactaccttacgtttagaacgtaaacgggtccgggtacccaagttacgtaaacgggtttacgaacgggttcggtacgtagggtagtacgtacggtaggggtaactaggttacctttacgaccttacctacgtaacctactacgacgtcgtaacgtctaccgacgtaaccgtaggtaaacttacgtttacgacctaactttacgtaccttagtaacgtaacgtacgtacgttaaccgtacgttcccgtaacccgttcggtaaccgttcggtaacccggtaacgggaaccgttaacggggtaactaaaccggtaacgtaaaccgtacggttacggtaacgtccgtacgaaccctaccgtacctacggtttaccg

SEQ ID NO: 288015 - DNA, 612 bp, Homo sapiens
  misc_feature: GYAE6OF02FZ9HG.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtcctccatccctccctgtctgcatctgtaggacacagagtcaccatcacttgccgggcaagtcagagcattagcaccttatttaattggtatcaggagaatccagggaaacgcccctaaactcctagatctatgatgcactcctatttgacgtaaaggtcgggtacccagtacgtaaggttcaggtggctaggtggactcgtagggactagtactttacactcaccacatcagctagtactcgacctaacgtagtaagtacttttacgaccttaaactttacctaacttcgtaactaaacgtagtaacgttaactacggttaccgtaccccgttacgggtacggttacccggaaccggtaacggggtaaccgtaagggtaacggtaaaacttaaccgaaaaccggtacgttacgggtacggtaccgtaccgacctaaccgttactccgttacg

SEQ ID NO: 288016 - DNA, 564 bp, Homo sapiens
  misc_feature: GYAE6OF02IASW0.6.19.B08.1.454.CMB.1.raw
  modified_base (273)..(273): a, c, t, g, unknown or other
  misc_feature (273)..(273): n is a, c, g, or t
  modified_base (290)..(290): a, c, t, g, unknown or other
  misc_feature (290)..(290): n is a, c, g, or t
  modified_base (351)..(351): a, c, t, g, unknown or other
  misc_feature (351)..(351): n is a, c, g, or t
  modified_base (408)..(408): a, c, t, g, unknown or other
  misc_feature (408)..(408): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgaccccagtctccatcctccctgtctgcatctgtaggacacagagtcaaccatcacttgccgggcaagtcagagcattagctacctaattttaaatggtatcgaggagaatcagggaaacnccctaaactcctgactntatgatgctatcctactttgacaaaggtcgggtccatcgtaaggtttcagtggctagtggntctgggactagtactttcactctacaccatcagctagtctagaccaactgaaagttntttcgacttaacttactactacgtacaaacgtgtaagttacacggttccgtccccgtacggtaccgttcccggaccgaacgggactaaggggtacgtaaacgtaaccgaaaccgtaacgtacggtcggactaccgaccaaccgttactacgttccg

SEQ ID NO: 288017 - DNA, 568 bp, Homo sapiens
  misc_feature: GYAE6OF02JFYX9.6.19.B08.1.454.CMB.1.raw
  modified_base (251)..(251): a, c, t, g, unknown or other
  misc_feature (251)..(251): n is a, c, g, or t
  modified_base (272)..(272): a, c, t, g, unknown or other
  misc_feature (272)..(272): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctcatcctcctgtctgcatctgtaggacacagagtcacatcacttgccggcaagtcagagctattagcacctatttaaatggtatcagganaatccaggaacgccctaaacncctgactctatgatgcatctattgactaaaggtcggtaccatcaaggttcaggtcgctaaggtggactcgtagggacagtatttcactcgtacacagtcagctagtctgacaactagtaacgtattttcgaactaactttacctacgttactacgaactagtaacgttaacgacgttaccgccccgttacggaccgtttaccggaaccgtacgggaacgtaacgggtaaggtaaaccgtaacgaaaccggtaactacggtacgggtactaccgggtactaaccgacgttcttaccg

SEQ ID NO: 288018 - DNA, 699 bp, Homo sapiens
  misc_feature: GYAE6OF02I1R1U.6.19.B08.1.454.CMB.1.raw
  modified_base (215)..(215): a, c, t, g, unknown or other
  misc_feature (215)..(215): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcacatcacttcggccgggnaagtcagagcattagcaccttatttaaattggtatacgaggagaatcgaaggaacacccctaaactcctagtactctagtgatgcatccctacgtttcgactaaacgggttcgggtaccccagttacgtaaggtttccgaggttggaccgtagtcggtaacgttcgtaggggaacctaggttactttttaccgaacctttccgtcccgtaaacccagttaccctaacggtacgtaacgtccgttacgaaccctaaacccggttagtaaacgtttacgtttttaacgaaccttaaaccctttacgttaaccgttcgttaaaccaacggtaacgttagttaaccgacggttaccctaccccgggtaccggttaaccgggttacccggaaccgtaaccggggtaaccgtaacggtaacgggtaaaacctacggaaaaccgttaccgttagggtaccgtacgtaacgccctaaccgtattccgttacg

SEQ ID NO: 288019 - DNA, 709 bp, Homo sapiens
  misc_feature: GYAE6OF02JFLKY.6.19.B08.1.454.CMB.1.raw
tcagatatcgcgagcacgaccggtgctcgatttagtgagtcagtaagggggagtcagtctcagtcaggacacagcatggacatgacgggtccccgctcagctccgtgggctcctgctactctggctccggaggtgccagatgtgacatccagatgacccagtctccatcctcctgtctgctatctgagacacagatcacatcacttggccggacaagtcagagactattacgactaacttaatttaaagttggtaactcgaaggtaacgtaacgtaccggaaaggggaaacctaccccttaaaactccgtaggtacttaccgtaagtacggtaactcgacctaacgttcccttaagtttacgacgtaaacgggtcggtaccaagtacgtaacggtcaggttacggcgtaggtagtacttcggtacggtaactacggttacttttaccgacgttaccgtaaccgtaaccttaacgtccgaacgttaccgttaacgggttcctaaccggtaaccgtaaccgttaaggttaacgtttacttttacgaacctttaacttaccggtacttacggtaactaacgtaggttaacgttacctaccgtccgtaccccgttaggtaacccgtcgggaaccgtacgggaaccgtaagggtaaccgtaaactaccgaaacgtaccggttgacccggtactacgacctacgtctccgttacg

SEQ ID NO: 288020 - DNA, 576 bp, Homo sapiens
  misc_feature: GYAE6OF02F41BW.6.19.B08.1.454.CMB.1.raw
  modified_base (256)..(256): a, c, t, g, unknown or other
  misc_feature (256)..(256): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcaccttatttaaattggtatcagganaatccgaggaaacgccctaaactcctagatctatgatgctatcctactttgacgtaaaggtcgggtacccagttacgaaggttcaggttggacgtaggtggtatcgtagggactagtactttcactctcactatcacgcgagtctcgacctaaccgtagaagttattttcgacttaacttactactcgtactaactagtacttacgtacgttccgtacccgtacgggtacgttccgggaccgaacgggacgaacgggtacggaaactaaccggaaacgtaacgttaggtacggtaccgtgaccctaccgtatccgtaccg

SEQ ID NO: 288021 - DNA, 729 bp, Homo sapiens
  misc_feature: GYAE6OF02I7TB7.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtcctccactccctccctgtctgctatcgtgtaggacacaagagtccacctactctaccgttcgggcccgggactaagtcaagacgctaattagacctaaccttaaatttaaacgttggtactacggaaggaacgtaacgtaccggaaacgggtaaaccgtaacccccgttaaaaccgtaccctagtaacttaccgttaagtacggtatacgaccttacttacccgttaacgttttacgaacgtaaacgggttccgggtaccctacgtacgtaacggttcgaggtcggtacgtaggtcggtacgtcggtagggtaactaggttactttcacctacctaccgtaacctactcacggtactacgtccgtacgtacctaaccgttaggttaagtttacgtttacgtaaccttaaacttaccttaacgttacgtaactaacggtacgttaacgttaaccgtacgttcccgtaccgttaccggtaccggttaccggaaccggtacggaacgtaacgggtaacgtaaacgtaacgtaaacgtacgtggtacgtactacgacctactacgtcttacg

SEQ ID NO: 288022 - DNA, 821 bp, Homo sapiens
  misc_feature: GYAE6OF02IO3IH.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtcctccatccctccctgtctgcatctggtaggacacgagagtccacctatcacgttggcccgggacaaggtcagacgtactagttaacgacctaacttaaattttaaaagttggttaactacgaaagggtagtaaacgtaccggaaggggtaaaacccgtacccccttaaaactaccgttagtacttacgtaagtacgtactcggacctaacgttacctacgtttacggaacgttaaacgggtccggggttaccctaagttaccgtaacgggtttccgaagggttcggacgtaggttacggacgttacggtacgggtaacgtagttacgttttccaaccgtttacgtacctaaccgtaacgttaccgaacggttaccgtaacggtaccgttaccgaacccgtaaaccgtaaggttaacgtttacttttacggaaccctttaaacgtttaaccgtaccttacgtaaacctaaacgttacggttaacttacgtaccggttacccgtaccccggttacgggtaacccggttaccgggaaccgggtaaccggggtaacgttaaccggggtaaacggtaaaaccgttaacggtaaaaccggttaaccggttacggtaccgggttaccgttacggaaccccgtaaccgttaccgttacggttacccg

SEQ ID NO: 288023 - DNA, 555 bp, Homo sapiens
  misc_feature: GYAE6OF02GS3Z2.6.19.B08.1.454.CMB.1.raw
  modified_base (272)..(272): a, c, t, g, unknown or other
  misc_feature (272)..(272): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagctacctatttaaattggtatcaggagaatccgaagggaaacncccctaaaactcctagatctatgatgctactcctactttgactaaacggtcggggtaccctatacgaaggttcaggtggcaggtggatcgtagggacagtatttcactcctacaccatcagcagtctgaccaacgtgaagttatttcgacctaacttactactacgtacaaactagtagttaacagtaccgccccgtacggtaccgttccggaccgtaacgggaccgtaagggtacgtaaactacgtaaacgtacgtagtacggtctcgaccactatcttacg

SEQ ID NO: 288024 - DNA, 522 bp, Homo sapiens
  misc_feature: GYAE6OF02JJEN7.6.19.B08.1.454.CMB.1.raw
tcagatatcgcgagcacgaccggtgctcgatttagtgagtcagtaaggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagagcattagcacctatttaaaattggtatcaggagaatccagggaaagcccctaaatcctgatctatgatgcatccatttgacaaagtgggccatcgaagttcagtgcagtgatctgggacagtatttcactctacaccatcagcagtctcgacaacctgaagtattttgacctaactttactactcgtacaacagacgttacagtccgtccccgtggaccgttcggtaccaacgggacgaacggttaggaaactacgaaaccgaacgttggtacggtcgtacgtaccaaccttatcttaccg

SEQ ID NO: 288025 - DNA, 715 bp, Homo sapiens
  misc_feature: GYAE6OF02FN06M.6.19.B08.1.454.CMB.1.raw
  modified_base (282)..(282): a, c, t, g, unknown or other
  misc_feature (282)..(282): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattacgactaccttaatttaaagttggtatacgaaggagaactaccgaagggaaacncccctaaaactcctagactctatagatgactactcctacgtttcgacgtaaaggttcgggtacccagtacgtaaacggtttcgaaggttggacgtaggtcgggtaattcggtaggggtaactaggtaacttttaccactttcctaccaaccctaataccgtacgaccgtagttaccgtacggaaccctaaacccgttaggtaaacggtttaactttttacggaacctttaaactttaccgttaccgttacgttaaccaaacgttaaggttaacgtttaacgtaacggttcccgtaccccggttacgggtaaccggttcccgggaaccggtaaaccggggtaaccggtaacggggttaaacggtaaacgtaaacccggtaaaaccggaacgtttagggtacggtcgtaccgaccgtaccttagttccgttacgg

SEQ ID NO: 288026 - DNA, 559 bp, Homo sapiens
  misc_feature: GYAE6OF02F82NN.6.19.B08.1.454.CMB.1.raw
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
  modified_base (536)..(536): a, c, t, g, unknown or other
  misc_feature (536)..(536): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcacctatttaaattggtatcaggagaatcaagggaacgcccctaaactcctgatctatgatgcatcctactttgactaaaggtcgggtacccatacgaaggtttcaggtggacaggtggatcgtgggactagtntttcacttcncacatcagcagtctcgaccaacgtagtaagttattttacgacctaacttactactcgtacaacgtagtacgttacgacgttaccgccccgttacggtaccggtttaccggaccgtaacgggacccgtaagggtacggaaacttaccgaaacgtacgttggnggtacctgaccactagtcgttcg

SEQ ID NO: 288027 - DNA, 759 bp, Homo sapiens
  misc_feature: GYAE6OF02HEF6Y.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagacgtcaccatcacttcggccggcaagtcagagcattagcaccttatttaaattggtatcaggagaatccgaaggaaacacccctaaactcctagactctatgatgactatcctactttgacgtaaacggtcgggtacctacgttaccgtaaaggtttcgaggttacggacgtacggttacgggtacgttcgtagggggaacctaaggttactttttaccgtaccttaccttacctaacccgtaacgtaccacggtcctaaacggttccgtaacggtacccgtaaaccgttaaggttaaacgtttaacgtttttacgaaccctttaaaacccttttaccgtaaccttacgttaacctaaacgtaacgttaaccggtttaaccgtacggttaccccggttccccggttaccgggttaacccggttttaccgggaacccggtaaccgggggtaaccggtaaacgggttaacgggtaaaaccgttaaaccggtaaaacccgttaacggtacggtttacggggtaccttaaccggtacccgtaaacccgttacgttacccgtttaaccgg

SEQ ID NO: 288028 - DNA, 732 bp, Homo sapiens
  misc_feature: GYAE6OF02J0BPO.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatcgacccagtcctccatccctccctgtctgcatctgtaggacacagagtcaccatcacttgccggacaagtcagagcattagcaccttaatttaaattggtatacaaggagaactacgaagggaaacgtacccctaaactccgtagtaactctaatcgtatgactactcctactttacgacgtaaaggtcggggtaccacgtacgtaacggttcgtaggtcggacgtaggtacggtagtacggtaggtacgtaagttacttttacgtaccttctaccgtaacctaacgttaccgacgtccgtaacgttccgtaacggtaccctaaccggttaagttaaacggtttactttttaacgaacccttaaacgttttaccgttaaacgttacggttaaccgtaaacgttaacggttacgtttaaccgtaaccgttccgtacccccggtaacgggttaccggttacccgggaaccggtaaccgggtaaccggttaaacgggaacggttaaactaacggtaaaaccggtaacggtttcggaacggtttcccggtaagttaacccgacccgttacggttacctttaccgg

SEQ ID NO: 288029 - DNA, 664 bp, Homo sapiens
  misc_feature: GYAE6OF02FYXPR.6.19.B08.1.454.CMB.1.raw
tcagatatcgcgagcacgaccggtgctcgatttagtgagtcagtaagggggagtcagtctcagtcaggacacagcatggaaatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcactatttaaatgtatcaggagaatcaaggaacgccctaaactcctgactctatgatgacactcctacttttcgacgtaaaggttcgggtacccaagtacgtaaagggttcaaggtcgggacgtaggtacggagtacgtagggaactaggtacttttccgaacttccgtacctaacctataccgagtccgtaacgttccgtacgacctaaaccgtagtaaacgttacttttacgaccttaaaacctttacttactacgttaacctaaacgtaagttaaccgttaactacggttacccgtaccccgttaccgggtaccggtttaccggaacccgggtaaagggacccggtaaagggtaacgggtaaaactaaccgaaaacgtaacgttaggtacggtaccgtacggaccgtaaccctagttaccgtacgttaccc

SEQ ID NO: 288030 - DNA, 645 bp, Homo sapiens
  misc_feature: GYAE6OF02GSZB1.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtcctccatccctccctgtctgcatctgtaggacacagagtcaccatcacttcggccgggactaagtcagagcaattagctaaccttaatttaaattggtatcgaaggagaatacgaaggaacgaccctaaactcctagtatctatgatgcactcctactttcgacgtaaacggtcgggtaccctaagtacgtaaggtttcgaggttcgggactaggtacggtagtcgtaggggaactaggttactttaccgtacttacctacctaaccgtatctaacgctagtcctagtaccaacgtagtaattagtttacgacttaaacgttactacgttactaacgtaacgtagttattacgacgttaccgaccccgttcggtaaccggttaccggaaccgaacgggtacccggtaaaggtaacggtaaactaaccggtaaaacgtacgttagggacgttccgtaacggtacctaccggttacttccgttaacg

SEQ ID NO: 288031 - DNA, 532 bp, Homo sapiens
  misc_feature: GYAE6OF02ILM9N.6.19.B08.1.454.CMB.1.raw
  modified_base (447)..(447): a, c, t, g, unknown or other
  misc_feature (447)..(447): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctattaaattggtatcaggagaatccgagggaaagcccctaaactcctagatctatgatgcactcctactttgactaaaggtcggggtcccaatcgaaggttcaggtggcagtggatcgtgggacagtactttcactctaccaccatcagctagtctgaccaacctgaatatttcgactaacttactactgtacaacgtagtagttacagtccncccgtcggtaccgttcggaccgtaagggacctaagggtcggaaactacgaaacgtacgtgtacggctacgacactacgtcttacg

SEQ ID NO: 288032 - DNA, 792 bp, Homo sapiens
  misc_feature: GYAE6OF02GWTM9.6.19.B08.1.454.CMB.1.raw
  modified_base (218)..(218): a, c, t, g, unknown or other
  misc_feature (218)..(218): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatgacccagtctccatcctcctgtctgcatctgtaggacacagagtcaccatcacgttggccggganaagtcgagacgctaattacgcctaaccttaattttaaagttggtaattacgaagggtaagaaacgtaccgaaggggtaaaccgtaacccccttaaaactacccgtaggtaactacgttaagtaggtaacttggtacctaactaccttaacgttttacgaaccggtaaaggttccggggtaccctagttaacgtaacggtttacgaggttcgggacgtaggtaggtacgttacggtacgggtaacgacggttactttacgtaccttacctacctaaccgtagtaccgtacggtacctacggttaccgtacgtaccgtaaaccgttaaggttaaacgttacgttttttaccgaaccgtttaaacctttaccgttaaccgtttacgtaaacgtaaaccgttaacgttaacgttaaccgtaaggttacccgtacccgttaccgggtaaccggttacggaacccgggtaacggtaacccgggtaacgggtaaacggtaaacgtaaccggtaaaaccggtaaccgttacgggttaccggtacgtaccggtaccgtaacccgttacgtaccgtttacccgg

SEQ ID NO: 288033 - DNA, 583 bp, Homo sapiens
  misc_feature: GYAE6OF02H8JCI.6.19.B08.1.454.CMB.1.raw
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtccaccatcacttcggccgggacaagtcagagcattagcctaaccttaattttaaaagttggtaactcgaaggagaatccgaagggaaaactacccctaaactcctagtatactatgatgctactccatatgacgaaaggtcgggtacccaagtacaaggttcaggtggcaggtgactcgtagggacagtactttcactctaccacctanctacgntacgtctgacgaacctgtaattatttacgaaccttaacttaactactacgtacacgtaagtacgttacacgtccgtcccgtccgtacggttcgacccgaagggtaaccgaaggtaacggaaactaacgtaaacgtacggtcggtacgacgttaccgacgtacctgttccg

SEQ ID NO: 288034 - DNA, 631 bp, Homo sapiens
  misc_feature: GYAE6OF02FNL4H.6.19.B08.1.454.CMB.1.raw
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
  modified_base (420)..(420): a, c, t, g, unknown or other
  misc_feature (420)..(420): n is a, c, g, or t
  modified_base (435)..(435): a, c, t, g, unknown or other
  misc_feature (435)..(435): n is a, c, g, or t
  modified_base (497)..(497): a, c, t, g, unknown or other
  misc_feature (497)..(497): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacgatcccaggatgacccgagtccgtccagtcctacccgtgtctgcatctgtagacacagatcacatcacgtcgccggacaagtcagagcattagcacttatttaaattggtatcgaggagtaataccgaagggaaacaccccttaaagtcctagtactactatggtatcgactactccttacgtttagaccggtaaaacggtcgggtaccccagttacgtaacggtttcaggttacggcgtaggtgatacgnggaanagtacttcactctacacctntcagcctagtcctanaccaccttaggtattcgtttagacttaaccgtttacaccgttgaacacttaagtcgttaacncgttacccgtccgttacggtaacgttcccgggaaccgtaacggggtccgaaagggttaacgtaaacgtaccccggaaaagtttccggtggttaccggtacctaccgggtaacccacctttacgtccgtttaacg

SEQ ID NO: 288035 - DNA, 729 bp, Homo sapiens
  misc_feature: GYAE6OF02J05UH.6.19.B08.1.454.CMB.1.raw
  modified_base (221)..(221): a, c, t, g, unknown or other
  misc_feature (221)..(221): n is a, c, g, or t
tcagatatcgcgagcacgaccggtgctcgatttagtgagtcagtaaggggagtcagtctcagtcaggacacagcatggacatgagggtccccgctcagctcctggggctcctgctactctggctcctaggtcgccagatgtgacatccagatcgacccagtctccatcctccctgtctgctatctgtaggacacagacgtcaccatctacttcggccgggnaaacgtccagacgacattagcctaaccttaatttaaaacttggtattacgaaggaagtaaactaccgaacggggaaactaccccccgtaaacgtcccttagaacttaccgttagttagtatacggtacctacgttccctaacgtttacgtacggtaaaacgggttccggggtacccaagttacgtaaacggtttccgtaaaggttccggagtaaacggtggtaacgtttcggagggacctaggtaacttttcgaccgttactcaccctatacgagtcacgtttcgacgtaccaaccgttagtaacgtttagtttagaccttaaaccctttgtaacccttagtacaacgaaagttacgttacgaaccgttccgtaccccgttacggtaccggttacccgaacggtaccggttaacccggtaaggtaaccgggtaaacccttaaaccgtaaaccggtttaacgacggtttacggacccgtaccgttacgacccttttacgcggtttaccg

SEQ ID NO: 288036 - DNA, 739 bp, Homo sapiens
  misc_feature: GYAE6OF02FVC57.6.19.B08.1.454.CMB.1.raw
  modified_base (224)..(224): a, c, t, g, unknown or other
  misc_feature (224)..(224): n is a, c, g, or t
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagancattagcacctatttaaattggtatcagganaatccaagggaaacnccctaaactcctagacttctatgattgacatcctaacttttgacgtaaaggtcggggtaccctaagttacgtaaacgggtttctaaggttcgggaccgtaaggttaggtaacgttacggtaggggaactaagttacgttttacctaacgttccttaccaaccctagtaccgaaggtacctacggttacttacgacctaaaccgtttaggaaacgtttacgtttttacgaaccttaaaccttttaacgtaacctttacggtaacctaaacgtaggttaacgtttaaccgtacggttacccggtaccccccgttacggggttaaacccggtttcccggggaacccgttaaacgggggtaaccccgtaaaggggttaaccgggtaaaacgttaacccggaaaaacccggttaaccgttagggtacggttacccgttaaggtacccctaaccgtaccgttaccgtttaaccgg

SEQ ID NO: 288037 - DNA, 639 bp, Homo sapiens
  misc_feature: GYAE6OF02GL5D0.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcaccttaatttaaattggtatcgaggagaatccgaagggaaacgacccctaaactcctagatactatagatgctactcctaacgtttgacgtaaacggtcgggtacccgtacgtacgtaaggttacgtacgtggacgtaggtgggtagtcggtagggaacgtagtactttactactacctaccaacctatacgacgtacgtacgtctacgaccctaacgttaggtaaacgttacttttacgtaaccttaacctttaaccttacgtacgtaactaacgtaagtaacgttacgtacgttccgtacccgtcggtaccgttaccggaccgtacgggaaccgtaagggtaacggtaaacgtaacgtaaacgtaaccgttaggtacgtcgtaccgacaccgtacgttacgttacg

SEQ ID NO: 288038 - DNA, 645 bp, Homo sapiens
  misc_feature: GYAE6OF02H4X0Y.6.19.B08.1.454.CMB.1.raw
  modified_base (257)..(257): a, c, t, g, unknown or other
  misc_feature (257)..(257): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggacaagtcagagcattagcacctaatttaaatggtatcagganaatcgaggaaacgaccctaaactcctagatctatgatgctatcctactttgactaaaggtcgggtaccctagtaccgtaaggtttcaaggttggactaggtggacttcggtaggggaactaggtacttttaccgtaccttccgtacctaacctattaccgagtacctaacgttcctacggtacctaaaccgttagaaacgtttattttacgaaccttaaacttactaacttcgtaacctaaacgtagtaacgttacacggttccgtaccccgtacgggtaaccgttccggaaccgtaacgggaacccgtaagggtaacggtaaaccgtaaccgaaaaccggtaacgtacggtacggtaccgtacgtacctaacctacttacgttaccg

SEQ ID NO: 288039 - DNA, 731 bp, Homo sapiens
  misc_feature: GYAE6OF02I87HI.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgaccccagtcctccatccctccctgtctgcatctgtaggacacagagtcaccatctacgttcggccgggcaagtcgagacgctattagctaccttaattttaaattggtatcaggagaatccgaagggaacgacccctaactcctagactctatcgatcgactactacctactttacgacgtaaaggttccgggggtacccaacgttaccgtaaacgggtttacgtacggttacggggacgtaacgggtggtaacgtttacggtacggggtacctaaggttacttttcccgtaaccttaccgtaccctaaaccgactttaccgaacgtaccggtaacgttaccgtacgtacccgtaaacccggttagttaaacgggtttaactttttacggtaaccccttaaactttttaacctaacgtttaaccggttacaaaacggttaacgtaacgtttacggtacgttacccggttacccgtacgggttacccgttacggaccggacgggtaaccgtaagggtaacggaaacttaaccggaacgttacgtaggtacggactagtacccaactacgttcgttaccg

SEQ ID NO: 288040 - DNA, 707 bp, Homo sapiens
  misc_feature: GYAE6OF02IMW25.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtcctccatccctcctgtctgcatctagtacggacacgagagtccacctatccgtacgttggacccgggactaagtcaaggagactaagttacgactaaccttaattttaaagttaggtaatacgaaggaagaacgtaccggaagggtaaaaccgtaccccctaaaaccgttcccgtacgtaacttactaagtacgtacgtcgactaccttaccttacgtttaggaacgtaacgggtccggggtacctacgttaacgtaacggttacgtaggtggacgtaggtacggtagtacgtaggtaacgtagtactttcgtaccttactacctaaccatacgacgtcgtacgttactacgtaccgtaacgttagttaaagtttacgtttacgtaaccttaaacgttactacggttactaactaacgtacgtacgttacgtacgtacccgtacccgtacggtaaccgtccgaaccggtacggaaccgtaacggtaacgtaaacgtaacgtaagtacgtacggttacgtacgtccgaacgtacctcgttacgtaccg

SEQ ID NO: 288041 - DNA, 528 bp, Homo sapiens
  misc_feature: GYAE6OF02GH7JQ.6.19.B08.1.454.CMB.1.raw
  modified_base (266)..(266): a, c, t, g, unknown or other
  misc_feature (266)..(266): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagatcagggaacncccctaaactcctgatctatgatgcatccactttgacaaagtgggtcccatcaaggttcagtggctaggtggatcgtagggactagtactttcactctcacatcagcagtctgacaacgtgaagtatttgactaacttactactgtacaactagtacgttacgagtcgtacccgtcggacgttccggaccgtaacgggaccgtaagggtacggaaactaccgaaacgtacgttaggtcggcgtacgaccactactcgttacg

SEQ ID NO: 288042 - DNA, 594 bp, Homo sapiens
  misc_feature: GYAE6OF02ISMY4.6.19.B08.1.454.CMB.1.raw
  modified_base (353)..(353): a, c, t, g, unknown or other
  misc_feature (353)..(353): n is a, c, g, or t
  modified_base (422)..(422): a, c, t, g, unknown or other
  misc_feature (422)..(422): n is a, c, g, or t
  modified_base (446)..(446): a, c, t, g, unknown or other
  misc_feature (446)..(446): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagagcattagctacctatttaaattggtatcaggagaactaccgaagggaaacgaccctaaactcctagtactctatgatgactactacctactttgactaaggtcgggtacccagtacaaggttcaggtgganaggtaggtatcgtaggactagtatttcactactctaccatcagactacgtctgactaaccgtgtaagtntttgtacctaaccgttactacgtntaacgaataacgtacgttaacacgttccgtacccgttacggtaacccggtcggtaacccggaacgggtaaccgtaaagggtacggaaacgttaaccggtaaaccgtagttacggtacggtaccgtacgtaccaaccgtactcgttacg

SEQ ID NO: 288043 - DNA, 592 bp, Homo sapiens
  misc_feature: GYAE6OF02I13SW.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttggccggcaagtcagagcattagcacctatttaaattgtatcaggagaatcagggaaagccctaaactcctgatctatgatgctatccactttgacaaagttcggggtacccagtcaaggttcagtggcagtggatcgtgggacagtactttcacttctacacctatccgagctagtctcgtaccgaaaccgtagtaagtcttttaggacctaacttactacgttgtacaacagtaagttacgtagtaccgtccccttaccggacgtttccggaaccgtacgggaacccgtaaggggtaaggtaaccgtaaccggtaaaccggtaaaccgttaggttaacgggtccgttaccggaccgtaacccgtagttacccggtttaaccgg

SEQ ID NO: 288044 - DNA, 793 bp, Homo sapiens
  misc_feature: GYAE6OF02I45EP.6.19.B08.1.454.CMB.1.raw
  modified_base (132)..(132): a, c, t, g, unknown or other
  misc_feature (132)..(132): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtnccagatgtgacatccagatcgacccagtctccatccctcctgtctgcatctgtagacacgagacgtcaccatcacgttcggcccgggactaaaggtccaaggacgtcctaagtttacggacctaacctttaattttaaaagttcgggtaactacggaaggtaagtaaacttacccggaaacgggaaaaaccgtaccccccttaaaaacgttcccgtaggtaacttaccgttaaagtacgtaaacgtcgtacctaacttaccccgtttactttacgggaaaccgttaaaacgggtttccggggtaacccctaagtttaaccgtaaacggggttttacgaacggtcgggtaccgtaaagggttcggttaaacctggttaaccgggggactaacggtttaacttttccgtaccttaccgtaacctaaccgtactaccgtaaacgtcgtaacgttcgtaacgtacctaaaccgtaggttaacgttacgttttaacgaacttaaaccgttactacgtacttaacgaaaccttaggtaacgttacgtaacgtccgtaccccgtggtaaccgtccgaaccggtacgggtaaccggtaaggtaacgggtaaactacggtaaaaccgtgttaggaccggttacgctaacccggtaacttacgacgtttcg

SEQ ID NO: 288045 - DNA, 577 bp, Homo sapiens
  misc_feature: GYAE6OF02FNXJ5.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaacttggtatcaggagaatccagggaaacgcccctaaactcctgatctatgatgcatccactttgacgtaagtcggggtcccatcgaaggttcaggtggcagtggatcgtgggactagtacgtttcacttctacaccatcagctagtctagcaacgtgaagtatttcgactaacttactacttagtacaacgtagtacgtttacaggttaccgttccccgtcggttaaccggttaccggacccggaaacggggtacccgaacgggtaacgggaaacttaaccgtaaaaccggaacgttacggtaggaccgtcggaacctaccgtacgttcgttaccg

SEQ ID NO: 288046 - DNA, 626 bp, Homo sapiens
  misc_feature: GYAE6OF02GUGQU.6.19.B08.1.454.CMB.1.raw
  modified_base (193)..(193): a, c, t, g, unknown or other
  misc_feature (193)..(193): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacanagagtcaccatcacttcggccgggacaacgtcaagagcaattacgcctaaccttaatttaaagttggtaattcgaaggataacgtccgaagggaaacgtaccccctaaactcctagacttactatgatgactactacctatttcgacgtaaaggtcgggtacccacgtacgtaaggttcgaggttggacgtaggtggagtcgtaggacgagttactttacactctacacctatacagtcagttctacgacctaacgtagaagtttacgtttcgaacttaacgtttactacgtacgtaacgaaactagtaacgttacgacgttcccggtacccttaccgggtaccgttccgaaccgacggtaaccgaagggtaaacgtaactaaccgtaaacggtacgttcggtacgtacgtaccgacctaccgtagtcttacg

SEQ ID NO: 288047 - DNA, 557 bp, Homo sapiens
  misc_feature: GYAE6OF02HOR4B.6.19.B08.1.454.CMB.1.raw
  modified_base (384)..(384): a, c, t, g, unknown or other
  misc_feature (384)..(384): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaactccaagggaacacccctaaatcctagatctatgatgcatcctatttgactaaaggtcgggtccatacgtaaggttccaggtggctaggtcgatcgtaggactagtatttcactcgtaccacatcanccagtctgacctaactggtaattcgttgacctaactttactacctagtactaacgtagtacgttacacgttcctccccggtagtaccgttacgaacgtacgggaacgtaagggtaacgaacgtaacaaaccggtacgtaggtacggtccgtacggaacctacgtagtcttacg

SEQ ID NO: 288048 - DNA, 722 bp, Homo sapiens
  misc_feature: GYAE6OF02HGWSQ.6.19.B08.1.454.CMB.1.raw
  modified_base (224)..(224): a, c, t, g, unknown or other
  misc_feature (224)..(224): n is a, c, g, or t
  modified_base (704)..(704): a, c, t, g, unknown or other
  misc_feature (704)..(704): n is a, c, g, or t
tcagatatcgcgagcacgaccggtgctcgatttagtgagtcagtaagggggagtcagtctcagtcaggacacagcatggacatgaggtccccgctcagctcctggggctcctgctactctggctccgaggtgccagatgtgacatccagatgacccagtctccatcctccctgtctgcatctgtaggacacagagtccaccatcacttgccggacaagtcagancattagcactaatttaattgtatcgagagaactcgaaggaaacacccctaaactcctagtactctactagtactcgactactcctaacttttacggaacgtaaaacggttccggggtaccctaaacgttacgtaaacggttacgtacggttacgggacgtaacgggttacgggtaacgttaccgggtaggggtaaaccgtaaggtttaacctttttaccgtaaacccgttccgttaaacccctaacccttaaaccgttacccgtaaaccggtcccgtaaacggttacccgtaccgtaaacccgtaaacccggttaacggttaaacgttttaacgttttaccggaacctttaaaaccgtttaacctacgttacgttactaaaccgtaagtaaccgtttacgacgttacccggtcccctacggtaccgtacggaccgtaacggaaccgtaggtaacgaacgtaacaacgtacgtagcgtacncgaccacgtactattacg

SEQ ID NO: 288049 - DNA, 607 bp, Homo sapiens
  misc_feature: GYAE6OF02JMXDP.6.19.B08.1.454.CMB.1.raw
  modified_base (256)..(256): a, c, t, g, unknown or other
  misc_feature (256)..(256): n is a, c, g, or t
  modified_base (284)..(284): a, c, t, g, unknown or other
  misc_feature (284)..(284): n is a, c, g, or t
  modified_base (374)..(374): a, c, t, g, unknown or other
  misc_feature (374)..(374): n is a, c, g, or t
  modified_base (387)..(387): a, c, t, g, unknown or other
  misc_feature (387)..(387): n is a, c, g, or t
tcagatatcgcgagcacgaccggtgctcgatttagtgagtcagtaagggggaggtcgagtctcagtcaggacacagcatggacatgagggtccccgcgtccagctcctggggctccgtgctactctggctcgaggtgccagatgtgacatccagatgacccagtctccatcctccctgtctgctatctgtaggacacagagtcaccatcacttgccggcaagtcagagcatagcacctattaaattggtatcaganatcgaggaactccctaaactcgagactntatgatgcatcacttcacgaaaggtcggtaccatacgaaggtttcagtggcagtggtatcgtgggaacagtatttcacttcactacctancagacgtatcgtnacctaacttggagttattttacgactaacctttacgtactacgttaccaaacgtacggtaaggttaacctacggtacccgttcccccggtaaccggttacggggtacccgtaaccgtaacgggggtaacctaaggggtaaacccgggtaaaattaccggaaaaacccgttaccggtggaacccggttcggccgggtaaacccacccttagtaccgttacg

SEQ ID NO: 288050 - DNA, 650 bp, Homo sapiens
  misc_feature: GYAE6OF02JE96Y.6.19.B08.1.454.CMB.1.raw
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
tcagatatcgcgagcacgaccggtgctcgatttagtgagtcagtaaggggggagtcagtctcagtcaggacacagcatggacatgagggtccccgctcagctcctggggctcctgctactctggctcgaggtgccagatgtgacatccagatgacccagtctccatcctccctgtctgcatctgtagacacagagtcacatcacttggccgggnaagtcagancattagcacctattaaattggtatcaggagataccgaagggaaacgacccctaaactacctgactctagtgatgacatacctagtttgactaaaggtcggggtaccctaagtacgtaaacgggtttcgaggttcgggacgtaggtcggtacttcgtaggggaacctaggttaacgttttccctaacgttcctaccgaaccctaacttacgaacgtctaacgttcttaggaccctaaaccgtagaaagttacttttaggaccttaacttaacgtactagtaccgaacacgtaacgttaacacgttccgtaccccggttcggaacccggtttcggaaccgtaacgggtaaccggaaggttaacggaaacttaaccggaaacgtaaccgttaggaccggtacgtaccggacctaacctacgttcgttacg

SEQ ID NO: 288051 - DNA, 635 bp, Homo sapiens
  misc_feature: GYAE6OF02GYEJS.6.19.B08.1.454.CMB.1.raw
  modified_base (266)..(266): a, c, t, g, unknown or other
  misc_feature (266)..(266): n is a, c, g, or t
  modified_base (426)..(426): a, c, t, g, unknown or other
  misc_feature (426)..(426): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccggaggtgccagatgtgacatccagatcgacccagtcctccatccctccctgtctgcatctgtaggacacgagacgtcaccatcacgttgaccgggcaagtcagagacattagctaacttaatttaatggtatcgagganactcgaagggaaccacccctaatcctagatctagtgtactcgctactacctacttgaacgtaacggtcgggtaccagtacgtaaaggttcgaaggtcggacgtaggtcggtacgttcggagggtaaccgtagttacttttaccgacctctaccaaccgtntaccgagtcgtacgtacgtacgaacctaacgtaggttaacgttagttttacgaccttaacttactacgtacgttaccaaagtacgtattaacgtacgttaccgccccggttacggaccgttacggaaccgaacgggtaccgaacgggtagtaaacgtaacctaaacggttacgtaggtacggtcgtaccgtaccgacttactaccgttc

SEQ ID NO: 288052 - DNA, 792 bp, Homo sapiens
  misc_feature: GYAE6OF02G9TX0.6.19.B08.1.454.CMB.1.raw
  modified_base (211)..(211): a, c, t, g, unknown or other
  misc_feature (211)..(211): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctcctgtctgcatctgtagacacagagtcaccatcactgccggnaagtcagagctattacgactaaccgttaattttaaagttggtaatcgaagggtagaaacttacccggaaaggggaaaaccgtaccccctttaaaacttccgttaacggtaacttaccgttaagtacggtaattcggacctaactttacccgtaagttttcggaaccgtaaaacggggtttccggggtacccctaaagttacccgggtaaagggtttccgaagggtttcgggaccgtaagggtagggtaaccgttacgggtacgggggtaaccttaagggttacctttttaacccgaccctttaccgttaacccgtaacccgtaacttacccggagtaccgttaacgtccttaaccggaactaaacccgttagggttaaaacgtttacgttttaccgaacctttaaaacgtttacctaaacgttcgtaaaccgtaaacgttacgtaacgtttaacgacggtttacccgtacccggttacgggtaacccggtttacggaaccgggaaacgggtaaccgtaagggttaacggaaactaccggtaaacgtacgtggtaccggactagccctaactacgtcttacg

SEQ ID NO: 288053 - DNA, 815 bp, Homo sapiens
  misc_feature: GYAE6OF02GCURG.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctcctgtctgcatctgtaggacacagacgtcaccatcacttcgccgggcaagtcagagcattagcacctatttaaattgtatcaggagaatccgaggaaacgcccctaaactcctagatctatgagtgacactacctactttacgacgtaaggttacggggtccctacgttacgtaacggtttcgacgttgggaccgtaaggttacgggtaagttaccgtagggggtaacctacggttaacttttcgtaaccgttaccgtacctaaccctacttaccgaacgttaccgtaacggttaccgtaccggtaaccctaaacccgtttaacggtaaacgttttacgtttttaaccgtaacccgtttaaaacccttttaacccgttaaccgtttaccgttaacccgttaaaaccggaaggttaaaccgttttaaccggaacccgggttttaccccggaaccccccgttttacccggggaacccgggttttacccgggaaacccggtaaaccggggtaacccggttaaacggggtaaaccggggttaaaaccttaaacccgggaaaaaaccgggtttaaccgtttaacgggtttaacccgggtacgttaaccgggtaccccggaacccttacggtttaccccgttttaacccgg

SEQ ID NO: 288054 - DNA, 646 bp, Homo sapiens
  misc_feature: GYAE6OF02GZT9Y.6.19.B08.1.454.CMB.1.raw
  modified_base (520)..(520): a, c, t, g, unknown or other
  misc_feature (520)..(520): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatcgacccagtctccactccctccctgtctgctatctgtaggacacagagtcaccatcacgttcggccggacaagtcgagagctattacgactaaccttatttaaattggtatacgaggagtaacgtaccggaacgggaaacctaccccctaaaactccgtagtacttactataggtactcgactactcccttacgtttacgaacgtaaacggtcgggtaccctagtaccgtaaaggttcgtaggtcggtacgtacggtagggtactcggtaggacgtagttactttacctactactaccctactactacgtacgactagtcctacgacctaaaccgtagtaacgtttattacgacttaacgtactacgtntaacgatacggtacttaaccgcggtaccgttcccgtacggtaccggttacggaccgaacggtacgaagggtaactaaacgtaccaaaggtaccgtggtacgtacgctacgaccgtactcgttaccg

SEQ ID NO: 288055 - DNA, 658 bp, Homo sapiens
  misc_feature: GYAE6OF02G55SI.6.19.B08.1.454.CMB.1.raw
  modified_base (497)..(497): a, c, t, g, unknown or other
  misc_feature (497)..(497): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatcgacccagtctccactccctcctgtctgctatctgtagacacagatcacatcacttcggccgggacaagtcaagagctattacgactaaccttaattttaaaagttggtaatacgaaggaacgaacgtaccggaaacgggaaaacgtaccccctaaaactccctagtacttactaagtgactgacctacttacccgtatttacggaacgtaaacgggttccgggtacccctaagtaccgtaaaggtttcgaggtaggacgtaggtagtacgtcgtagggaactaggttacctttaccactttccaccactataccgagctacgtctagacctaactgtaaacgttntttacgacttaaacttctactagtaaccaagtagtacttacgacgttacccgcccggttaggtaccggttaacgggaccgtaaacgggtaccgaaagggtaacgaaacttaccggaaacgtaccggtgtaccggacctggaccctaacttcgttccgtacg

SEQ ID NO: 288056 - DNA, 531 bp, Homo sapiens
  misc_feature: GYAE6OF02FQDK7.6.19.B08.1.454.CMB.1.raw
  modified_base (216)..(216): a, c, t, g, unknown or other
  misc_feature (216)..(216): n is a, c, g, or t
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (400)..(400): a, c, t, g, unknown or other
  misc_feature (400)..(400): n is a, c, g, or t
  modified_base (415)..(415): a, c, t, g, unknown or other
  misc_feature (415)..(415): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggnaagtcagagcattagcacctatttaaattggtatcagganaatccagggaaancccctaaactcctgatctatgatgcatcctactttgactaaaggtcgggtacccatcgaaggttcagtggcagtggatcgtgggacagtatttcactctcaccatcagcagtctgaccaactgaatatttnactaacttactactntacaacagtacttacgacgtcgtccccgtagggtaccgttccggaccgaacgggacgtaagggtaacggaaactaccgaaacgtacgtggtacggctcggaccacctatcgttacg

SEQ ID NO: 288057 - DNA, 565 bp, Homo sapiens
  misc_feature: GYAE6OF02HDCUA.6.19.B08.1.454.CMB.1.raw
  modified_base (368)..(368): a, c, t, g, unknown or other
  misc_feature (368)..(368): n is a, c, g, or t
  modified_base (382)..(382): a, c, t, g, unknown or other
  misc_feature (382)..(382): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccggcaagtcagagcattagcacctatttaaattggtatcaggagaatccgaagggaaagccccctaaaatccctgacttctatgatgcatccaactttgacaaagtcgggtacccagtcaaggttcagtggcagtggatcgtgggacagatttcactcncacatcagcagtcngccaaccgtgtaagtattttagactaactttactacgtagttaccaaacgtagtaacgttactaagttccgtacccccttgggtaaccgtttcccgaaccggaacgggtaacctaaggggtaacggaaacgtaccgaaacggtaacgtggtacggtactacgtaccgtacctagtcccttacg

SEQ ID NO: 288058 - DNA, 536 bp, Homo sapiens
  misc_feature: GYAE6OF02HBSCL.6.19.B08.1.454.CMB.1.raw
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagagcatagcactattaatgtatcaganaatcgaggaacnccctaaactcctagactactatagatgctactcctactttgactaaaggtcgggtcccatacaaggtttcagtgcagtgatcgtagggatagtatttcgactcacacatcagcagtcacgtacaaccgtagtaattatttcgactaacttactactgtaacctaaacagtaacgttacagtacccgcccgttacggaccgttaccggaccgaacgggtaccaaagggtagtaaactacgaaaacgtaacgtgtacgctacgacaacctatcgttacg

SEQ ID NO: 288059 - DNA, 707 bp, Homo sapiens
  misc_feature: GYAE6OF02IA156.6.19.B08.1.454.CMB.1.raw
  modified_base (258)..(258): a, c, t, g, unknown or other
  misc_feature (258)..(258): n is a, c, g, or t
  modified_base (281)..(281): a, c, t, g, unknown or other
  misc_feature (281)..(281): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgccatctgtaggacacagagtcacctatcacttgccgggacaagtcagagcattagctacctaatttaatggtatcagganatcgaggaacacctaactcctanactctatgatgctactcctacgttttagacgtaaagggttccgggtaccctaacgtaccgtaaacgggtttaccgtaaggtacggtacgtaaggtcgggtacgttaccgtacggggtaaccgttaaggttaactttttaccctaaccgtttcctaacccgtaaccctacgttaccgacgtacgtacgtccttacggaacctaaccgtagtaaacgtttacgttttacgaaccttaaactttactaaccgttagttaaccgaaacgtacgtaaacgttaaccgtacgttacccggtccccgttacgggtaccggtttaccggaccggtaaccgggtaaccggtaacgggtaacggtaaaccgttaaccggaaaccgttaacgttcggtacggtacgtaccgtaaccctaccgttactacgtttaccg

SEQ ID NO: 288060 - DNA, 612 bp, Homo sapiens
  misc_feature: GYAE6OF02G84I1.6.19.B08.1.454.CMB.1.raw
  modified_base (215)..(215): a, c, t, g, unknown or other
  misc_feature (215)..(215): n is a, c, g, or t
  modified_base (255)..(255): a, c, t, g, unknown or other
  misc_feature (255)..(255): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggnaagtcagagcattagcacttaatttaaatggtatcagganaactccgaagggaaacgcccctaaatcctagactctatgatgctactccatttgacgtaaggtcgggtacccatacgtaaggttcaggtcggactaggtcggattcggtagggaactagtactttcaacctctacacctatcagctacgtcacgacctaacgtagtaacgttacttttacgaacttaactttactacgtagtaacctaaacgtagttacgttaacacgttccgtacccccggttaggtaacccggttccggaaccgaaccggggtaacctaaacgggtaacggtaaaacgtaccgaaaacggtaccgttaggtacggtaccttacggaccctactacgttcttaccg

SEQ ID NO: 288061 - DNA, 599 bp, Homo sapiens
  misc_feature: GYAE6OF02GBUAE.6.19.B08.1.454.CMB.1.raw
  modified_base (259)..(259): a, c, t, g, unknown or other
  misc_feature (259)..(259): n is a, c, g, or t
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
  modified_base (391)..(391): a, c, t, g, unknown or other
  misc_feature (391)..(391): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgctatctgtaggacacagacgtcaccatccacttcgccgggcaagtcagagcattagctacctatttaattgtatcagganatcgaggaaacnccctaaatcctnatctatgatgctatcctacttgacgtaaaggtcgggtaccatacgtaaggttcaggtggactaggtgatcggtagggacagtacttctacgtctacgaacctatcganctagtcgtcacctaacgtagtaattatttacgacttacttactaccttagtacaaacgtagtaacgttacgtacgtccgaccccgttacgggtacccggttacggaacccggtaacgggaaccgtaaacgggttaacgggaaacttaaaccggaaaccgtaacgttacgggtacggtacgtacgtaccaacccgttgtaccgtttacg

SEQ ID NO: 288062 - DNA, 639 bp, Homo sapiens
  misc_feature: GYAE6OF02JOAEG.6.19.B08.1.454.CMB.1.raw
  modified_base (619)..(619): a, c, t, g, unknown or other
  misc_feature (619)..(619): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccattccacgttcggacccgggcaagtcagagcctaagtttagcaaccttaattttaaaagttggtaattcgaaggagtaactccgaaggggtaaacgacccctaaaactccgtagactctaagtggaatcgctactcctactttacgacgaaacggttccgggtaccacgtaccgtaaggttcgaggttacggacgtaaggtggacgttacgtagggtacaagttatttccgaacttccgtacacctactacgagccttaggtcctaacgaccaacctagtaacgttactttacgacttaaactttactaccgttagaccaaacgttgtaacgttacgtacgttaccgtcccgtacggtaccgttcggaaccgtacgggaacctaaggtaacgaatacgtaaacgtacgtggtacgtanacgtaccacttctacgttcg

SEQ ID NO: 288063 - DNA, 689 bp, Homo sapiens
  misc_feature: GYAE6OF02JUF7D.6.19.B08.1.454.CMB.1.raw
  modified_base (194)..(194): a, c, t, g, unknown or other
  misc_feature (194)..(194): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgctatctgtagacacagngtcaccatcacttggcccgggataagtcagacgctattagctaacttatttaaattggtaatcgaggagtaacgtcgaaggaaactacccctaaactccgtagtacttactagtgatcgctacgtcctactttagacgtaaacggtcgggtaccctacgtacgtaacggttcctagggtcgtacgtaaggtcggtagttccgtagggactaacggttactttaccgacttccgtacgaaccctagtaccgacgtacgtacgttacctacggtaacctaaccgttaggtaaacgtttcgtttttaaccgaacctttaaaccgtttaaccttacgttacggtaacctaaacgtagttaaacgtttaaccgtacgttcgtacccgttaccggtacggttaccgttccggaaccggttaacggaaccggttaaagggttacgaaacgtaaaccgtaacgtaacgttaggtacggtaccacgttacgtacctagttaccg

SEQ ID NO: 288064 - DNA, 741 bp, Homo sapiens
  misc_feature: GYAE6OF02H5XQN.6.19.B08.1.454.CMB.1.raw
  modified_base (347)..(347): a, c, t, g, unknown or other
  misc_feature (347)..(347): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccggaggtgccagatgtgacatccagatcgacccagtcctccatccctcctgtctgcatctgtagacacagacgtccaccatcacgttcggaccgggacaaggtcaggacgctaagttacgacctaaccttaattttaaaattggtaacttacgaagggaagaaacgtaccgaaaggggaaaaccgtacccccttaaaactccctagtaacttcctaagtanatgacctactacctactttcgactaaggtcgggtacccagtacgtaacggttcaggtgcgaggtaggtacgtcgtgggaacacggtactttaccgacttcctaccaacctactacgacgtacgtacgtactacgtaacctaaccgttaggtaaacgtttacgttttacggaaccttaaaccgtttacttaaccgtcgtaacctaaacggtacggttaacttaccggtaacgggttacccgttaccccggttaccgggtaaccggttaccgggtaacccgaaccggggtaaccggaaacggggttaaccggaaaacggttaaaccggaaacggttaacggttacggttaccgggtaccgtaccggtaaccctaaccgttaccgttcttaacccgg

SEQ ID NO: 288065 - DNA, 696 bp, Homo sapiens
  misc_feature: GYAE6OF02IVZZP.6.19.B08.1.454.CMB.1.raw
  modified_base (190)..(190): a, c, t, g, unknown or other
  misc_feature (190)..(190): n is a, c, g, or t
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtagacncagatcacatctactggccgganaaggtcagancattagcaccttatttaaattggtatcgagagaatcgaagggaacgacccctaaactcctagatactatagatcgcactaccctagtttcgacgtaaaacggttcggggtacccaacgttacgtaaacgggtttaccaggtacgggtacctaagggtaggtaacgttcgtacggggaactaggttacttttaccacgttacctaccgaacctactacgacggtcctaacgttcgtaacggtaaccctaaaccgttagtaaacgtttatttttaccggaaccttaaaccgttttaccgttaaccttacgaaactaacgtaaggttacgttaaaccgaacgttcccgtaccccggttacggtaacccgggttacggtaaccgtaaacggggacctaaacggggtacggtaaaaacgtaccgtaaaaccgtacgttaccggtacggtacctacggacctaaccgtacttgttaccg

SEQ ID NO: 288066 - DNA, 666 bp, Homo sapiens
  misc_feature: GYAE6OF02HSMRD.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtccaccatccacttggccgggacaagtcagagctattagacacttaatttaaagttgtatcgaggagaataccgaaggaacaccctaaactctagtatactagtgtatcgactactaccttatttacgaacgtaaacgggttccgggtacctaacgtacggtaaacgggtttacgaacgggttggtacgtaagggtacggttataccggttaggggaacttaggtacttttacctacgttcctaccaccgtaactacgacgactacgtctacgacctaacgtagtaatttagttacctaacttaaacgttactaactacgtaacaacgttagtacgtacgtaccgtaccgttacccgtaggtaccgttaccgggaaccgtaaccgggtaacgaacggggtaacgtaacgtaaaaccggtaaccgtaacggttcgtacggtcgtaccgtaccgtaacttacgttcgttacg

SEQ ID NO: 288067 - DNA, 630 bp, Homo sapiens
  misc_feature: GYAE6OF02GWB3X.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctctgaggtgccagatgtgacatccagatgacccagtctccatcctccctgtctgcatctgtaggacacagagtcaccatcacttggccggcaagtcagagcattagcactaatttaaattggtatcgaggagaataccgaagggaaacgacccctaaactcctagactctatgatcgcactcctactttgacgtaaaggttccggggtaccctagtacgtaacggttctaggtggactaggtggtagtcggtagggaacgtagtactttccacttctaccacctactcgagtctacgtctacgaccctaaccgttaggtaacgttattttacggaacctttaaactttaaccttacgtagttaccaaacgtaagtaacgtttacgacgttaccgtacccccgttacgggtacccgttccgggaccgtaacgggtaaccgtaacgggtaacggtaaactaacgaaaaccgtacgttacggtacggcgttaccgaccacgtacttacg

SEQ ID NO: 288068 - DNA, 624 bp, Homo sapiens
  misc_feature: GYAE6OF02IE3RQ.6.19.B08.1.454.CMB.1.raw
  modified_base (96)..(96): a, c, t, g, unknown or other
  misc_feature (96)..(96): n is a, c, g, or t
  modified_base (237)..(237): a, c, t, g, unknown or other
  misc_feature (237)..(237): n is a, c, g, or t
  modified_base (266)..(266): a, c, t, g, unknown or other
  misc_feature (266)..(266): n is a, c, g, or t
  modified_base (357)..(357): a, c, t, g, unknown or other
  misc_feature (357)..(357): n is a, c, g, or t
  modified_base (397)..(397): a, c, t, g, unknown or other
  misc_feature (397)..(397): n is a, c, g, or t
  modified_base (419)..(419): a, c, t, g, unknown or other
  misc_feature (419)..(419): n is a, c, g, or t
tcagatatcgcgagcacgaccggtgctcgatttagtgagtcagtaagggggaggtcagtctcagtcaggacacagcatggacatgagggtccccgntcagctcctggggctcctgctactctggcttccgaggtgccagatgtgacatccagatgacccagtctccgatcctccctgtctgactatcgtggtacggacacagagtccaacctatcgacttggccgggacaagtcagncattcgctacttatttaatgtatcagganatcgaggaactccctaatcctagacttcagtgatgactatccatttgactaaggtcggtaccagtcgaagtcaggtgactaggtcgatcgngggaactgttaattttccaactctccaacgtctacacgtntacgtctacgtacctaacgttntaaagttactttagaaccttaacttacgtaccgttagtaaccctaaagtacggtaacgttaccgagtttcccgaccccggttagggaccgtttaccggaaccggtaaccggggtaaccgtaaggggttaaacggttaaaccgtaccggtaaacgtttaccgtaggtttcgggacttacgggaaccctaacggttcctcgttaccg

SEQ ID NO: 288069 - DNA, 606 bp, Homo sapiens
  misc_feature: GYAE6OF02IQPAI.6.19.B08.1.454.CMB.1.raw
  modified_base (216)..(216): a, c, t, g, unknown or other
  misc_feature (216)..(216): n is a, c, g, or t
  modified_base (251)..(251): a, c, t, g, unknown or other
  misc_feature (251)..(251): n is a, c, g, or t
  modified_base (258)..(258): a, c, t, g, unknown or other
  misc_feature (258)..(258): n is a, c, g, or t
  modified_base (462)..(462): a, c, t, g, unknown or other
  misc_feature (462)..(462): n is a, c, g, or t
  modified_base (600)..(600): a, c, t, g, unknown or other
  misc_feature (600)..(600): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgganaacgtcagagctattagcacttatttaaatggtanacagganaactccgaagggaaacgacccctaaactcctagactctatgatgctatcctactttacgacgtaaaggttccgggtacctacttacgtaacggtttcacgggttgacgtaggttggaactcgttagggaactaggtacttttcaccgttactcaacctaactcaagtacgtacgtcctaggacctaaccgttagtaaacgtttntttacgaccttaacttactacttagtacctaacgtagtacgttaacgagtccgtacccgtcggtacggttaccgacgaacggtaccgtaaggtacgtaaacacggaaacgtacgtaggtcgtagtaccacgaaccttncgttcg

SEQ ID NO: 288070 - DNA, 606 bp, Homo sapiens
  misc_feature: GYAE6OF02JAPAG.6.19.B08.1.454.CMB.1.raw
  modified_base (223)..(223): a, c, t, g, unknown or other
  misc_feature (223)..(223): n is a, c, g, or t
  modified_base (256)..(256): a, c, t, g, unknown or other
  misc_feature (256)..(256): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttggccggcaagtcagngcattagctacttatttaattggtatcgagganaactcgaaggaaacgcccctaaactcctagattctaatgtatcgactattcctaacttttcgaacgtaaacggtcgggtacccctaagtaccgtaaggttcgaggtggtacgaggtacggtacgtacgtaggggaactaggttactttccgtacttactacccaactacttacgacgtcagttcctcgacctaactagtaacgttagtttacgaaccttaaccttaactcttacgtacaacgtagtaacgtacgtacgtcctacccggtcgtacggtaccgtaccgacgggactaacggtacgtaaactacgaaacgtacgtcggacgtctacgacaccgtatcgttacg

SEQ ID NO: 288071 - DNA, 761 bp, Homo sapiens
  misc_feature: GYAE6OF02F17R7.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctcctgtctgcatctgtaggacacagagtcaccatcacttgacggcaagtcagagcattagcacttattaaattggtatcaggagaatccgaaggaaacaccctaaactcctagatctatagatcgacacttcctaacttttacgacgtaaaacggttcggggtacccctaagttaccgtaaacggtttacgaaggtttacgggtaccggtaaggttgggaacgtttaccggtacggggtaaactaaggttaacttttaccgacctttaccgttacccgaacctaactcaacggtactaaggttacctcggtaaccctaaaccgttaaggttaacgttaaacgtttttccggaacctttaaaccgtttaacgtaaccgttacgttaacctaaaccgtaacgtttaacgttaaccgtaaccggttacccgacccccggtttacgggtaacccggtttacccggggaacccggtaacggggttaacccggtaaaagggggtaaccggtaaaaacgttaaacccggaaaaaaccggttaaccgtacggggttaccggtaacgttaccgaacccttaaccgtacgttacccgtttacg

SEQ ID NO: 288072 - DNA, 563 bp, Homo sapiens
  misc_feature: GYAE6OF02FPWFP.6.19.B08.1.454.CMB.1.raw
  modified_base (432)..(432): a, c, t, g, unknown or other
  misc_feature (432)..(432): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcatagcaacctatttaaattggtatcaggagaatccgagggaaacgcccctaaactcctagatctatgatgcatcctactttgacgtaaaggttcggggtaccagttacgtaaggttcgagttggcaggtggatcgtgggactagtactttcactctacacctatcagcagtctcgctaactgtagtatttcgacttaacttctactntacaacgtgtaattcacgtccgcccgttacggtacgttaccggacgtacgggaccgtaacgggtaagtaaacgtaaccgaaacgttacgtacgggtcggtaccgtacggaccaaccgtacttcgttaccgg

SEQ ID NO: 288073 - DNA, 697 bp, Homo sapiens
  misc_feature: GYAE6OF02I1W9H.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggacagtcagagcattagctacttatttaagttggtatcgaggagaataccgaagggaaaccgacccctaaactcctagtactctatgatgactactcctactttgacgtaaggtcgggtaccatacgtaaggttcaggtggctaggtgagttcggtaggacagttactttacacttaccaccgtacctatcgtacggctacgttacctacgacctaaccgtgttaaacgtttcgttttacgaaacccgtttaacctttaccgttaacgtttaccgtaaacccgtaaacgtacgggtttaaccttaacgtaccggttcccgggttaacccccgttacggggtaacccggtttacccgggaaccgggttaacccggggaacccggttaaacgggtaacggtaaaccgtaaaccggtaaaaccggaaccggtttaccgggtacgtaccggttaccgtaacccggtaccttaccggttactttcccg

SEQ ID NO: 288074 - DNA, 590 bp, Homo sapiens
  misc_feature: GYAE6OF02GU9BW.6.19.B08.1.454.CMB.1.raw
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacgagagtcaccatcacttcggccgggcaagtcagagcattagcaccttatttaaattggtaatcgaggagaactccgaagggaaacgcccctaaaactcctagtatctatgatgcactcctatttgacgtaaaggtcgggtacctatacgtaacggttnaggtggctagtggatcgtggganagtactttcacttctaccgactatcagacgtagtcctagacctaacgtgtaaagttacttttacgactaaactttactacttacgaactaactgtaaccgttacacgttccgccccgttaggtaccggttaccggaccgtaaacgggaccgtaagggtaacgaaacgttaacgaaacgtaaccgtgtacggcttaccgccgtaactcgttcttacg

SEQ ID NO: 288075 - DNA, 572 bp, Homo sapiens
  misc_feature: GYAE6OF02JWVZO.6.19.B08.1.454.CMB.1.raw
  modified_base (96)..(96): a, c, t, g, unknown or other
  misc_feature (96)..(96): n is a, c, g, or t
  modified_base (195)..(195): a, c, t, g, unknown or other
  misc_feature (195)..(195): n is a, c, g, or t
  modified_base (216)..(216): a, c, t, g, unknown or other
  misc_feature (216)..(216): n is a, c, g, or t
  modified_base (275)..(275): a, c, t, g, unknown or other
  misc_feature (275)..(275): n is a, c, g, or t
tcagatatcgcgagcacgaccggtgctcgatttagtgagtcagtaagggggaggtcagtctcagtcaggacacagcatggacatgagggtccccgntcagctcctgggctcctgctactctggctcgaggtgccagatgtgacatccagatgacccagtctccatcctccctggtactgcatctgtagacagagngtcaccatcacgttgccgggnaagtcagagctatacgcacctattaattggtatcaggagaatcgaggaacgccctaaanccgtagatctatgaatgcatccactttgacgaagtcgggtaccagtacaggttcaggtcgacgagtgatcgaggacaggtactttacaccgtctacactagtcacgtacaacgtctacgactaaccgttagaacgttagtttacgactaacgttactacgtacgtacaagtacgtacgttaactacgttccgacccgtacggacgttcggaccgtacgggtaaccgaagggttaacgaacgtaaccgtaaacgaaccgtaggtacggtcgaaccgtactaaccgtacgtacttacgg

SEQ ID NO: 288076 - DNA, 527 bp, Homo sapiens
  misc_feature: GYAE6OF02FRL10.6.19.B08.1.454.CMB.1.raw
  modified_base (213)..(213): a, c, t, g, unknown or other
  misc_feature (213)..(213): n is a, c, g, or t
  modified_base (264)..(264): a, c, t, g, unknown or other
  misc_feature (264)..(264): n is a, c, g, or t
  modified_base (425)..(425): a, c, t, g, unknown or other
  misc_feature (425)..(425): n is a, c, g, or t
  modified_base (441)..(441): a, c, t, g, unknown or other
  misc_feature (441)..(441): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagatcaccatcacttgccggnaagtcagagcattagcacctatttaatgtatcaggagaatccagggaaacnccctaaactcctgatctatgatgcctatcctacttttagactaaaggtcgggtacccattacgtaaggtttcaggtggacaggtgagtctagggacagtacttcactctaccacatcacgcacgtctcgacaactagaactatttgacctaacttctactntacaatagtacttacngtaccgcccgtaggtacgttcgaccgacgggaccaagggtcgaaactacgaaacgtactaggtcgacgtgacctactactcgtacg

SEQ ID NO: 288077 - DNA, 609 bp, Homo sapiens
  misc_feature: GYAE6OF02GFY5P.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtagacacagagtcaccatcacttcggccggacaagtcagagcattacgctaaccttaatttaaattggtaattcgaaggaagaataccgaagggaaacgtacccctaaactccgtagacttctatgatgctactcctacttagacgtaagtcgggtaccaagtactaaggtcaggtcgactaggtgtaactcggtaggactaacggttatttaccaccttacgtaccgtacctactacgagtactacgtcctacgaacctaaccgtagtaaacgtttgtttacgaaccttaaccgttaactacgttacgtaaccaagtaacgtacgttactagtccgtacccgtacggtaccgtcggaccgaggtaaccgaggtaacgaactaacgaaccgtagtagacggtacacgacacgtacgtcgttacg

SEQ ID NO: 288078 - DNA, 540 bp, Homo sapiens
  misc_feature: GYAE6OF02FEZ7B.6.19.B08.1.454.CMB.1.raw
  modified_base (225)..(225): a, c, t, g, unknown or other
  misc_feature (225)..(225): n is a, c, g, or t
  modified_base (233)..(233): a, c, t, g, unknown or other
  misc_feature (233)..(233): n is a, c, g, or t
  modified_base (264)..(264): a, c, t, g, unknown or other
  misc_feature (264)..(264): n is a, c, g, or t
  modified_base (276)..(276): a, c, t, g, unknown or other
  misc_feature (276)..(276): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacgatcccaggatgtacccagtccgtccagtcctacccgtgtcctgtcatctgtaggacacagagtcaccatcacttgccggnaagtcagngcattagcacctatttaaacttgatcagganaatccagggaancccctaaaactcctagatctatgatgcatccactttgacctaaagtcgggtccagtacaaggttcagtaggcagtgatcgtgggacagtattcactctcaccatcagctagtctgaccaactgaatattttcgacctaacttactacctgttaccaatacgtattacgagttccgcccctgggtccgttacggaccctaggggaccaagggtacgtaaataaccgaaacgtacgtggtcgacgtgactaccccgattcgttacg

SEQ ID NO: 288079 - DNA, 988 bp, Homo sapiens
  misc_feature: GYAE6OF02GEG0G.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctcgagtgaccagatgtgacatccagatcgacccagtcctccatcctccctgtctgactactctaggtacggacacaggacgttccacctatcctacgtttcgggacccgggtactaaacggtccgaaggtaacggaccttaagtttaaccggaccttaaaccctttaaagtttttaaaaacgtttaggggttaactttaccggaagggtaacgtaaaccggttacccggaaacgggggtaaaacccgtaaccccccgtttaaaaaccgttacccccgttaggtaaccgttaccgttaaagtttacggtaacgttacgggtaccttaaccttaccccggtttaaaccgttttaccgggaaaccggtttaaaacgggttaccccgggggttaacccgtaaaacgtttaacccgggtaaaacggggtttttacccggaaggtttacccggggtacggttaacggggttacgggtaacggtttacccgggtttaaggggaaaccgttaacggtttaaccgttttacccgtaaccgtttaccccgttaaacgtacccctaaacgttaccggtaacgttaccggttaaccgtttacgaaccgttacccgttaaacccgttaaaggtaacggttttaacgttttaacgaaaccctttaacgttttaaaccgttcgttaacggttaaccgttaaaccgtaaggtaaccgtttaaccgtccgggtttacccgtacccggttaaccggttaccgggtttaccggtaaccgggaacccggtaaggttaaccgggtaacggaaaacgttacccggtaaaacccgtaggtttacggtacggtaccgtaccggtaaccgaacgttaccgtacgttaccg

SEQ ID NO: 288080 - DNA, 735 bp, Homo sapiens
  misc_feature: GYAE6OF02GW99Y.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtctccatccctccctgtctgctatcgtgtaggacacagacgtcaccatccacttcggccgggacaagtccagagctaattacgcctaaccttaattttaaaagttcggtaatacgaaggtaagtaacttaccggaaggggaaaaccgtacccccttaaaacgtccctaggtaacttaccgtatagtagtcgtacctattccctaacgtttacgacgtaaaacggttccggggtaccctaagttaccgtaaggtttcgtacggtacggacgtaggttacggtaagttacggtacggggaacctaggtttaacttttaccctaacttccgtaaccctaccgtaacgttaccgaacggtacgtaacgttaccgtacgaaccctaaaccgttagtaacgtttacttttacggaaacctttaacctttaacgtaccgttataaccaacgtaagtaccttaacgtacgtccgtaccccgtacgggtaacgttccgggaccgtaacgggtaccgtaaagggtacggaaaacttaccgaaacgtacgtaggttacggacttaccgaccacgttactcgttacg

SEQ ID NO: 288081 - DNA, 566 bp, Homo sapiens
  misc_feature: GYAE6OF02JJUIQ.6.19.B08.1.454.CMB.1.raw
  modified_base (393)..(393): a, c, t, g, unknown or other
  misc_feature (393)..(393): n is a, c, g, or t
  modified_base (444)..(444): a, c, t, g, unknown or other
  misc_feature (444)..(444): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
  modified_base (496)..(496): a, c, t, g, unknown or other
  misc_feature (496)..(496): n is a, c, g, or t
  modified_base (552)..(552): a, c, t, g, unknown or other
  misc_feature (552)..(552): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgctatctgtaggacacgagacgtcaccatcacgttcggccgggacaaagtcaagagctaattagcctaaccttaattttaaaacttggtaatcgaagggataactccgaagggtaaaccgccccttaaaagtcctagactctatgatcgactactcctacgtttcgaacgaacgggttcgggtacccagttacgaaacggtttcaaggttcggacnggtacggtatcgtagggactagtactttcactctacactgcagtcagtcgnacctatcgaagttattcgactaacttanacttnacatacgtagtacagtccnccgtagcgttcgacgagaccgtaggtagtaacctagaaccgtagtagtcgtactanacgactagtcgtcg

SEQ ID NO: 288082 - DNA, 608 bp, Homo sapiens
  misc_feature: GYAE6OF02FQS58.6.19.B08.1.454.CMB.1.raw
  modified_base (218)..(218): a, c, t, g, unknown or other
  misc_feature (218)..(218): n is a, c, g, or t
  modified_base (277)..(277): a, c, t, g, unknown or other
  misc_feature (277)..(277): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctcctgtctgcatctagtaggacacagagtcaccatcacttggccggganaagtcagagcattagcaccttatttaaacgttggtatcaggagaatccgaagggaaacncccctaaactcctagactctatgatgctatcctactttcgacgtaaaggtcgggtacccagttacgtaacggttcaggtcggacgtacggtggtaactcgtacgggaactagtactttacgacgttcctacacctatacagctacgtctacgacctaacgtagtaacgtatttagactaacgttactactacgtaacaacgagtaacgttacgagttcccgacccgttacggtaccgttaccgggaccgtaacgggaaccgtaaggtaacggtaaactaaccgaaacggtacgtaggtacggtaccgtacgacctaactcgttacttaccg

SEQ ID NO: 288083 - DNA, 624 bp, Homo sapiens
  misc_feature: GYAE6OF02GC75B.6.19.B08.1.454.CMB.1.raw
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (603)..(603): a, c, t, g, unknown or other
  misc_feature (603)..(603): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagancattagcacctaatttaaattggtatcagganaacgtccgaagggaaacgacccctaaactccgtagatctatgatgctactcctacgtttgacgtaaaggtcgggtaccctagtacgtaacggttcaaggttcggacgaggttacggaacgttcgtaggggaactaaggttactttccgaaccttactaccaacctacgttacgacgtactacggttcgtacgacctaaaccgttagtaaagtttacttttacgacttaaacttacctacttacgacaactagtacgtacgacggttacccgacccgttacggcgttaccggaaccgacgggaacgaacgggtaagaaacttacgaaaacgtacggtagtcggtacncggtaccacgtacgtcgttcg

SEQ ID NO: 288084 - DNA, 595 bp, Homo sapiens
  misc_feature: GYAE6OF02FK73C.6.19.B08.1.454.CMB.1.raw
  modified_base (224)..(224): a, c, t, g, unknown or other
  misc_feature (224)..(224): n is a, c, g, or t
  modified_base (272)..(272): a, c, t, g, unknown or other
  misc_feature (272)..(272): n is a, c, g, or t
  modified_base (283)..(283): a, c, t, g, unknown or other
  misc_feature (283)..(283): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtccaccatcacttgccgggcaagtcagngcattagcacctatttaaacttggattcaggagaatccaggggaaacnccccgtaaacncctgatctatgatgcatccacttcgactaaagtcggggtccactcaacggttcaggtggcagtgatcgtgggacagtattcgactctcaccatcagtcacgtctcgacctaacctgtaacgtactttacgacctaacctttacctaccttacgtactaaaccgtaacggtaagttaacctacggttaccggtaccccgtaccgggtaaccgttacccgggacccgaacgggaacccgaaacgggtaacggtaaactaaccgtaaaccgaacgttacggtcggacgtcgaccgtaacctacgttcgttacccg

SEQ ID NO: 288085 - DNA, 693 bp, Homo sapiens
  misc_feature: GYAE6OF02GCB9Z.6.19.B08.1.454.CMB.1.raw
  modified_base (219)..(219): a, c, t, g, unknown or other
  misc_feature (219)..(219): n is a, c, g, or t
  modified_base (263)..(263): a, c, t, g, unknown or other
  misc_feature (263)..(263): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatccacgttgccggganaaggtcaagagcattagctaccttatttaaattggtatcagganaactacgaaggaacgacccctaaactccgtagactactatgatgactactacctactttacgactaacggtcgggtacctagtacgtaacggtttacaggttcggacgtaggtcggtaacgtcgtacgggtactagttactttccgaccgttccttaccctaacctataccgaacgtccgtacgttcgtacgacctaaccgtagtaagttacttttcgaaccgttaactttacctacttacgaaccgttaaacgtacggttaaccgaacggttcccgtaaccccgggttcggtaaccgggttaccggaacccggtaaaccggggaaccgtaaacgggttaacgggaaaccgttaaccggtaaaaccggtaacgttacgggtacggttaccgtacggtaaccccgtacgtactttcccgtacgtttacccg

SEQ ID NO: 288086 - DNA, 798 bp, Homo sapiens
  misc_feature: GYAE6OF02H4EN1.6.19.B08.1.454.CMB.1.raw
  modified_base (210)..(210): a, c, t, g, unknown or other
  misc_feature (210)..(210): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccggaggtgccagatgtgacatccagatgacccagtctccattccctccctgtctgctatctggtaaggacacagagtccaaccntacacgttcggaccgggacaagtcagacgctaagttacgacctaactttaaattttaaagttggtaactacgaagggaacgtaacgtaccggaaacgggtaaaaccgtacccccttaaaacttccgtaggtaacttacttagtcgtaactcgactacgttacccttacgttttacggaaccgttaaaacggggttccgggtaccctaagttaccggttaaacgggtttcgaagggttcgggacgttagggtacggtaacgttcggtacggggtaacttaacggttacttttaccgaacccttctaacccgacttaacgttaccaacgtacgttacgttaccacggtacccaaacggtttaagaacgttttaactttaccgaacctttaaactttaaccgtaccttaacggtaacctaaacggttaagttaccgttaacgtccggttaccccgtccccgggtaacgggttaccgttaccggggaacccgttaacggggaacgtaagggttaaacggtaaacctaaaccgggtaaacctcggtacgggtacggtacccgtacggaccctaaccgttacgttccgttaccg

SEQ ID NO: 288087 - DNA, 732 bp, Homo sapiens
  misc_feature: GYAE6OF02H1I80.6.19.B08.1.454.CMB.1.raw
  modified_base (460)..(460): a, c, t, g, unknown or other
  misc_feature (460)..(460): n is a, c, g, or t
tcagatatcgcgagcacgaccggtgctcgatttagtgagtcagtaagggggagtcagtctcagtcaggacacagcatggacatgagggtccccgctcagctcctggggctctgctactctggctccgaggtgccagatgtgacatccagatgacccagtcctccatcctccctgtctgcatctggtaggactacacgagtcaccgaatcacttggccgggactaaagtcagagtctaattagacaccttaagtttaaattggtaactacgaacggaagtaataccgtaaagggaaactaccctaaacttctagtatacgtatagatgacagttacctaatttgaacgtaacggtcgggtacctaacgtaccgtaaggtttccagtacggactaaggttagagtgtacggaactagtacgttttcaacttcgtaccaactagtacagtacagttaccgtanacctaaccgttagaacgtttaacgttttacgaaccttaaaccttaacgttaaccttaggttaaaccctaaacgtaaggtaaacgttaaccgtaacggttaacccgttaccccggtaccgggttaaaccggttacccgggtaaccccggtaaacgggaacccggttaaaacgggtaacgggttaaaaccggttaaaccggaaaaaccggttaaaccgtagggttaacccgggtcgtaaaccgggttacccaaccctacgttccgtttaaccgg

SEQ ID NO: 288088 - DNA, 579 bp, Homo sapiens
  misc_feature: GYAE6OF02GXQ0W.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatccattcgccgggcaagtcagagcattagcacctatttaaattggtatcaggagaatccgaaggaaacgcccctaaatccctgatctatgatgcactcctactttgacaaaggtcgggtaccctagtacgtaaggttcaggtaggcaggtaggatcgtgggactagtatttcactctacaccatcagtcagtctgacctaaccgtagtaagtattttcgactaaacgttactactacgtacaactagtacttacgagtccgtacccgtacggtaccgttccggaccgtaacgggaccggtaaaggtacggtaaaaccttaaccgaaaaccggtacgttacggtacggtaccgtacgaacctaaccgtacttcttcgg

SEQ ID NO: 288089 - DNA, 712 bp, Homo sapiens
  misc_feature: GYAE6OF02GVWKG.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtcctccatccctccctgtctgcatctgtaggacacagagtccaccatcactcggccgggacaagtcagagcattagccaccttatttaaagttggtatcgaggagaatccgaagggaaacacccctaaactcctagatctatgatgctactccctatttcgaacgtaaggttcgggtacccctagtaccgtaaacggtttcgtaggtcggtacgaagggttggtagttccgtaggggtacctagttaacttttccaacctcctaccaacctactcctaacgtaccgtagttccgtacgtaacccgaacccgttaggtaaacgtttacgtttttacgaaccttaaacctttaacctaccgttacgtaaccgtaaacgtaacggttaccgttaacgtaccgttacccggtaccccgttacccgggtaacccgtttaccgggaacccggtaacggggaaccggtaaacgggtaacggtaaaccgttaaccgaaaaccggtaaccggttcggtaccggtaccgtaccggtaccctaaccgtacccgttagttacccg

SEQ ID NO: 288090 - DNA, 799 bp, Homo sapiens
  misc_feature: GYAE6OF02I9CY2.6.19.B08.1.454.CMB.1.raw
  modified_base (795)..(795): a, c, t, g, unknown or other
  misc_feature (795)..(795): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctcgaggtgcagatgtgacatccagatgacccagtcctccatccctccctgtctgacatctggtaagacacagagtccacactcacgttggcccggacaagtcacgagctaattagcctaaccttaatttaaagttacggttaattaccgaaggtaagtaaacttaccggaaaaggggtaaaaccgtacccccttaaaaacgttcccgttaggtaacttaccgttagtacggtaacttagaccgttaacttacccttaacgttttacggaaccgtaaaacggggttcccggggttaaccctaacgttaaaccggttaaagggtttacccgtaagggtttacgggaccgtaaggttacggtaaacggtttcgggtaacggggtaaactaacggtttacttttaccgtaaccggtttcctaaacccgtaaccttaacggtacccgtaacggtacctaacgggttaccgttaaccggaacctaaacccgtttaagggtaaacgttttacgtttaacgtaaacccgtttaaactttaaccgttaacgttacggttaaacctaaacggtacgtttaactaacggtccgtaccgtacccggtacgtacgggttacgaaccgtacgggtacgtaagtacgtaaagtccaaacgttagcggtactcgtagaccgctacgtntacg

SEQ ID NO: 288091 - DNA, 644 bp, Homo sapiens
  misc_feature: GYAE6OF02GY43K.6.19.B08.1.454.CMB.1.raw
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtagacacagagtcaccatcacttcggccggcaagtcagagcattagctactatttaaagtggtatcagganactcgaaggaacncccctaaatcctgactctatgatgcatcctagtttgactaaggtcggtacccagtacgaaggttcgagtggactaggtggtacgtcgagggactagttcttttaccacttccgacctaacctattaccgacgtactgttccgtacgaccctaaacgttggtaaactttacgttttacgaaccttaaacccgttttacttaaccgttagttaaccgaaacgttaaggttaaccgttaacgtaccggttcccgttacccccggtaggtaacccgggttccggaaccgtaaccgggtaaccgtaaggggtaacgaaacgtaaaccgaaacggtacgttaggtaaccggtcgtaaccggtaccctactacgttcttaccg

SEQ ID NO: 288092 - DNA, 695 bp, Homo sapiens
  misc_feature: GYAE6OF02H3EEZ.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctcctgctactctggctccggaggtgccagatgtgacatccagatcgacccagtctccatcctccctgtctgcatctgtaggacacagagtcaaccatcacttggccggacaagtcagagctatagctactatttaaatggtatcgagagaatcgaaggaaacaccctaaactcctagtactactatagatcgactactacctacgttagactaaacggtcgggtaccagtacgtaacgtcgaggtgacgtaggtggatcgtacggtaactaggtactttaccgtactctacgaacctacgtcgaacgtcgtaacgtcgtaccgactaaaccgttagtaaacgtttacgtttcgaaccctttaaacgttaccgttaacgttaccgttaaacctaaacggttacgttaaaccggttaccgtaaccggttcccgggttaccccggttacgggtaacccggtttaaccgggtaccgtaaacccggggtaacggttaaacggggtaaccgtaaaacgtaccggtaaaaccgtaaccggttggtaacggtaccggtaccggtaacccggtacttaccggttacgtaaccgg

SEQ ID NO: 288093 - DNA, 557 bp, Homo sapiens
  misc_feature: GYAE6OF02JFV7D.6.19.B08.1.454.CMB.1.raw
  modified_base (95)..(95): a, c, t, g, unknown or other
  misc_feature (95)..(95): n is a, c, g, or t
  modified_base (220)..(220): a, c, t, g, unknown or other
  misc_feature (220)..(220): n is a, c, g, or t
  modified_base (230)..(230): a, c, t, g, unknown or other
  misc_feature (230)..(230): n is a, c, g, or t
  modified_base (367)..(367): a, c, t, g, unknown or other
  misc_feature (367)..(367): n is a, c, g, or t
  modified_base (463)..(463): a, c, t, g, unknown or other
  misc_feature (463)..(463): n is a, c, g, or t
tcagatatcgcgagcacgaccggtgctcgatttagtgagtcagtaagggggagtcagtctcagtcaggacacagcatggacatgagggtccccgntcagctcctggggctcctgctactctggctccgaggtgccagatgtgacatccagatgacccagtcctccatccctccctgtctgcatctgtacggacacagacgtcaccatcacttggccgggnaagtcaggancattagcaaccttattaaacttggtatcaggagatccagggaaacgcccctaaactcctgactctatgatgcatccactttgacaaaggtcgggtaccatacgtaacggtcagtggcagtggatcgtaggacacgtntttcaccttcacgaccatcgacgctagtccgtacgcctaaccgtaggtaacgttatttaggaccttaacttacacttagactaactagacgttacngtccgtacccgtggacgttccgaccgagggtaacctagggtacgaaactacgtaaacgacgttaggtacgtctacggacaccgttgtacttcgg

SEQ ID NO: 288094 - DNA, 750 bp, Homo sapiens
  misc_feature: GYAE6OF02H9FMM.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctcctgtctgcatctgtagacacagatcaccatcacttcggaccgggacaagtcaagagctatttagacctaaccttaattttaaaacgttgggtaattaccgaagggtaacgtaaaacgttacccgaaaggggaaaacctacccccgttaaaaaccgttcccttaaggtacttacgtaacgttaggtacttagacctaacttacccgtacttttacgacgtaaaacggttcgggtaccctaagtacgaacggtttacaggtcggtactaggtagtacgtcgtaagggactaacggtacttttaccgtacgttacctacctaccgtaacttcgaacgtaccgtaaggttcctacggacctaaccgttaagtaaacgtttacgttttacgaacttaaaccgtttaaccttaacttaacggtactaaaccgtaggttaacgttaaaccgtacgttacccgtacccgtaccggtaaccggttccggtaacgaaaccggggtaccgaaaacgggtacgtaaaacggtaaccgtaaaacggtaacgttaccggtagtaccggtacgaacctacctagacgtttaccg

SEQ ID NO: 288095 - DNA, 706 bp, Homo sapiens
  misc_feature: GYAE6OF02GGV1K.6.19.B08.1.454.CMB.1.raw
  modified_base (269)..(269): a, c, t, g, unknown or other
  misc_feature (269)..(269): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtagacacagagtcaccatcacttgccggcaagtcagagcattagctaccttatttaaattggtatcaggagaatcgaagggaacnccccgtaaactcctgactactatgatgacacttcctaactttcgacgtaaacggtcggggtaccctagttaccgtaaacgggtttctaaggttcggtacgtaggttacgggtaacgttcggttaggggaacctaaggttacttttacctaccgttcctaccgtaaccctattacgaacgtactacgttacctagtaaccctaaccgttaaggttaaagtttattttacggaacccttaaacgtttacctaacgtacgttaaccaaacgttacgtaatttaaccgacggtttacccggcccgttaccgggtaccgggttaccgggaaccgtaaccggggtaaccgtaacggggtaacggtaaacgttaaaccgaaaaccgttaacggttacggttaacggtacgttaccggaccctaacgttaccttacgtttacccg

SEQ ID NO: 288096 - DNA, 685 bp, Homo sapiens
  misc_feature: GYAE6OF02GLMZP.6.19.B08.1.454.CMB.1.raw
  modified_base (455)..(455): a, c, t, g, unknown or other
  misc_feature (455)..(455): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgaccccagtcctccactccctccctgtctgctatctggtagacacagagtcaccatcacgtcggccgggactaagtcagacgctagttacgacctaacctttaattttaaagttggtactacgaaggaacgtaactaccggaagggaaaccctaccccgtaaactccgtagtactctagtgatcgactactacctacgttacgacgtaacggtcggtacctatacggtaagtcgaggtcggagtaggtagtacgtcggaggtactaggttaccttacctcctacgacctactactacgtacncgtagtcctacgtaaccgtagttagttaactttagttaccaacttaaaccttcgtaactagtaaccgtaacgtaggttaccttacggtacccggtcccgttacccggtacgggtacccgtaaccgggaacggtaacccgggaacggttaaacgggtaaccgtaaaccgtaaccggtaacggttacgtcgggtacgtaccgtaaccgtaccgtacggttactccgttaacg

SEQ ID NO: 288097 - DNA, 565 bp, Homo sapiens
  misc_feature: GYAE6OF02F3A9E.6.19.B08.1.454.CMB.1.raw
  modified_base (268)..(268): a, c, t, g, unknown or other
  misc_feature (268)..(268): n is a, c, g, or t
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtcctccatcctccctgtctgcatctgtaggacacagagtcaccatcacttgccgggcaagtcagagcattagcacctatttaaattggtatcaggagaatccagggaancccctaaacncctgatctangatgcatccactttgacaaagtggggtcccagtcaaggttcagtggcagtgatcgtggacagtactttcactctacaccatcagcagtccttagaccaaccgtgtaaagtacttttacgacctaacctttaactaacttgtaccaaacgagtaacgttactacgttcgacccctacggtaccgttccggacccgacgggaaccgtaaggtaacgggaaacttaaccggaaaaccgtaaccgtggtacggtccgtggacctaacccgtatccttacgg

SEQ ID NO: 288098 - DNA, 770 bp, Homo sapiens
  misc_feature: GYAE6OF02JCUA8.6.19.B08.1.454.CMB.1.raw
  modified_base (758)..(758): a, c, t, g, unknown or other
  misc_feature (758)..(758): n is a, c, g, or t
tcagatatcgcgagcacgaccggtgctcgatttagtgagtcagtaagggggagtcagtctcagtcaggacacagcatggacatgacgggtccccgctcagctccgtggggctcctgctactctggctccggaggtgccagatgtgacatccagatcgacccagtctccacttccctccctgtctgacactcgtagtacgacacagactccaacatacctaccttcgggccggataacggtacacgagactaattacgacctaaccttaatttaaaattggtaacgtacgtaagggaacgtaaacggtaccgaaacgggaaaaccctaacccccttaaaacgtcccgtaggtaacttacctacgtaacggtatacggacctaacttccctttaacgttacgtaaccggtaaaggtttaccggggtaccctaacggtttaacggtaaacggtttccggaaggttagggtactaagggtagtacgttaccgggaggtaaccgtaagtttaactttacgtacctaccttaaccaacgtaactaacgtaccgtaacgtacgtacgtacgaacctaaccgttaggaaactttagttagtaaccttaacgttaacttagtacgtaactaaacctagtaaggtttaaacctacgtccggtacccgttacgttaccgggtaccgggtaacgtaaccgggaacgttaaagggaaccggtaaactaacggtaaaaccgttagtaggtcgtaacgtactaaccgacgttnttaccgttacgg

SEQ ID NO: 288099 - DNA, 652 bp, Homo sapiens
  misc_feature: GYAE6OF02H0LM5.6.19.B08.1.454.CMB.1.raw
  modified_base (164)..(164): a, c, t, g, unknown or other
  misc_feature (164)..(164): n is a, c, g, or t
  modified_base (229)..(229): a, c, t, g, unknown or other
  misc_feature (229)..(229): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (396)..(396): a, c, t, g, unknown or other
  misc_feature (396)..(396): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtccnccactcctccctgtctgcatcgtgtacggacacgagagtcaccatcacttggccggcaagtcagngcattgctacttaattaatgtangagganancgaggaacaccctaactcanatntntnangactactctattcgacgtaaggtcggtaccatcgtaacggttcaggttggacgtaggtgacgtcgtaggaacttaggtacttttcgacccttcgtaccctaaccgtntaacgacgtacgtacgttaccgctaacgtaaccgttagaaacgttttactttacgaccttttaaagttacctaaacgttcgtaacctaaaacggttaggttaacgttaccgacgtttacccgggtccccgtacgggtaacccgttaccggaaccggtaaccgggtaaacgggttacggtaaacgggtaaaccaaccgttaaaacggaacggttcggacggttacctaccggtaccgtacccttcgtactttaccgg

SEQ ID NO: 288100 - DNA, 583 bp, Homo sapiens
  misc_feature: GYAE6OF02GGZJD.6.19.B08.1.454.CMB.1.raw
  modified_base (271)..(271): a, c, t, g, unknown or other
  misc_feature (271)..(271): n is a, c, g, or t
  modified_base (282)..(282): a, c, t, g, unknown or other
  misc_feature (282)..(282): n is a, c, g, or t
  modified_base (425)..(425): a, c, t, g, unknown or other
  misc_feature (425)..(425): n is a, c, g, or t
  modified_base (575)..(575): a, c, t, g, unknown or other
  misc_feature (575)..(575): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtccaccatcacttgccggcaagtcagagcattagcaccttatttaaattggtatcaggagatccgaaggaaacnccctaactccngatctatgatgcatcctactttgacgtaaaggtccgggtaccctataccgtaaggttcaagtggactaggtaggattcgtaggggacctagtactttacactctacaccatcacgctagtctagacctaacctagtaaacttnttttacgaccttaaactttctaactcgtaactaacgagtacgttaacacgttccgaccccgttacggtaccgtaccggaaccggaacggacccgtaagggtaacgaaacttaccgaaaacgttacgtaggacggtctaccgacgaacctntacgttac

SEQ ID NO: 288101 - DNA, 687 bp, Homo sapiens
  misc_feature: GYAE6OF02FXGDJ.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtcctccatccctccctgtctgcatctgtaggacacagacgtccaccatcctacgttcggccgggacaagtcagagctattagcacctatttaaattggtatacaggagaataccgaaggaaacgaccctaaactcctagtactactatgatgctactcctactttgacgtaaaggttcggggtaccctacgtacgtaacggtttacgtacggttagggacgtagggttaggtacgttcggtaggggaacgtaagttaacttttaccgaacctttcctaaccgtaacctacgtaccgtacgtacctacggttacctacggtaaccgtaaaccgttaaggtaaacgttacttttacgaccttaaacttaccgttaacttacgttaactaaactagtaacgttaacgtaccggtccgtacccgtacggttaccggttaccgaccggtaacgggaccgtaagggtaacgtaaacgtacgtaaaccggtacgtacggtcgtaccgtaccggtactaccgtacgtcgtttaccg

SEQ ID NO: 288102 - DNA, 867 bp, Homo sapiens
  misc_feature: GYAE6OF02ICLFU.6.19.B08.1.454.CMB.1.raw
  modified_base (230)..(230): a, c, t, g, unknown or other
  misc_feature (230)..(230): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctcgaggtgccagatgtgacattccaagactcgacccagtcctccatccctcctgtctgcattctggtaggacacgtagacgtccaccatcacgttggcccggganaagtcgaagacgtctaatttacgacctaaccttaattttaaaaagttcgggtaacttacgaaagggggaactaaacgttaccggaaacggggttaaaacctacccccttaaaacgttcccgtaggtaacttaccttaagttggaacttacgacctactttaccccttaacgttttaccggaacgtaaaacgggttcggggtacccctaagttaccgtaaaggtttcgaggttacggacgttaggtacggtacgttacgtacgggtaacctagtaccttttaccaccgttactaccgtaacctactacggtaactccgtaagttacccgtacgaacccttaaaccgttaaggttaaagttttaccttttaaccggaaaccttttaaaccgttttaaaccgttaccgttaacggttaacccgtaaaacggtacgtttaaaccggtttaaccgaccgggtttaacccccggtaccccggttaacggggttaaccgggtttaaccccgggaaacggttaaaaccggggggaacccgttaaaggggttaacccggtaaaactaaaccgggtaaaaccgttaacggttcgggttaacgaccggttaccgaacccggtttaaccttacccgtttggttaacccc

SEQ ID NO: 288103 - DNA, 678 bp, Homo sapiens
  misc_feature: GYAE6OF02I88Y5.6.19.B08.1.454.CMB.1.raw
  modified_base (254)..(254): a, c, t, g, unknown or other
  misc_feature (254)..(254): n is a, c, g, or t
  modified_base (266)..(266): a, c, t, g, unknown or other
  misc_feature (266)..(266): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaaccatcacttggccgggacaagtcagagcattagcacctatttaaatgtatcaganatcgaggaaacnccctaaactcctgatctatgatgctatcctactttcgacgtaaaggttcggggtacccctaagtaccgtaaaggtttaccaggtacggacgtaaggttggacgtcgtaggggaacctaggtacttttaccgacttctaccgaacctagtaccagcctaagttcgtacgaccctaaacccgtaggtaaatttacgttttacgaaccttaaactttcctaacgttcgtaacctaaactacggtaacgtttaacgacgttcccgtacccgttacgggtaccggttaccggaacccggtaacggggtaacccgtaaaggggtaacggtaaaaaccgttaccggtaaaaaccggtaaccgtttacgggtaaccggttacgttaccggaaccgttaaccgtaacgttcgtttaaccgg

SEQ ID NO: 288104 - DNA, 656 bp, Homo sapiens
  misc_feature: GYAE6OF02FXVYY.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtccaccatcacttggccgggacaagtcagagcattagcaaccttaatttaaattggtatcgaggagaatcgaagggaaacgcccctaaactcctagatctatgatcgctatcctactttgacgtaaggtcgggtaccacgtacgtaaggttacaggtcggacgtaggtaggtaacgtcgtagggaactaagttacttttacgaccttcgtaccaacctatccgaacgtactagtacctacgaccctaaccgttaggtaacgttacttttacgaaccttaacctttacttaactcggttaacctaaagtacgttaaacgttacgtacggttcccgtaccccgttcggtaaccggttaccggacccggtaacgggaaccgtaagggtaacgtaaaaccgtaccgaaaaccggttacgtacggtacggtacctaccggtacctacctaacgttccgttaccg

SEQ ID NO: 288105 - DNA, 641 bp, Homo sapiens
  misc_feature: GYAE6OF02HUUMS.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagagcaattagctacttaatttaaatggtatcaggagaatcgagggaaacaccctaaactctagtatctatgatgactactcctactttgacgtaaacggtcgggtaccctaagtacgtaaggttacgtagtggacgtaggtggagtcgtagggactagtactttccacctactacctaacccaattaccgacgtactaacgttccgtacgtacctaaaccgtaggttaaacgttacttttacgtaaccttaaacctttaacctttaaccgttacgtaacgtaaacgtaagtaacgtttaacgacggttacccgtccccggtacggtaccggttaccggaccggtaacgggaaccgtaacgggtaacggtaaacgtacgtaaaacgtacgtagtacggctacgtaccacctacgtattaccg

SEQ ID NO: 288106 - DNA, 853 bp, Homo sapiens
  misc_feature: GYAE6OF02HXJGB.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtcctccactccctccctgtctgcatcgtagtaggacacagagtccaccatcacttcggaccgggactaagtcaagacgactaagttacgacctaacctttaattttaaacgttggttaactcgaaggaagtaaacgtaccggaaagggaaaccgtaacccccttaaaacgttcccttacggtaacttacgttaagttacgtagtacgactacgttaccctaacgttttacgaaccgttaaacggggttccgggttacccaagttaccgtaaacgggtttcggaaggtacgggtaccgtaaggttacgggtaacgttcggtaacggggtaactacggtttacgttttacctaaccgtttcctaccgtaaacccttaactaccgtaacgtaccgtacgttacgtaccgtaacccgtaaacgttacggtaaagttttaacgtttaccggtaaaccctttaaacgtttaaccgtaaccttacggttaaaccctaaaacggttacgttaaacgtttaacccgaaccggtttcccggtaaccccggttaacgggtaccggttaaccggggaacccggtaaaccggggtaaccggtaaacggggttaaacggtaaacccggttaaaccgtaaacgggtaacggtttcggtaccgggtaaccgtaccgtaaccgtaaccgttaccgttaccgtttacccgg

SEQ ID NO: 288107 - DNA, 685 bp, Homo sapiens
  misc_feature: GYAE6OF02G6B3O.6.19.B08.1.454.CMB.1.raw
tcagatatcgcgagcacgaccggtgctcgatttagtgagtcagtaagggggagtcagtctcagtcaggacacagcatggacatgagggtccccgctcagctctgggctcctgctactctggctccgaggtgccagatgtgacatccagatcgacccagtctccatcctccctgtctgcatctgtagacacgagacgtcaccatcacttggccggcaaacgtcaagagctattagctaccttaatttaaacttggtatacgagagaactccgaagggaaactacccctaaactccgtagtactacgttatgtatcgctaactcctactttgacgtaaaggtcgggtacctactacgtaacggttcaggtcggactaggtcggtactcgtaggacgtagtactttacacttctacgaccatcgagtacacgtctacgtacctaacgtagtaacgttacttttacgaaccttaacgttaactacgttacgtaaccttaaacgagtaacgtttaaccgacggttacccgtacccccggttacgggtaacccgttacgggtaaacccgtaacgggtacccggttaaaacgggtaacgggaaaaccgtttaaccgaaaaccggtaacggttttacggaaccgggttaccgtaaccggtaccgtaacccgttacgtttaccctttaacccgg

SEQ ID NO: 288108 - DNA, 652 bp, Homo sapiens
  misc_feature: GYAE6OF02HFDSC.6.19.B08.1.454.CMB.1.raw
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtcctccatccctccctgtctgctatctggtaggacacgagacgtcaccatcacgttggccgganaagtcaganctattagactaccttatttaaagttggtatcgaaggagtaacgtaccggaagggaaactaccccgtaaaactccgtagtacttactatagactcgactactaccttacgttacgacgtaacgggtccgggtaccctaagttaccggtaacggtttacgaggtcggtacgtaggttacggtactcggtaggtaactaagttactttcgaccttcgtaccaacctagtacacgtacgtacgtacgtacgtaaccgtaaccgtaggtaactttacgtttacgtaacccttaacttacgttaactacgtaacctaagtacgtacgttactacgtcccgtcccggtacggtaccgtacgaccggacggtacgacggtaagaactaacggaacgtacgtagtcggactacgaccgtactcttagtc

SEQ ID NO: 288109 - DNA, 682 bp, Homo sapiens
  misc_feature: GYAE6OF02JD6IC.6.19.B08.1.454.CMB.1.raw
  modified_base (307)..(307): a, c, t, g, unknown or other
  misc_feature (307)..(307): n is a, c, g, or t
tcagatatcgcgagcacgaccggtgctcgatttagtgagtcagtaaggggagtcagtctcagtcaggacacagcatggacatgagggtccccgctcagctcctggggctcctgctactctggctccgaggtgccagatgtgacatccagatcgacccagtctccactccctcctgtctgctatctacggacgacacagtcgaccactactccttacgtccgggccgaagtacacgagcactatacacctaactttaatttaagtgtactacgagaagtacacgggaaaggaccctaacctacctacngtactatagtgtagcactacctcttaacgttacgaacggtaagggtccggtacctacgttacggtacgtacgtaggtcgagttaggagttacgtcggacggaactgttactttaccgtacctcctacgacctacgtacgtacgacgttactcgtaccgtaacgtacctaaggttaacgtttacttacgtaccttaacttaccttagttactaacctaacgtacgttaactacgaccggttacctccggaccggttaacggtccggtaacggtaccgggtaacggtacgggttaaacggaaacccttaaagggtaacccgtaacgggtaccggtacggttacggtaaccgttaccgaacttccggtttacttaccg

SEQ ID NO: 288110 - DNA, 659 bp, Homo sapiens
  misc_feature: GYAE6OF02IYNMO.6.19.B08.1.454.CMB.1.raw
tcagatatcgcgagcacgaccggtgctcgatttagtgagtcagtaagggggagtcagcctcagtcaggacacagcatggacatgagggtccccgctcagctccgtgggctcctgctactctggctccgaggtgccagatgtgacatccagatgacccagtcctccatccctccctgtctgctatctgtaggacacgagagtcaaccatcacgttggcccgggacaacgtcaagacgctaattacgacctaaccttaatttaaaacttggtaacttacgaaggtaagaacgtaccgaaagggtaaaccgtaacccctaaacgttcctagtactacctagtagatcgactactcctactttacgacgtaacggtacgggtacctaagtaccgtaaggtttacgaggttacggtcgtaacggtacgtacgtttcgaacggggtactaacggttaactttcgtacctacctaccgtaacctacttacgacgtacgttaactccgtacgaacctacgtaacgtaagttcttttacgaccttaatttacctactagtactaacgtagtacgttaccgtacgttcgcccgtaggtacgttaccgacgaacgacgtaacggtcaaatacgaaacgtagtacgacggtactcgactcgtactcgtacg

SEQ ID NO: 288111 - DNA, 594 bp, Homo sapiens
  misc_feature: GYAE6OF02GPIDV.6.19.B08.1.454.CMB.1.raw
  modified_base (250)..(250): a, c, t, g, unknown or other
  misc_feature (250)..(250): n is a, c, g, or t
  modified_base (260)..(260): a, c, t, g, unknown or other
  misc_feature (260)..(260): n is a, c, g, or t
  modified_base (268)..(268): a, c, t, g, unknown or other
  misc_feature (268)..(268): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagagcattagcactatttaatggtatcaganatcaggaacnccctaacncctgatctatgatgcatcctactttgacgtaaaggtcggggtcccatacgtaacggttcaggttggacaggtaggatcgtgggactaggtactttcgactcctacacctatacagctaacgtctacgacctaaccgtaggtaaagttatttacgaactaaacttactacttacgtacaaacgtagtaacgttacagttcccgaccccgttacgggaccgtttaccggacccggtaacgggtaaccgaaagggttaacggaaaacgttaaccgaaaacggttacgttaggtacggtaccgtacgtacccgaccgtattccgttaccg

SEQ ID NO: 288112 - DNA, 817 bp, Homo sapiens
  misc_feature: GYAE6OF02HPAHX.6.19.B08.1.454.CMB.1.raw
  modified_base (232)..(232): a, c, t, g, unknown or other
  misc_feature (232)..(232): n is a, c, g, or t
tcagatatcgcgagcacgaccggtgctcgatttagtgagtcagtaagggggagtcagtctcagtcaggacacagcatggacatgagggtccccgctcagctccgtggggcctcctgctactctggctccggaggtgccagatgtgacatccagactgacccagtcctccatccctccctgtctgcatctgacggacacagatcaccatcacgttggccgggacaagtcaganacattagcaccttaatttaaattggtaatcaaggataatccgaagggaacgacccctaaactcctagatcctatgatgactactcctactttagacgtaaaggtcgggtacccaagtaccgtaagggttccaggtcggacgtacggtaggactcggtacggggactaggtactttaccgaccttcctacctaaaccctaactaccgacgtaccttaggttacctacggaacccgtaaacccgttagggtaaaacgtttaccgtttttaacggaacccttaaaacgtttttaacccttaaccgttacggttaaacctaaaacccggttaaggtttaaaccggttttaacccggtaacccgggtttccccggttaaccccccgggttaccgggttaaacccgggttttacccgggggaccccggttaaaaccgggggtaaaccccggtttaaaacggggttaaaccgggtaaaaccccgtttaaaccggaaaaaaccccggggttaacccggtttagggttaaccgggtacccggtaaccggttaaaccccgaaacccccgtttacggtacccggtttttaacccgg

SEQ ID NO: 288113 - DNA, 593 bp, Homo sapiens
  misc_feature: GYAE6OF02G4INI.6.19.B08.1.454.CMB.1.raw
  modified_base (300)..(300): a, c, t, g, unknown or other
  misc_feature (300)..(300): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtagacacagagtcaccatcacttggccggcaagtcagagcattagctaaccttaatttaaatggtatcgaaggagaactccgaagggaaactacccctaaactcctagactctangatgctatcctatttgactaaaggtcgggaccatacgtaaggttcagtggacaggtggatcgtaggacagtactttcactctacacatacagtcagtctagactaccgtagtaacgttatttacgaaccttaacgtttacctacttcgaacctaacgtagtacgttacgacgttaccgtacccggttacggtaaccgttcgggaacccgacgggtaaccgtaagggtaacggtaaacgtaaccgaaaacgtaccgttaggtacgtacgtacgacctaaccgtacttcgttacg

SEQ ID NO: 288114 - DNA, 658 bp, Homo sapiens
  misc_feature: GYAE6OF02GS81T.6.19.B08.1.454.CMB.1.raw
  modified_base (503)..(503): a, c, t, g, unknown or other
  misc_feature (503)..(503): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtcctccactccctcctgtctgcatctagtaggacacagacgtcaccatctacgttcggaccgggtaatcgagagctaagttacgctaaccttaattttaaagttcggtaactacgaagggaataacgtaccgaaacggggaaacctaccccttaaaactccgtagtaccttacgtagtagacgtcgacctacttacccttaacgtttcggaaccgtaaacggggttccgggtaccctagttaccgtaacgggttcagggtcggacgtaagggtgtacgtcgtacgggactacgtaatttccactcctacaccatcagtccagtcacgactaactggtaagttntttacaactttacttaactctacgtacaagtacgttagtacctcggtccaccgttcggtacgtaaccggacgaacggtacgtaaggtaacggaaactaaccggtaacggaactcggtacgtccgacgtccgaacctcgttacctcgtttaacccg

SEQ ID NO: 288115 - DNA, 649 bp, Homo sapiens
  misc_feature: GYAE6OF02JH16D.6.19.B08.1.454.CMB.1.raw
  modified_base (259)..(259): a, c, t, g, unknown or other
  misc_feature (259)..(259): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgctatctgtagacacagagtcaccatctacgttcggccggacaagtcagagctattagctaaccttaatttaaattggtaancgaaggagaataccgaagggaaacctacccctaaaactccgtagacttactagtagatcgactactacctacttgacgtaaacggtcggtaccctatacgtaacgttcgaggtacggactaaggtgtacgtcgtacggaactacggttactttaccacgtacctacgtactacgtacacgtactacgtacgtacgacctaacgtagttaacgttacttttacgacttaaccttaactaaccttacgtaactaacgtaacgtaagttaccgtacgttccgtacccggtacggtaccgttaccggaccggtaacggaaccggtaacggtaacgtaaacgtacggtaaacgtacgtacgtacggtaccgtcgtaccgtaccgtactacgttcg

SEQ ID NO: 288116 - DNA, 656 bp, Homo sapiens
  misc_feature: GYAE6OF02FKLKO.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagatccgagggaacaccctaaactcctagatctatgatgactactcctacgtttcgacgtaaaggttcggggtacccaagttaccgtaacggtttccaaggttcgggactaagggttcgggaagttcggtacggggtacgtaagttacttttaccgaaccttccgttacaccctaattaccacgtacctacggttaccttgacccgtaaacctagttaaacgtacttttacgaccttaaaccgtttaactacgttacgtaccaaacgttagtaaacgtttacgtacgtaccgtccccgttacggtaacgttccgggtaacccgacggggtaacccgtaaggttacggaaacctaaccgtaaaaccgtacgttagacggtcgtacgccgtacctactcgttacg

SEQ ID NO: 288117 - DNA, 570 bp, Homo sapiens
  misc_feature: GYAE6OF02JJH27.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccggacaagtcagagcattagcaacctatttaaattggtatcaggagaatccagggaaacgcccctaaactcctgatactatgatgacatcctactttgacgtaaaggtcgggtacccatacgaaggtttcaggtggcaggtggatcgtaggacagtatttcactctacaccataccgagcctagtctacgacctaacctagtaacgtattttacgacctaactttactacttcgtaacaactaagtagttaacgacgttccgtcccgtacggtacgtaccggtaccgaacgggaaacgaaggtaacggtaaacctaagtaaaccgaacgttggtacggtcgtacgacctacacgttattcg

SEQ ID NO: 288118 - DNA, 659 bp, Homo sapiens
  misc_feature: GYAE6OF02IUKPW.6.19.B08.1.454.CMB.1.raw
tcagatatcgcgagcacgaccggtgctcgatttagtgagtcagtaagggggagtcagtctcagtcaggacacagcatggaaatgagggtccccgctcagctcctggggctcctgctactctggctccgaggtgccagatgtgacatccagatgacccagtctccatcctccctgtctgcatctgtaggacacagacgtcaccatcacttgccgggcaagtcagagcattagcacctatttaaatgtatcaggagaatccgaggaacgcccctaaactcctgactctatgatcgctactcctacttttgactaaacggttcggggtacccagtacgtaaggttcgaagtcggactaggtggtacttcggtagggacagtactttaccacttctaccaacctatcacgacgtagtctacgacctaacccgtagtaacgtattttaggaccttaacgtttactactttacgactaaccgtagtaacgttacctaacgttccggtaccccgtttaccgggaaccggtttccgggaccccgtaaagggtacccggtaaacggggtttaacggtaaaacgttaaaccgaaacggttaaacccgttacgggtaacggtaccggtaccggtaaccctacccgtaacgtttaccgtcggtttaacccg

SEQ ID NO: 288119 - DNA, 643 bp, Homo sapiens
  misc_feature: GYAE6OF02JVPKO.6.19.B08.1.454.CMB.1.raw
tcagatatcgcgagcacgaccggtgctcgatttagtgagtcagtaagggggagtcgagtctcagtcaggacacagcatggacatgagggtccccgctcagctccgtggggctcctgctactctggctccgaggtgccagatgtgacatccagatgacccagtctccatccctccctgtctgctatctgtaacggacacagacgtccacctatcctacgttcggccgggacaagtcaagagctagttagctaccttatttaatgtatcgaggagaatccgaaggaacctacccgtaaactcctagtactctatagatgactactacctatttcgactaacggtcggtacctactacggtaagtttcgaggtcggtactacgggttgagtcggtaggacgtaagtacgtttactactaccgtactacaactcgacgtacagtactacgacctacgtagtaacgttacttacgtactaacttactactacgtaactaacctagtaacgttacgtacgtcctacccggttacgaccgggtttaccggaccgtaacgggtaaccggtaacggtacgggtaaaactaacgtaaaccccggtaggttaccgtacgggtctaccggtacgaacccgtcttacccgggttac

SEQ ID NO: 288120 - DNA, 735 bp, Homo sapiens
  misc_feature: GYAE6OF02G9RZO.6.19.B08.1.454.CMB.1.raw
  modified_base (233)..(233): a, c, t, g, unknown or other
  misc_feature (233)..(233): n is a, c, g, or t
  modified_base (726)..(726): a, c, t, g, unknown or other
  misc_feature (726)..(726): n is a, c, g, or t
tcagatatcgcgagcacgaccggtgctcgatttagtgagtcagtaagggggagtcagtctcagtcaggacacagcatggacatgagggtcccgctcagctcctggggctcctgctactctggctcgaggtgccagatgtgacatccagatgacccagtctccatcctccctgtctgcatctggtacggacacagacgtcaccatcctacttcgggccgggacaacgtcagganctattacgcctacttaattttaaagttggtatacggaaggaacgtaacgtaccgaagggaaaccgtaccccttaaacgtcctagtactctagtagtactcgactactccttacgttcgacgtaaacgggttcgggtacctagtaccgtaaggttacgaggtacggtacgtaggtacggtagtcgtagggaacctaggtttacctttccgtaccgttacctaccgtaccgtaacgtacaacggtcgtaaccgttcgtaccgtaaccctaaacggttacggtaaacgttttaccttttaacgaaaccgtttaaacctttaaccggttactacgttacctaaacggtcgttaaacggttaccggtaacttccccggtacccgttagggttaaccggttacccgggaccggtaaacgggtaccgttaaagggggtaacgtaaaccgtaaggtaaacccgttaggttcggtaacggcgttaaccgtaccgacctttanccgtttacg

SEQ ID NO: 288121 - DNA, 586 bp, Homo sapiens
  misc_feature: GYAE6OF02IIZ25.6.19.B08.1.454.CMB.1.raw
  modified_base (256)..(256): a, c, t, g, unknown or other
  misc_feature (256)..(256): n is a, c, g, or t
  modified_base (295)..(295): a, c, t, g, unknown or other
  misc_feature (295)..(295): n is a, c, g, or t
tcagatatcgcgagcacgaccggtgctcgatttagtgagtcagtaaggggggagtcagtctcagtcaggacacagcatggacatgagggtccccgctcagctcctggggctcctgctactctggctccgaggtgccagatgtgacatccagatgacccagtctccatcctccctgtctgcatctgtaggacacagatcaccatcacttgccgggcaagtcagagcattagcaccttatttaaattggtatcagganaatccgagggaaacgaccctaaactcctagatctatgangcatccatttgactaaaggtcgggtcccatacgaaggtttcaggtggacagtggatcgtgggacagtatttcacttctaccaccattaccagctagtctgacctaacctgtaaagttattttacgactaaactttactaacttgtacctaaacgtagtagttaacgtacgtccgtaccccgtcggaaccggtttccggaacccggtaagggaaccgtaaacgggtacggtaaaacgtacggaaaaaccgtacgttacgtaggtcctaggaccctaacctagtccgttaccg

SEQ ID NO: 288122 - DNA, 705 bp, Homo sapiens
  misc_feature: GYAE6OF02GXVXI.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatccctcctgtctgcatctgtaggacacagacgtcaccatcacttcggccggacaagtcagagcattagactacttaatttaaattggtactacgaaggaagaactaccgaagggtaaaccgtacccctaaactccgtagtaacttcttaatagatacgactactcctacttcgaacgtaaaggtcgggtaccctaagtacgtaacggttacgtaggtacggcgtaaggtggtacgttacggtagggtaaccgtaaggttaacttttaccgtaaccgttaccgttaaccctaaccgtaacgttaccgacgttaccgtacgttcgtaaccgtaaccctaaacggttagtaaacgtttaattttaccgaaacttaaaccctttaacctacgttaactaccgtaaacgtagttaacgttacgtaacgttcccgtacccggtacggtaccgttaccggaccggtacgggtaaccgtaaggtaaacggtaaacgtaaccgaaacgtacgtaggtacggtcgtacgtacgaccgttactcgttaaccg

SEQ ID NO: 288123 - DNA, 493 bp, Homo sapiens
  misc_feature: GYAE6OF02FH7H3.6.19.B08.1.454.CMB.1.raw
  modified_base (268)..(268): a, c, t, g, unknown or other
  misc_feature (268)..(268): n is a, c, g, or t
  modified_base (382)..(382): a, c, t, g, unknown or other
  misc_feature (382)..(382): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaancccctaaaactcctgatctatgatgcatcactttgcaaagtgggtccatcaagttcagtggcagtggatctgggacagatttcactctcaccatcagcagtctgcaacctgaanattttgactaacttactactgtacaacagtaacgttacagttcgcccctcggacgttcgaccgtagggaccaaggtacggaatacaaacgaactagtggctgcacatctcg

SEQ ID NO: 288124 - DNA, 806 bp, Homo sapiens
  misc_feature: GYAE6OF02G9J6L.6.19.B08.1.454.CMB.1.raw
  modified_base (237)..(237): a, c, t, g, unknown or other
  misc_feature (237)..(237): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtcctccatccctccctgtctgctatctgtaggacacagtagtccaccagtccacttcggccgggacaaaggtcagganctattagacctaaccttaatttaaagttggtatacgaaggagtaactaccgaagggaaaccacccctaaactccgtagatctaagtgatcgactacttcctacgtttacgaacgtaaaacgggttccgggtaaccctaagttaccggtaaacggtttacgaacgggttacggacgtaacgggttcggtaacgttacggtacggggtaacctaaggttaaccttttaccgtaccttaccgtaccctaacctaataccgtaacgtacgtaacgttccgtaaccgaaccgtaaaccgttaaggttaaacgttaacgttttacgaacccgttaaacttttaacccgtaacgtttacgtaaccgaaaaccgttaacgggttaaccgtttaaaccgtaaccgggttaccccgttaaccccggggtttaccggtacccggtttacccgggaacccggtaaaccgggggtaacccgtaaagggggttaaaccgtaaaccgtaaaccggtaaaacccggtaacggttaacggtacggtacggttacccgaaccctaacgttaccgttcgttaacccgg

SEQ ID NO: 288125 - DNA, 662 bp, Homo sapiens
  misc_feature: GYAE6OF02HQ5EY.6.19.B08.1.454.CMB.1.raw
  modified_base (501)..(501): a, c, t, g, unknown or other
  misc_feature (501)..(501): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtccaccatcacgttcggccgggcaagtcaggagctaattagacctaaccttaattttaaaagttggtaatcgaagggaagtaaacgtccgaaggggaaaacctacccccttaaaactccgttaagactaccttaagtcgtatcgcctactccctaacgtttcgaacgtaaagggttccgggtaccctaagttaccgtaaacggtttcaacgggtggacgtaggtcggtactcggtagggaactaggttactttaccactctaccactatcaagctaagtctcgaacctacagtaacttagtttanacctaacttactactagtaaccaagtacgtaacgttacgacgttcccgtcccggtacggtaacggttccggaacgtaacgggtaccgtaaagggtaacgtaaaccgtaacgtaaacgtacggtacggtacggtacgtacgtaaccacgttacctcgttacg

SEQ ID NO: 288126 - DNA, 834 bp, Homo sapiens
  misc_feature: GYAE6OF02I9P7U.6.19.B08.1.454.CMB.1.raw
  modified_base (135)..(135): a, c, t, g, unknown or other
  misc_feature (135)..(135): n is a, c, g, or t
tcagatatcgcgagcacgaccggtgctcgatttagtgagtcagtaagggggagtcagtctcagtcaggacacagcttatggacatgagggtccccgctcagctcctggggctcctgctactctggctccgaggtnccagatgtgacatccagatgaccctagtttccatccctccctgtctgctattctggtacgacacagacgtccaacctattcacgttcggcccggggacaagtccaagtacgactagttacgcctaacctttaattttaaaacgttgggtaattaccggaaagggtaaacgtaaacttaccccggaaaaggggtaaaaacccgtacccccccttaaaaaccgttcccgtagttaacctttaaccgttaagtacggtaactcggtaaccttaacgttaccccgttaacgttttaccggaaccggtttaaaaaccgggggttccgggggttaaaccccctaaggtttaacccgtaaaggggttaacgacggttacggaccgtaggttacggacgtttaccgggtagggtaccgttaagttaccgttttacctcctttaccgaccctaactacctgaacggtctacgttcgtaaccacgttaaccgttaagtagttttacgtttccaaatttaacccgtttacctaacgttcggtaaactaaacgtagtttaccgttaaacgccggtttaccccgacccggttacggttcggaccgggtaaccggtaaggtaaccgttacgggttaaacggaaaccttaaacgaaaccgtcggttagaccggttaggtaacccgacttaaccggtactttcggtaccttacgg

SEQ ID NO: 288127 - DNA, 680 bp, Homo sapiens
  misc_feature: GYAE6OF02JBLQC.6.19.B08.1.454.CMB.1.raw
  modified_base (95)..(95): a, c, t, g, unknown or other
  misc_feature (95)..(95): n is a, c, g, or t
  modified_base (182)..(182): a, c, t, g, unknown or other
  misc_feature (182)..(182): n is a, c, g, or t
tcagatatcgcgagcacgaccggtgctcgatttagtgagtcagtaagggggagtcagtctcagtcaggacacagcatggacatgagggtccccgntcagctcctggggctcctgctactctggctcgaggtgccagatgtgacatccagatcgacccagtctccatcctcctgtctgcatcngtagacacagagtcaccatcacttggccggacaagtcagagcattagctacttaatttaagttggtatcaggagtaactaccgaagggaaacctacccctaaactcctagtactctagtgactgtacacttacctagttacgaacgtaaacggtccgggtaccagtaccgaaggttcaggtggactaggtacggtacgttacggtacggggactaaggttactttaccgaccgttctaccgtaacctactccgtaagacctacggttactacgtacctaacggttagttaaacgttacttttacgaaccttaactttccgttaacttccgtaacgaaccgttagttaacgttaccggtaccgttacccggtcccggtacgggttaacccgtaccggtaaccggacgggtaacgttaaacgggtaacggtaaaccgtaaccggtaaacgtacgttacggggtactaccggtacaaccccgtacgtacgttcgttacccg

SEQ ID NO: 288128 - DNA, 670 bp, Homo sapiens
  misc_feature: GYAE6OF02I6U8Q.6.19.B08.1.454.CMB.1.raw
  modified_base (322)..(322): a, c, t, g, unknown or other
  misc_feature (322)..(322): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtcctccatcctccctgtctgcatctgtaggacacagagtcaccatcacttcggccgggcaaagtcagagcaattagcaccttaatttaaattgtatcaggagaactaccgaaggaaacgtacccctaaactcctagatactattgatgactactcctactttnacgaaaggtcgggtaccctagtacgtaaggttacgtagtacggactaaggtaggtaactcggttacgggactaagtacgttttaccgtaccttaccttacgaacctagtaccaggtacaggttactacgtacctaaaccgtaggtaaacgtttagttttacgaccgtttaaaacctttaaccttaacgttacgttaaccaaaccgtaaggttaacgtttacgaacggttcccggtaccccgttaccggttaaccggttaccgggtaccggaaacggtaccgaacgggttaaggaaaactaccgaaaacgttaccgtaggtacgctacgaccctaacctagtcttaccg

SEQ ID NO: 288129 - DNA, 545 bp, Homo sapiens
  misc_feature: GYAE6OF02FLD5U.6.19.B08.1.454.CMB.1.raw
  modified_base (218)..(218): a, c, t, g, unknown or other
  misc_feature (218)..(218): n is a, c, g, or t
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (375)..(375): a, c, t, g, unknown or other
  misc_feature (375)..(375): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagacgtcaccatccacttggccgggnaagtcagagcattagcacctatttaaatgtatcaganaatccaggaacnccctaaactcctnatctatgatgcactccactttcgactaaaggtcgggtacccagtacaaggttcaggttggcaggtggatcgtgggacagtatttcactcacactntcagctagtctagacaacctgaagtatttacgactaacttactactcgtacaactagtaattacacgtccgtacccgtcggtacgttaccggaccgaacgggtaccgaaggtcggaaactacctaaacggtacgtaggtacggtactacgacctaccgtagtccgttacg

SEQ ID NO: 288130 - DNA, 740 bp, Homo sapiens
  misc_feature: GYAE6OF02GMK89.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtcctccatccctcctgtctgcatctgtagacacagagtccaccatcctacgttcggccgggacaacgtcgaagagctaattacgacctaacctttaattttaaagttggtaactacgaaggaagaacgtaccggaaacggggaaacctaccccctaaaactccgtagtacttacgtatacgtatcgtacctacttacccttacgttacgaacggtaaacgggttccgggtaacctaagtaccgttaaaggttcgtaggtcggtacgtaggttacggtacgttcggtacggtacgtagttacgttttacccgacttccctaaccgacctacgtccgaacgtaccgtacgtaccgtacgtaaccctaacgttaggttaaacgtttacgttttaaccgaacctttaaaccttaccttaacgttaaccgtaactaaaccggttaggttaaccttaacgtaccggttaccccggtaccccggttacggtaccggttacccggaacggtaacgggtaccgtaaagggtaacgtaaactaacggtaaacggtacgttggtacgctaccgacctacttacgtcgtacg

SEQ ID NO: 288131 - DNA, 851 bp, Homo sapiens
  misc_feature: GYAE6OF02G9G3Y.6.19.B08.1.454.CMB.1.raw
  modified_base (240)..(240): a, c, t, g, unknown or other
  misc_feature (240)..(240): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatcgacccagtcctccatccctccctgtctgcattctggtaggacacagacgtccacctagtcctacgttcggcccgggataagtcagtanctattacgacctaactttaatttaaagttggtactacgaagggtaacgtaacgtaccggaaaggggaaacctacccccttaaacgtccgtaggtaacttacctaagtcggtaactcggacttacttaccgttaacgtttcggaaaccgtaaacggggttccgggtaccctaaagttaccggtaaacgggtttacgtacgggtacgggtacgtaagggttcgggtaaccgtttcgggtaaacggggtaacctaaacggtttacttttacccgacctttacccgtaacctaaacccgttagttacccgaacggttaccgtaacggttacccgttacggaaacccgttaaccgttttaaggttaaacgttttacgtttttaaccgaaccgttttaaaccccgttttaacgtaacgttttaccgaaaaccgttacgttaaccgggttaaacgtttaacccgtaccgggttcccggttacccccggttaaaggggttaccccgttacgggtaaccgggtaaccgggtaaaccggttaacgggtaaacgtaaacgttaaccgtaaaacggttaccgtggtaaccgcgtaacgtacccctagttaccttaccgtacgg

SEQ ID NO: 288132 - DNA, 815 bp, Homo sapiens
  misc_feature: GYAE6OF02IA9MV.6.19.B08.1.454.CMB.1.raw
tcagatatcgcgagcacgaccggtgctcgatttagtgagtcagtaaggggggagtcagtctcagtcaggacacagcatggacatggacgggtccccgctcagctccgtggggcctcctgctactctggctccgaggtgccagatgtgacatccagatcgacccagtcctccactccctcctgtctgcatctgtaggacacagagtccaccatctacgttcggaccgggacaagtcgaagagactaagttacgacctaacctttaaattttaaaagttggttaactacgaagggtaacgtaaacgtaccggaaacggggaaaaccctaaccccttaaaacccttccgttagtacttactaagtgtactcgacctacttacctacgtttacggaacgtaaagggttccgggtaccctaagttaccgtaaggttacgaggtacggacgtaggtacggtacgtcggtagggtaacgtacgttacttttaccgaccttacctacctacctaactacgtacgtacgtacgtacgtacgtaaccgtaaccgttaacgttaacgttacgtttacgttaaccttaaaccttaaccttaacgttacgttaacctaaacgtaacgtaacgttaagtacccccccccccccccccccccccccccccccggttacgtaccccggtaccgggtaaccgggttaccgggtaaccggtaaccgggtaaccgggtaaacgggtaaacgggtaaaccgtaaaccggtaaaaccggtaaccggttacgggtacggtaccggtaccgtaccgtaaccgtaccgttacgttaccg

SEQ ID NO: 288133 - DNA, 694 bp, Homo sapiens
  misc_feature: GYAE6OF02F7GSO.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatcgacccagtcctccatccctcctgtctgctatctgtaggacacagacgtcaccatcacgttcggaccgggactaacgtcgaagagtcctagttacgcctaaccttaattttaaaagttggtacttacgaaggacgtaaacgtaccggaagggaaaacctacccccttaaactccgtaggtacttacctaagtcgtatacggtactactaccttacgttacggaccgtaaagggtccgggtaccctagtaaccgtaaggttcgaggtcggacgtaggtagatcggtacgggtaactaggttacctttcgaaaccttccgtaccctaacctacgtaccacggtaccgtaagttaccctaggtacccgtaaaccgttaggttaaacgttagtttaccgaacttaacgttaccttacgtacgtacaactagtacgttacgacgttaccgaccccgtaggtaccgtacggaaccgacggtaacgaagggttaacaacgtaacgtaaacgtagttacggacgtacgtccgaacctcgttagtccttacg

SEQ ID NO: 288134 - DNA, 597 bp, Homo sapiens
  misc_feature: GYAE6OF02IMXB4.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcaacttaatttaaattggtaatcaggagaactccgaagggaaacgtacccctaaactcctagactctatgatcgactatcctactttagacaaaggtcgggtaccctagtaccgtaaggttacaggttcggacgtaggtaggactcgtagggactagtatttaccacgtactccaaccatacgagtacagtcacgacacgtagaagttactttacgactaacttactacgtgtaaccaactagtacttacgacgttccgtccccgtaggtacccggttcggaaccgaacgggaccgtaaggtaacggaaaccgtacgtaaaacggtacgttaggaggtaccgtcgaaccgacctactaccgttacg

SEQ ID NO: 288135 - DNA, 642 bp, Homo sapiens
  misc_feature: GYAE6OF02HVIVT.6.19.B08.1.454.CMB.1.raw
  modified_base (95)..(95): a, c, t, g, unknown or other
  misc_feature (95)..(95): n is a, c, g, or t
  modified_base (401)..(401): a, c, t, g, unknown or other
  misc_feature (401)..(401): n is a, c, g, or t
  modified_base (472)..(472): a, c, t, g, unknown or other
  misc_feature (472)..(472): n is a, c, g, or t
  modified_base (492)..(492): a, c, t, g, unknown or other
  misc_feature (492)..(492): n is a, c, g, or t
  modified_base (614)..(614): a, c, t, g, unknown or other
  misc_feature (614)..(614): n is a, c, g, or t
tcagatatcgcgagcacgaccggtgctcgatttagtgagtcagtaagggggagtcagtctcagtcaggacacagcatggacatgagggtccccgntcagctccgtggggctcctgctactctggctccgaggtgccagatgtgaccatccaagatcgaccctagtcctccactccctcctgtctgctatcgtagtacggacacaggactcaaccatcctacgttggcccgggactaaacgtcgaagagtaccgtaattacgacctaaccttaaattttaagtggtatacgaaggataacgtaccggaaaggaaccctaaccctaacgtcctagtacttactagtgactgactacttactacgttagaacgtaaaggttccggaacctagtcgtaaacgttnacggtcgacgtaggttacggactacggtaggacttagttactccaacttcgacacatcagtagtacgtcanaaccgtactaggtaactttntacgaaccttaagtacctagtacgtacaagttgaaacttacgtaccggtacgtccccggttaaggtaccggttaccgacggttaacggaacgtaggtaaacgacgtaacctaaggccgttanacggtacacgtacctacggcttaccgtc

SEQ ID NO: 288136 - DNA, 679 bp, Homo sapiens
  misc_feature: GYAE6OF02G4B21.6.19.B08.1.454.CMB.1.raw
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatcctccctgtctgcatctgtaggacacagagtcaccatcacttgccgggcaagtcagagcattagcacctatttaaatggtatcgaganatccaaggaaacnccctaaactctgatctatgatgcatcctactttgactaaaggtcgggtacccagtacaaggttcaaggtggacctaggtcgggtactcgtacggggaactaaggtacttttaccgaaccttcctaccgaacccgtaattaccgaaggtccctaaagttccgtacgtaaccctaaaccgtacggtaaaacgttacgtttttacggaaccttaaaccgtttaaccttaacgttacgtaccgtaaacgttaagtaaccgtttaacgacgttaccgtaccccgttacgggtaacccgtttacgggaacccgaaacggggtaccggtaaaacgggttacggtaaaaccgttaaccgaaaaccggtaaccgttacgggtacggtacgtaccgtacccggtaaccttacgtccgtttacg

SEQ ID NO: 288137 - DNA, 675 bp, Homo sapiens
  misc_feature: GYAE6OF02H0IK9.6.19.B08.1.454.CMB.1.raw
  modified_base (494)..(494): a, c, t, g, unknown or other
  misc_feature (494)..(494): n is a, c, g, or t
  modified_base (656)..(656): a, c, t, g, unknown or other
  misc_feature (656)..(656): n is a, c, g, or t
  modified_base (670)..(670): a, c, t, g, unknown or other
  misc_feature (670)..(670): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatcgacccagtcctccactccctccctgtctgctatctgtacggacacgagataccaccatctacttcggaccgggacaagtcgagagcattagacctaaccttaattttaaattggtaatacgaaggtaagaagtaccggaagggtaaacccaccccgtaaaacctccgtagtaactctaactgatcgtactactaccgtacgtttacgacgtaaacgggttcgggttacccaacggttacgttaacgggttacgtaggtacggtacgttaacgggtaggtacgttacggtagggtaacgtagttacgtttacctaccttactaccgaccctaagtcaacgntaacgtcgtacgacccgtaaattcgtaaagtttcctttaacgaccttaaacctttacgacttacgtaaccaacgtagttacgttaacgcgttccgacccggttaggaccgttacgaccgtacgtaacggtaggaaactacgaaactaacgtaggtgtacggntaccgctacctgtnttccg

SEQ ID NO: 288138 - DNA, 709 bp, Homo sapiens
  misc_feature: GYAE6OF02HOVEQ.6.19.B08.1.454.CMB.1.raw
  modified_base (215)..(215): a, c, t, g, unknown or other
  misc_feature (215)..(215): n is a, c, g, or t
  modified_base (261)..(261): a, c, t, g, unknown or other
  misc_feature (261)..(261): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtagacacagagtcaccatcacttggccgganaagtcagagctattacgctaccttaatttaaattggtatcaagganaactccgaagggaaaccgtacccctaaactcctagatcgtatgatcgctactccgtactttgaacgtaaggttcgggtaccctaagttaccgtaacggtttcgaggtcggacgtaggtcggtactcggtagggaacttacggttaacttttccgaaccttcctacccgtaaccgtataaccgacggtctaacgtttccgtacgtaacccgtaaccgtaaggttaacgtttacgttttacgtaaccttaaaccttttactaccgttagttaaccctaaaacgtagtaacgtttaaccgacgttaccccggtccccgttacgggtaacccggtttacccgggaaccggtaaccggggtacgtaaacggggtaacgtaaaccgttaaccgtaaaccgtaccggttacggtacggtaccgttacgtaccccaacgttacttccggttaaccg

SEQ ID NO: 288139 - DNA, 606 bp, Homo sapiens
  misc_feature: GYAE6OF02GQSH7.6.19.B08.1.454.CMB.1.raw
  modified_base (407)..(407): a, c, t, g, unknown or other
  misc_feature (407)..(407): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagacgtcaccatcaacgttcggaccgggacaagtcagagcattacgcacctatttaaattggtatcgagagaatccgaagggaaacgcccctaaactccgtagattctaagtgatgacatacctacgtttgacaaaggtcgggtccatacgtaagttcgagtggacaggttggattcgtagggaacagtactttcactctaccacatcagtcgtntctacgacaccgtataacgtattttacgacttaaccttacgttactccgtaatacgtaagtaaccgttagtaccggttaccgtaccccgtacggtaaccggttccggaaccgtacggggtaaccgtaacggggtaaaggaaacctaacggaaaccgtaacggttcgacggtactaccgactaaccgtacttcgttaccg

SEQ ID NO: 288140 - DNA, 531 bp, Homo sapiens
  misc_feature: GYAE6OF02F8EEW.6.19.B08.1.454.CMB.1.raw
  modified_base (355)..(355): a, c, t, g, unknown or other
  misc_feature (355)..(355): n is a, c, g, or t
  modified_base (445)..(445): a, c, t, g, unknown or other
  misc_feature (445)..(445): n is a, c, g, or t
  modified_base (504)..(504): a, c, t, g, unknown or other
  misc_feature (504)..(504): n is a, c, g, or t
  modified_base (527)..(527): a, c, t, g, unknown or other
  misc_feature (527)..(527): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccgagggaaacgcccctaaactcctgatctatgatgcactccacttttgacgtaaaggtcggggtcccatacgaaggttcagttggcagtggatcgngggacagtattcactctcacctatcagcacgtctagactaacctagtaatattttcgactaacttactatagtacaacagtacttaacgngttcgtacccgtggaccgttcgaccgagggaccgaaggtacggaaatacgaaacgtacnggtacgcgtacgtacgactagtntacg

SEQ ID NO: 288141 - DNA, 678 bp, Homo sapiens
  misc_feature: GYAE6OF02GOYI8.6.19.B08.1.454.CMB.1.raw
  modified_base (194)..(194): a, c, t, g, unknown or other
  misc_feature (194)..(194): n is a, c, g, or t
  modified_base (264)..(264): a, c, t, g, unknown or other
  misc_feature (264)..(264): n is a, c, g, or t
  modified_base (289)..(289): a, c, t, g, unknown or other
  misc_feature (289)..(289): n is a, c, g, or t
  modified_base (417)..(417): a, c, t, g, unknown or other
  misc_feature (417)..(417): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtcctccatccctccctgtctgcatctgtaggacanagagtcacatcacttcggccggacaagtcaagacgactatagctaaccttaatttaaattgtatcagganactaccgaggaacaccctaactccngtactctatgatgactactacccttagttagacgtaaaggtcgggtacctaagtaccgtaaggttcgaggtcggactacggtagtacgtcgtgggaactagttactttacgtacctctacctaacctntaccgagtacgagttcgacgtacctaaccgttgttaaacgtttgttttaaccgactttaaacccgttacgttacgtacgtaagtaaccgtagttacgttaaccggttacgtacccggttacccgtacgggttaacccgggtaccggtaaccggaacgggttaaccggtaaacgggttaacggtaaaccgttaaaccggaacggttaaccggtagtttaaccgggtaccgtaccggaacgttaccgtactttccgttaaccg

SEQ ID NO: 288142 - DNA, 607 bp, Homo sapiens
  misc_feature: GYAE6OF02FNAL2.6.19.B08.1.454.CMB.1.raw
  modified_base (601)..(601): a, c, t, g, unknown or other
  misc_feature (601)..(601): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcacatcacttggccgggcaagtcagagcattagcaccttaatttaaattggtatcaggagaactaccgaagggaaaccacccctaaactcctagatctatgatgcactcctacttgacgtaaggtcggggtaccctagtacgtaacggttcgaggtcggactaggtggacgttcggtaggggaactaggttactttcacgttcctaccaacctactcgaagtcgtacgttccgacgacctaacgttagtaacgttactttacgacctaaactttactacgttagtactaacgtagtacgttacacgttccgtacccgtacggtacgttaccggacgtacggaacgtagggtaacgtaaacgtacgtaaacgtacgtaggtacggtactagaccgtacctacgtnttaccg

SEQ ID NO: 288143 - DNA, 569 bp, Homo sapiens
  misc_feature: GYAE6OF02FLZQM.6.19.B08.1.454.CMB.1.raw
  modified_base (267)..(267): a, c, t, g, unknown or other
  misc_feature (267)..(267): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccggcaagtcagagcattagcacctatttaaattggtatcaggagaatccagggaaancccctaaactcctgatctatgatgcatcctactttgactaaaggtcggggtcccatacgtaaggttcaggttggcgtaggtggatcgtgggacagtatttcactctcaccatcagcagtctcgacctaacctgtaactattttcgacctaacttactacttgtacaacgagtagttacgacgttccgccccgtacggtaccgtttaccggaccgtaacgggaccgtaagggtaacggtaaactaaccggaaaaccggtaacgttaggtacggtctaccgacgtaacccgtattccgttaccg

SEQ ID NO: 288144 - DNA, 773 bp, Homo sapiens
  misc_feature: GYAE6OF02G5C95.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctcctgtctgcatctgtaggacacagagtcaccatcacttcggaccgggacaagtcagacgcattagctaacttaatttaaattggtactacgaaggagtaactaccgaaaggggaaacgtacccccttaaaactccctaggtaacttccgtaatcgtatacgactacttacctacgttttgaacgtaaacgggttcgggtaccctaagttacgtaaacgggtttcgaaggtacgggactaaggttaggtacttcggtacggggaactacgttacgttttacaacccgttctacccgtaaactaacgttacgaaccgtaccgtaacgttcctaacggtaacccgttaaaccgttaaggttaaacgttttacgttttaacgaaccttaaaccgttttaactaaccgttacgttaaaccaaacggttaagttaacgtttaaccgacgggtttaccccgtaccccggttaacgggtaacccggttaccgggaaacccggtaacgggtaaccggtaaacggggtaacggtaaaaccgtaaaccgtaaaacggtaaccgtttacggtacggtaccgtacgttaacccgtacccgttacgttactttcccgg

SEQ ID NO: 288145 - DNA, 518 bp, Homo sapiens
  misc_feature: GYAE6OF02F7EXG.6.19.B08.1.454.CMB.1.raw
  modified_base (269)..(269): a, c, t, g, unknown or other
  misc_feature (269)..(269): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaacncccctaaactcctgatctatgatgcatccactttgacaaagtgggtcccatcgaaggttcagtggcagtgatcgtggacagtactttcgactctacacctatcagcagtctagccaactgaatatttacgactaacttactactgtacaatagtattacgagtccgcccgtacggacgttcgaccgagggaccgaaggtacggaactaacaaacgtacgtaggtcggtactacgacacctagtcttacg

SEQ ID NO: 288146 - DNA, 737 bp, Homo sapiens
  misc_feature: GYAE6OF02I6TNA.6.19.B08.1.454.CMB.1.raw
  modified_base (212)..(212): a, c, t, g, unknown or other
  misc_feature (212)..(212): n is a, c, g, or t
  modified_base (233)..(233): a, c, t, g, unknown or other
  misc_feature (233)..(233): n is a, c, g, or t
tcagatatcgcgagcacgaccggtgctcgatttagtgagtcagtaagggggagtcagtctcagtcaggacacagcatggacatgagggtcccgctcagctcctgggctcctgctactctggctcgaggtgccagatgtgacatccgagatcgaccctagtctccatcctcctgtctgctaacgttcgtgtacggacacgagtctccaacctntaccgtacttggacccggganaaacgtcaaggcttacaatttagactacctaattttaaagtggttaactcgaaggagaacttaccggaaaggtaaaccaccccttaaacgcctagtactacctaatgacttgactactccgtacttgtaacgtaacggtcgggttaccagttacgtaacgtctaggtacgagtagggtcgtaaagtcgtaacgggacttaacgtctttacctacctacgttacacccgtaagttcccaaggtctcgttaacgtcgttaccaaaccgggttataaacggttattttaaccggaacctaactttttaccgtacgttacgttaaacggaacttaacgggttaattacccgtaacgttcccgtaaccccgttaaggtaccccgtttaagaacccgggttacggaaaccgggaaacgtttacggaaaacccgtacgtaaaaaccggtccgttaaacggtttcggggtacctaacggacccgtaaaccctttaggtccccggttttaacg

SEQ ID NO: 288147 - DNA, 934 bp, Homo sapiens
  misc_feature: GYAE6OF02G3LSD.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgctatcgtgtaggacacgagtacgtccaaccattaccgacgttcgggacccggactaaacgtcgaaggtacgcttaattacgacctaacctttaaattttaaaacgttgggttaacttaccgaagggtaagtaacgtacccggaaaggggtaaaaccgacccccttaaaactccgtaggtaactacttagtacgtattcgacctaacttcccgtaactttcggtaaccgtaaaacggggttccgggttaaccctaaggtttaaccgtaaagggtttacgaacggggttacgggtaccgtaagggttacggtacgtttaccgggtaacgggtaaaccgtacggttaacttttaccgtacgttccctaaccgtacccgtaactaccgtaacggtcgttacggttaccgttacgggtaaaccctaaaccggtttacggttaaacgttttacgtttttaaaccgaaccgttaaaccgttttacctttaccggttaacgttaaacgtaaaccggttacggtttaaacggttaaccggtaaccggtttcccgggtaaaccccccggtttaagggtaacccgggtttaacccggggaacccgggttaaaaccgggtaacgggttaaaaaccggggggttaaaccggtaaaaccgttaaaaaccccgggtaaaacccgggttaaccggttaaccggggtaaccggttaaccggttaaccggtaaacccccgtaacggttttaacccggttagtttaacccccgg

SEQ ID NO: 288148 - DNA, 567 bp, Homo sapiens
  misc_feature: GYAE6OF02FP4O1.6.19.B08.1.454.CMB.1.raw
  modified_base (226)..(226): a, c, t, g, unknown or other
  misc_feature (226)..(226): n is a, c, g, or t
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
  modified_base (401)..(401): a, c, t, g, unknown or other
  misc_feature (401)..(401): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctaccgaggtgccagatgtgacatccagatgacccagtctccatcctcctgtctgccatctgtaggacacgagagtcaccatcacttgccgggcaagtcaagngcattagcacctatttaaatggtatcagganatccagggaacncccgtaaactcctagatctatggatgcatcctacgtttgcgtaaagtcgggtacccagtacgtaaggttcaggttcggcaggtggaatcgtagggacaggtatttcacgtctacaccatcagtcacgtctanactaacctgtaacgttatttacgacctaacttactacgtgtaccaagagttagtacaggttccgtaccccgtagggtaccgttacggaccggtaacggaccgtaagggtacgaaactccgaaaacgtacgttaggtcggtactacggacctacgtacttcgtaccg

SEQ ID NO: 288149 - DNA, 670 bp, Homo sapiens
  misc_feature: GYAE6OF02H8U4O.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtgggctcctgctactctggctccggaggtgccagatgtgacatccagatcgaccccagtcctccactccctccctgtctgctatcgtagtacggacacgagacgtccacctatctacgttcggacccgggactaagtcagtacgctaattacgacctaaccttaattttaaagttggtaatacgaagggtaagaactaccggaagggtaaacccgtacccctaaactcctagtactctaatagatcgactactcctagttcgacgtaacgggtccggtacctagtacgtaagtgaggtggacgtaggtacggtagtcgtaggtactagttactttacctccttactacctacctactcgaacgtctagtaccgtcgaaccgtacgtagtaacgtttactttagacctttaacttaccgtacgttagtaaccaagtagtacgtaccgtacgtccgttacccgaggttacccggtacggaaccggaccgggtaacggtaaggtaacgtaaaccgtaacggaaaccgtacggtaggtacgtacgtaccgtaactacctacttgtacccg

SEQ ID NO: 288150 - DNA, 702 bp, Homo sapiens
  misc_feature: GYAE6OF02I0BEK.6.19.B08.1.454.CMB.1.raw
  modified_base (223)..(223): a, c, t, g, unknown or other
  misc_feature (223)..(223): n is a, c, g, or t
  modified_base (500)..(500): a, c, t, g, unknown or other
  misc_feature (500)..(500): n is a, c, g, or t
  modified_base (683)..(683): a, c, t, g, unknown or other
  misc_feature (683)..(683): n is a, c, g, or t
  modified_base (689)..(689): a, c, t, g, unknown or other
  misc_feature (689)..(689): n is a, c, g, or t
tcagatatcgcgagcacgaccggtgctcgatttagtgagtcagtaaggggggagtcagtctcagtcaggacacagcatggacatggacgggtccccgctcagctccgtggggctcctgctactctggctccggaggtgccagtatgtgactactaccgagactcgaccctagtcctaccacctcccgtcctgtctcgactgttctggaacggacacgaggtancctactactctacgttcgggccggacacgtacgaggtacgactactaacgcttaactttaaggtttaacgtcgttaacgaggtaacggtaagtaaccgtaacgggaaaccggaaacccgtaacccttaacgctaactacgtgtaactggtaacactaccgttactaccttaacggtggtaacggttaacggggtccgttaactaacggtacggtaacggtccgtaagggttcggagtacggggtttgacgtagggttaaccgacgttataccttccnctcgtactacgacgttcgacgtcgtacgtcgtaaccggaactacgttaacgtagtttaaccgtactaacctttacgtattaaccggtactactacgtaacgttacgtctacgggtaccttaccgggtaccgcgggtaaccgtacggacgaaccggtaaggaccgtaaggtaccaagtcgaacngaccgncgtactcgtctac

SEQ ID NO: 288151 - DNA, 752 bp, Homo sapiens
  misc_feature: GYAE6OF02JW60N.6.19.B08.1.454.CMB.1.raw
  modified_base (194)..(194): a, c, t, g, unknown or other
  misc_feature (194)..(194): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccactcctcctgtctgctatctggtaggaccanagacgtaccaccattccacgttcggcccggggtacaacgttccaggacgacttagttacgacctaaccgttaatttaaaacgttgggttaactacggtaagggtaaacggtaactaacccggggtaaacggggtaaaacccgtaacccccgttaaaaccgttacccgttacggtaacttaccgttaacgaggtaaacctcggtaacctacttaaccccttaaacgttttcggaaacggtaaacggggttaccgggtacccctaagttaccgtaaacgggtttcaggttcggacgtaaggtcgaacgttcggtaagggtacttaggtactttacgtaccgtacttaccgactacgtcacgtctagtacgtacgacctacgagttaacgttgtttaacattaaccttactacttgaacttaacagttacgtacgtcgttaccgtacccggtagacccgttacgggtaaccggacggtaacccggtaaggtaaccggtaagtaaaccgaacgttaaccgtaggtaccggacgttacgtacccgtaactacgttacttaacg

SEQ ID NO: 288152 - DNA, 756 bp, Homo sapiens
  misc_feature: GYAE6OF02HXKFY.6.19.B08.1.454.CMB.1.raw
  modified_base (613)..(613): a, c, t, g, unknown or other
  misc_feature (613)..(613): n is a, c, g, or t
  modified_base (652)..(652): a, c, t, g, unknown or other
  misc_feature (652)..(652): n is a, c, g, or t
  modified_base (750)..(750): a, c, t, g, unknown or other
  misc_feature (750)..(750): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctcatccctccctgtctgcatctgtagacacgagtagtcaccatctacttcggccggcaagtcgagagctattacgacctaaccgttaaattttaaaagttggttaactcgaagggtaagtaaacgttacccgaaagggtaaacccgtaaccccccttaaaaccgttccccgttaggttaaccttacctttaagttacggtaagttccggaaccttaaccttaccccttaacgttttacggaaccgttaaaacggggttccggggttacccctaaacggttacggttaaaccgggttttacgaaggggtttaccggacggttaacggttacgggttacgttaccgggttacggggtaacctaaacggtttactttccgtaacctttaccgtaccctaaccgtataccgagtaccgtaggttccctaggaaccctaaaccgtagtaaacgtttntttaacgaccttaacgttaccttacgtacgactaaacgngtaacttacgcgtaccgtcccgtacggtacgtaccgacggtacgggtaacagggtaaccaagaaccgtaaaggtcgtggtacgcgtacgacctacgtntactcg

SEQ ID NO: 288153 - DNA, 785 bp, Homo sapiens
  misc_feature: GYAE6OF02JQUW3.6.19.B08.1.454.CMB.1.raw
  modified_base (184)..(184): a, c, t, g, unknown or other
  misc_feature (184)..(184): n is a, c, g, or t
  modified_base (551)..(551): a, c, t, g, unknown or other
  misc_feature (551)..(551): n is a, c, g, or t
tcagatatcgcgagcacgaccggtgctcgatttagtgagtcagtaaggggaggtcgagtctcagtcaggacacagcatggacatgagggtccccgctcagctcctgggctcctgctactcgtgctccgaggtcgccagatgtgacatccagatcgaccagtcctcctactcctccctgtctacncacgtctgtacggactacgagacgtaccacctactccgtacttcggacccgggctaaacgtcaaggacgacgtatacgtcctaacttattttaagtacggttatacgtaggtagtaaactaccgaagggaaaccgtaccccgttaaaccctccgtacgtaattaccgttaacgtagttacgtcgtacgttacttaacccgttacgtttaccgtaacggtaaaacggggttcccggggttaccctacgttaccggtaaacggggtttactaaacggggtcggtacgtacgggttacgtacggtttaccggtacggggtaccctaaggttaccgtttaccctacgttaccctaccgtaacctcgtaccnaccggttaatccctagtacccgtagttaactaacgttaccgtttacacgtttaaccttaaccgtccgttaactaccggtaaataccgggtaatttacccggaaggttcccacccgggttaccggtaaccgggttacgacccggtaccggtaacggtaacgggaacggttaaacgaaccggtaaaccggtagttaccggtagtacggtcccgtaacgacgttacctcggttaccg

SEQ ID NO: 288154 - DNA, 817 bp, Homo sapiens
  misc_feature: GYAE6OF02JIGUD.6.19.B08.1.454.CMB.1.raw
  modified_base (146)..(146): a, c, t, g, unknown or other
  misc_feature (146)..(146): n is a, c, g, or t
  modified_base (789)..(789): a, c, t, g, unknown or other
  misc_feature (789)..(789): n is a, c, g, or t
tcagatatcgcgagcacgaccggtgctcgatttagtgagtcagtaaggggggagtcagtctcagtcaggacacagcatggacatgagggtcccgctcagctcctggggctcctgctactctggctccgaggtgccagactgtcganactcgagtatccgacctacgtcctactcttccctcctgtcgtcgactactcgttaggaacgacacgaggtactaccaactactacgtacgtccgggaccggaactaacggtcgaacgtacgacttaagtaccgtaaccttaacgttttaaatttaacggttacggtaactaccgggaagggtaaactaacgtaacccgggaaaacgggtaaccccttaaccccgttaacgttacgttagttaactacgttaaggtactagtacgtacctaccgttaccttaacggttacgaaaccggtacgggttaccggtacctaaggttaccggttaacggtacgtacgggtacgtacgtagggtcgtaacgttccggggtaaacgtaacgtaacgttttaccttaccgtaacctcccgtaaacctacgtactaaccggaacgtccgtaacgttaccgaaccgtaacctacggttaaggttaaacggtttcttaaccggaaactttaacctttaccgtaacgttccgaaataaccggtagtttaacccgtcgtaccgttacccgggttccgttaacgggttaccggtaaccggaaccgggttaaccggacggtaaggttaacgaaacttaacggaaccgttgtaccggtanccggtaacctacgacgttctacggttac

SEQ ID NO: 288155 - DNA, 611 bp, Homo sapiens
  misc_feature: GYAE6OF02GWHVB.6.19.B08.1.454.CMB.1.raw
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (282)..(282): a, c, t, g, unknown or other
  misc_feature (282)..(282): n is a, c, g, or t
tcagatatcgcgagcacgaccggtgctcgatttagtgagtcagtaaggggggagtcagtctcagtcaggacacagcatggacatgagggtccccgctcagctcctggggctcctgctactctggctccgaggtgccagatgtgacatccagatgacccagtctccatccctccctgtctgcatctgtagacacagagtcaccatcacttcgccgggcaagtcagagcattagcactattaatgtatcaganaatcaggaacncccaactctagatctatgangcatcctatttgacgtaaacggtcgggtaccatacgaagttcaggtggcaggtggatcgtagggactagtactttcactcaccacatcaacgctacgtctagaccctaaaccgtagaaacgtttattttacgaaccttaaacctttaccgtaacttacgtacctaaaacgtagtaaacgtttaaccacggttacccgtacccccggttacgggtaaaccgttccgggaacccggaacggggtaaccgtaaaggggtaacgtaaaacggtaaccgtaaaaccggtaacgtacggtacggtaccttagaccctaacgtacgtcttaaccgg

SEQ ID NO: 288156 - DNA, 590 bp, Homo sapiens
  misc_feature: GYAE6OF02FZYDU.6.19.B08.1.454.CMB.1.raw
  modified_base (217)..(217): a, c, t, g, unknown or other
  misc_feature (217)..(217): n is a, c, g, or t
  modified_base (271)..(271): a, c, t, g, unknown or other
  misc_feature (271)..(271): n is a, c, g, or t
  modified_base (450)..(450): a, c, t, g, unknown or other
  misc_feature (450)..(450): n is a, c, g, or t
  modified_base (573)..(573): a, c, t, g, unknown or other
  misc_feature (573)..(573): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctcctgtctgcatctgtaggacacagacgtcaccatcacttcggccgganaagtcagagcattagcacctattaatgtatcagagatcgaggaacaccctaacncctagatactatgatcgactatcctactttacgactaaacggtcggggtacccagtaccgtaaggttaccgtaggtaggactaggtggtactcggtacgggacttaacgtacttttacgaccgttacttacccacccgtatccgaagtcgaagtcctacgactaccgtagttaaacgtnttttacacgttaacttaactattacgtactaacgagtagtacgtacgttaccgcccttacggaccgttaccggaccgtaacggtacgaaggtacgaaactaaccgaacgtacgtacgagtacncgaccacgtactgttac

SEQ ID NO: 288157 - DNA, 673 bp, Homo sapiens
  misc_feature: GYAE6OF02JZQ5Q.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtgggctcctgctactctggctccgaggtgccagatgtgacatccagatgacccagtctccatccctccctgtctgactatcgtggtaacggacacgagacgtaccaacctatctacgttcggcccgggataacggtcagagactattcgactaacttatttaaagtcggtatacgaggtaagactacgaagggaacacccttaaacgctagtataccgtatgtactgactactactacgttagactaggtcggttccaagtaccgtaggttacgaggttcggactaggtacgtcttacggtaggacgttacgtactttaccaccgttacacgtaaccgtagacgtactgtacgttactacgaacctacgtaagttaaccgttatttccggaacttaacgttactacgttaacaccgtaacgtaacgtaaggttaccacgttacccgtaccgttaccgggtaccgttaccggaaccgtaccgggaacgtttacgggtaacgtaaccgttaacggtaaaccggtcgttaaggtccggtactaaccggtaccttaaccgcggttaaccttcg

SEQ ID NO: 288158 - DNA, 738 bp, Homo sapiens
  misc_feature: GYAE6OF02IPZAS.6.19.B08.1.454.CMB.1.raw
  modified_base (222)..(222): a, c, t, g, unknown or other
  misc_feature (222)..(222): n is a, c, g, or t
  modified_base (694)..(694): a, c, t, g, unknown or other
  misc_feature (694)..(694): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccggaggtgccagatgtgacatccagatcgacccagtcctccatccctccctgtctgctatctgtaggacagagatcacctatcacttcggccgganaagtcaggacgctattacgacctaaacctttaattttaaaagttcggttaatacgaagggtaacgtaactacccgggaaaggggaaaacccgttacccccctaaaacttccgtaacggtaacttacgttaagtacgaattccggaacctaccttacccttaacgtttacggaccggtaaaggggtccgggtaccctaacgttacggtaacggttcgaggtacgggactaggtcgggtacttacggtagggaccttagttacttttacccgtaccttcctaccgaaccttagtaccgtaagtccgttaacgttccaacgtaaccctaaggttaacgtaagtttacttaccgtaacttaactttacgtactataaccgtaactgttaacgtaaccgtccgtacccggtcccggtagtaccgggtacccgaacggtacgggacgtaacgggtaacgaaactaacgtaaacccggnggttacggtcgtaaccggtcctacccgtaattcttaccggttac

SEQ ID NO: 288159 - DNA, 621 bp, Homo sapiens
  misc_feature: GYAE6OF02I4IF9.6.19.B08.1.454.CMB.1.raw
  modified_base (94)..(94): a, c, t, g, unknown or other
  misc_feature (94)..(94): n is a, c, g, or t
  modified_base (130)..(130): a, c, t, g, unknown or other
  misc_feature (130)..(130): n is a, c, g, or t
  modified_base (224)..(224): a, c, t, g, unknown or other
  misc_feature (224)..(224): n is a, c, g, or t
tcagatatcgcgagcacgaccggtgctcgatttagtgagtcagtaagggggatcagtctcagtcaggacacagcatggacatgagggtccccgntcagctcctgggctcctgctactctggctccgagtnccagatgtgacatccagatgacccagtctccatccctcctgtctgcatctgtaaggacacagatcacctatcacttcggccggacaagtcagancattagctacttatttaaattggtatcaggagaatcaagggaaactcccgtaaactcctagtatctatgtatcgcatccctatttgactaaaggtcgggtacctataccgaagttcaagtcggactaggtggaactcggtggaactaggttactttacgaccttcaacctaacctataccgagtacctaacgtccttaggaaccctaaccggtagtaacggttactttacgaccttaaaacctttcgtaaccttacggactaaacgtacgttaacgtaacgtcgtacccgttacccggtcggtaacggttccgaacggtaacggacgtaaaggtaagtaaaccgtaacgtaaaccgttaacgtagtaccgtacgtaccacctacgtactcgttaacc

SEQ ID NO: 288160 - DNA, 660 bp, Homo sapiens
  misc_feature: GYAE6OF02JSOZK.6.19.B08.1.454.CMB.1.raw
  modified_base (228)..(228): a, c, t, g, unknown or other
  misc_feature (228)..(228): n is a, c, g, or t
  modified_base (263)..(263): a, c, t, g, unknown or other
  misc_feature (263)..(263): n is a, c, g, or t
  modified_base (303)..(303): a, c, t, g, unknown or other
  misc_feature (303)..(303): n is a, c, g, or t
tcagatatcgcgagcacgaccggtgctcgatttagtgagtcagtaagggggagtcagtctcagtcaggacacagcatggacatggagggtccccgctcagctcctgggctcctgctactctggctccgaggtgccagatgtgacatccagatcgacccagtcctccatccctcctgtctgcatctgagacacagacgtcaccatcacgttcggccggacaaggtcagngactattagctaactatttaaatggtatcgagganaactcggaaggaaacgccctaaacgtcctagactctagtnagtacgacactactacttgaacgtaacggtcggtaccatacgacggtttacagtgactaggtgtaactcggtaggacagtactttcgacttaccacactgtacacgtctacgtctacgaccgtaaacgtaggtaactttagttaccgtaaccttaaagtttacccttaggtacgttaaccgtaaacgtacggttaacgttaaccgtacggttaccccggttcccgtaaccgggtaaccggtttacggaacccggttaacggggaacgttaaacggggtaacgttaaacgtacccgaaaacgggtacgttaacggtcggtaacgcccggtaacctaccggttaacttcccgttaacgg

SEQ ID NO: 288161 - DNA, 630 bp, Homo sapiens
  misc_feature: GYAE6OF02FMMH8.6.19.B08.1.454.CMB.1.raw
  modified_base (267)..(267): a, c, t, g, unknown or other
  misc_feature (267)..(267): n is a, c, g, or t
  modified_base (381)..(381): a, c, t, g, unknown or other
  misc_feature (381)..(381): n is a, c, g, or t
  modified_base (420)..(420): a, c, t, g, unknown or other
  misc_feature (420)..(420): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagctactatttaaatgtatcagagaatccgagggaaacncccctaaactcctagatctatgatgctatcctactttgacgtaaaggtcgggtccatacgtaaggttcaggtgagagtggatcgtagggacagtatttccactctaccacctanactagctaacgttctacgtaccaaccgttagtaacgttnttttacgaccttaactttactacgttacgtacaaaccttagtaacgttaacgtacgttcccggtacccccgttacgggtaaccggtttacccgggaacccgaacggggtaaacccgtaacggggttaaaccgggaaaactaaacccggtaaaacgttaaccggtacggttacggtacccgttacggaccctaaccgtctttaccgttacg

SEQ ID NO: 288162 - DNA, 650 bp, Homo sapiens
  misc_feature: GYAE6OF02G1CYX.6.19.B08.1.454.CMB.1.raw
  modified_base (393)..(393): a, c, t, g, unknown or other
  misc_feature (393)..(393): n is a, c, g, or t
  modified_base (555)..(555): a, c, t, g, unknown or other
  misc_feature (555)..(555): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccactcctccctgtctgcactctggtaggacacgagagtaccaccatcacttcggccggggacaaggtcagagactattagcctaaccttaattttaaagttggtaatacgaggtaagaacgtaccggaagggaaacctaacccccttaaactccgtagtacttacgttaatgactgctactccttacttggacgtaacggtcgggtcctagtacgtaacgtgcgtggtanacggtagacgtcggtaggactacgtacgtttaccacgtcctaccaaccctagtacacggtctaggtctacggaaccctaacgtaacgtaatttacgttttacgaaccctttaaacttaacgtaccttacgtaacctaaacgtacgtacttaccgacgttccnccccggttacggaccggttaccgacggaccgggtaacgaagggtacgaaacttacgaaaccggtagtggtccggctacgacctacgtctcgttac

SEQ ID NO: 288163 - DNA, 781 bp, Homo sapiens
  misc_feature: GYAE6OF02IUO7A.6.19.B08.1.454.CMB.1.raw
  modified_base (96)..(96): a, c, t, g, unknown or other
  misc_feature (96)..(96): n is a, c, g, or t
  modified_base (324)..(324): a, c, t, g, unknown or other
  misc_feature (324)..(324): n is a, c, g, or t
  modified_base (730)..(730): a, c, t, g, unknown or other
  misc_feature (730)..(730): n is a, c, g, or t
tcagatatcgcgagcacgaccggtgctcgatttagtgagtcagtaagggggagtcagtctcagtcaggacacagcatggacatggagggtccccgntcagcctccgtggggctcctgctactctggctccggaggtgaccagatgtcgacactccagtatcgacccagtcctccactccctccctggtctagctagttctaggtacggacacgagataccacctagtactaccgttcgggacccgggactaaacggtccaagggactacgttaacgttaaggtacccctaaaacgttttaagtttttaaaaggttgggtttaanacggaaggtaacgtaaaccgtaccggaaacggggaaaccctaccccctttaaacgcttaagacttacgtactagacgtaccgtctaactacctaacggtttcgaaaccgttaaagggtccggtacccaagttaccggtaggttccgaaggtgacgtaggtagcgtcgaggtactggttactcgactcgacctacgtacgctacggtacctagtccgttaacgcccgttaaagtaggtaaaccgttttacgttaaaccggttaacctttaaacctcgttaaccggagttaaaccctaaacgtgttaaacgttacccggttacgtcccgggtaacccggttaggtaccccggttaggaaccggaaccggtaacggtaaacgtcggtaaacccggtagtaaaccccggngtttgggaaccgtcgtaacccgtacctaacggttacgttacccgtttaacg

SEQ ID NO: 288164 - DNA, 747 bp, Homo sapiens
  misc_feature: GYAE6OF02IM0ED.6.19.B08.1.454.CMB.1.raw
  modified_base (95)..(95): a, c, t, g, unknown or other
  misc_feature (95)..(95): n is a, c, g, or t
tcagatatcgcgagcacgaccggtgctcgatttagtgagtcagtaagggggagtcagtctcagtcaggacacagcatggacatgagggtccccgntcagctcctgggctcctgctactctggctccgaggtgccagatgtgacatccagatgacccagtcctccattccctccctgtctgcatctgtaggacacgagagtcacatcacttgccgggacaagtcagagctatagcaacttaatttaaacgttgtatacgaaggagtaacaccgaagggaacctacccctaacgtcctagtacttactactagaactgactacttaccgtactttaggaaccgtaagggttaccgggtaccctaagtacgtaacggttacggtaggtacggtacgtaggtacggtacgtacgtacggggtaactaagttacgttttaccgaccttaccttaccgaacccttagttaacgacgtaacgtacggttactaacggtaccctaaacgttacgggtaaactttaacggttttaccgtaaaccttaaacggtttaaaccctacggtttaagtaacccgtaaaagttaaccgttaaccgtttaaaccgtaacccgtttacccccgggttaaaccgggttacccgttaaccggggttacccggaaaacggggtacccgttaaacgggtacggtaaacgtaacgtaaacggaacgttacggacggtacgacgtacaaccggtactacgttcgttaccg

SEQ ID NO: 288165 - DNA, 773 bp, Homo sapiens
  misc_feature: GYAE6OF02F7UJF.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccggaggtgccagatgtgacatccagatcgacccagtctccatccctcctgtctgcatctgtaggacacgagacgtccaaccatcctacgttcggaccgggactaagtcagagactaagttacgctaaccttaatttaaagttggtatcaaggagaacgtaccgaaggggaaacctacccctaaaactccgtagtatactatagatcgactacttaccgtactttagacgtaaacggtcgggtacccagtacgtaacggtttcgaaggttcggacgtagggtacggtagttacggtacgggacgttaaggtacttttaccaccgttacctaacgtaaccctagtaaccacgtaccgtagtacccgttacggaaacccttaaccggtaagttaaacgtttacgttttaccggtaaaccttaaccttttaaccttaacgttaccgttaaaccgaacggttaagttaaccgtttaaccgtacggttacccttccccgggttaccggttaaccgggtacccggtaaccggtaacggggtaaccggtaaacggggttaacgggaaaacccgttaaaccggtaaaaccgttaacggggttacgtaccggttaccggtaacgtaccccgttaacggtacctttcgttaaccccgg

SEQ ID NO: 288166 - DNA, 614 bp, Homo sapiens
  misc_feature: GYAE6OF02GRRSF.6.19.B08.1.454.CMB.1.raw
  modified_base (214)..(214): a, c, t, g, unknown or other
  misc_feature (214)..(214): n is a, c, g, or t
  modified_base (222)..(222): a, c, t, g, unknown or other
  misc_feature (222)..(222): n is a, c, g, or t
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (295)..(295): a, c, t, g, unknown or other
  misc_feature (295)..(295): n is a, c, g, or t
  modified_base (355)..(355): a, c, t, g, unknown or other
  misc_feature (355)..(355): n is a, c, g, or t
  modified_base (394)..(394): a, c, t, g, unknown or other
  misc_feature (394)..(394): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatccctccctgtctgcatctgtaggacacagagtcaccatcactggccggnaagtcagngcattagctacttaatttaaatggtaatcaagganaactccgaagggaaaccnccccttaaatcctagtactntatgactgctaactcctaattcgaacgtaacggtcggtaccatcgaacgtttcaggtcgntaacggtgtatcgtagggacagtactttccaactctacnctatcgagtacagtacacgaccacgtataagttctttacgacttaaacgttactacgtacttaacgaaccgtaggttacgttaacgacccggttacctcccggtacgggaccgtttaaccgggacccgtaacgggtacctaaaggggttcggtaaaacctaacgtaaaccggtacttaccgggaggtcccgaacgtacccgtaacttaccggtattcccg

SEQ ID NO: 288167 - DNA, 677 bp, Homo sapiens
  misc_feature: GYAE6OF02J182F.6.19.B08.1.454.CMB.1.raw
  modified_base (95)..(95): a, c, t, g, unknown or other
  misc_feature (95)..(95): n is a, c, g, or t
  modified_base (229)..(229): a, c, t, g, unknown or other
  misc_feature (229)..(229): n is a, c, g, or t
tcagatatcgcgagcacgaccggtgctcgatttagtgagtcagtaagggggagtcagtctcagtcaggacacagcatggacatgagggtccccgntcagctccgtgggctcctgctactctggctccggaggtgccagatgtgacatccagatcgacccagtcctccactccctccctgtctgctatctgtaggaccacagacgtcaaccatccacgttcggccggganaacgtcacgagactaagttacgtactaaccgttaattttaaagttggtaattcgaaggaacgtaactaccgaaggggtaaacctaccccgttaaaactcccgtagtaacttccgtaattcgactcgactactacctacgttacgaacgtaaaggtcgggtacccagtcgtaaggttcgaggtcggtacagggtcgtaacttcggtaggtactagtactttacgacttacgtaacacctatcgacgtacctagttacctacgtaacctaccgtaagtaattagtttacgacttaacttacctagttacgtaactaaacgtcgtaacgtaacgtccggttaccgtacccgtacggtcgtaaccgtacgtaacgggtaccgtaacggggtactaacctaacggaaaccgttacgtacgtacgtcgtacctaaccgtactgttaccgttacg

SEQ ID NO: 288168 - DNA, 755 bp, Homo sapiens
  misc_feature: GYAE6OF02H9ETR.6.19.B08.1.454.CMB.1.raw
  modified_base (163)..(163): a, c, t, g, unknown or other
  misc_feature (163)..(163): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtcgccagatgtgacatccagatgacccagtcnccatccctccctgtctgctacgttcctagtacggacacaggacgtaccaccagtcctacgttcggccgggactaagtcaggacgctagttacgcctaacctttaattttaaagttggtaatacgaagggtaacgtaacgtaccgaaaggggtaaaccctaccctaaacccgttccgtaggtactaccgtagtacgtaatccgacttactaccgttaacgtttacgaacgtaacgggtccgggtacctaagtccggtaaagggttctacggtcggtagtaggttacggtacgtacgtacgggaaccttaggttactttacccgacctttaccgtaaccctaacgtacgtacgacgtacgtacgtaccgtactaaccgtaacggttagttaaacgttttacgtttccgaaaccgtttaacctttaaccggtacttaccgtaaaccgtaaacgttagtacgttacggaccggttccccgtacccggtccggttaaccgggtccgaaaccgggtaccggtaaccggaaggttaacgaaccgttaacggaaaccgtcgttaggcgtacgtaccgaaccgtacttaccgtcgttaccg

SEQ ID NO: 288169 - DNA, 699 bp, Homo sapiens
  misc_feature: GYAE6OF02GXCH0.6.19.B08.1.454.CMB.1.raw
  modified_base (94)..(94): a, c, t, g, unknown or other
  misc_feature (94)..(94): n is a, c, g, or t
  modified_base (213)..(213): a, c, t, g, unknown or other
  misc_feature (213)..(213): n is a, c, g, or t
  modified_base (326)..(326): a, c, t, g, unknown or other
  misc_feature (326)..(326): n is a, c, g, or t
tcagatatcgcgagcacgaccggtgctcgatttagtgagtcagtaagggggagtcagtctcagtcaggacacagcatggacatgaggtccccgntcagctcctgggctcctgctactctggctccggaggtgccagatgtgacatccagatgaccctagtcctccattcccgtccctgtctgctatctagtaggacaacgagactccaccgtntacacttggacccggataaagctaggagacctatagacaccttaatttaagtagtaactagaggagaacgtacgaacggtaacgtacccctaaactcgtacgactacgtactntagtcgtacacttctaacttacgtaacggtaaaggttccgggtaaccagtaaccgtaaggttactacggtagacgtagtacggactacgggtaggactagttacttactaccgtactacctaccgtatcgaacgtcgtacgtaccgtagacctaacgtgttaaacgtactttttaccgactttaaaccttaccgttaacgtaaccgttaaccgaacgtaaggttacgttaaaccgtaccgtacccgtacccgttaccggtacgttacccggaacccggtacgggaacggtaaacgggtaacggtaaacgtaaccggtaaaaacgtaccgtaggtaccgtacggtaccgtaccgtaaccgtacttaccgttacg

SEQ ID NO: 288170 - DNA, 818 bp, Homo sapiens
  misc_feature: GYAE6OF02G4DMN.6.19.B08.1.454.CMB.1.raw
  modified_base (155)..(155): a, c, t, g, unknown or other
  misc_feature (155)..(155): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccggaggtgccagatgtgacatccaggtnacccagtctccactccctcccgtcgtctgcattctggtaggacaacgagacgtacaccatcacttcggccgggacaagtcagagacatagctaaccttaatttaaattagtagtacgaggaagtaagtaccgtaagggaaaccgtaaccccttaaactaccgtagtaattactacgtagtactacgtacaacttaccctaacgtttacggtaacgtaaacgggttaccggggtaccctaaacgtaacgtaaacggttacgtaacgggtacgggtacgtaaggttagggtacgttacgggtaacggggtaaacgtaaggttaaacgtttttaccaaccgttacctaacccggtaaacctaaccgttaacgaacggtaaccgttaacggtcccgtaacggtaaccccgtaaaaccgttaggttaaaaggtttaacctttttacggaaaacctttaaaccgttaaaccgtttaaccctaacggtaaaccgtaaaaccgtaaggttaaccgggttaactaaccgttacccggtaccccgtacgggtaaccgtacccggtaacgggaaaccggtaacggtaaacggtaaacggtaaaaccggtaaacgtaaaccgaaaggttaccgtaggggtaccctacggaaccgactacgtacgttccgttaccg

SEQ ID NO: 288171 - DNA, 722 bp, Homo sapiens
  misc_feature: GYAE6OF02GU4X7.6.19.B08.1.454.CMB.1.raw
  modified_base (269)..(269): a, c, t, g, unknown or other
  misc_feature (269)..(269): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcattcgtgtaggacacgagacgtccaccatcacttggccgggctaaagtcagagctaattagcaaccttatttaaatggtaatcgagganaatcagggaaactaccctaaactcctagtatactatgatgcatcctactttgacgtaaaggtcgggtacccctattacgaaacggttttcaacggttcggacgtaggtcgggtaacttccggtacgggtaactacggtaacttttaccaaccgtttaccgtaacccacccgtaacgttccggaacgtaccgtaacgttccgtaccgtaacctaaacccgttagttaaacgtttacgttttaccgtaaccgtttaaaccctttacgttaaccgtttaaacgtaccgtaaacggtacggttaaacgtttaaccgtacggttcccggtaccccggttaccgggtaaccgtttacccgggaacccgaacggggtaaccctaaggggtaacggtaaaacgtaccggtaaacggtaacgttaggtacgtacggtaccgaccaccgttacgttccgtacg

SEQ ID NO: 288172 - DNA, 569 bp, Homo sapiens
  misc_feature: GYAE6OF02HMZ44.6.19.B08.1.454.CMB.1.raw
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (252)..(252): a, c, t, g, unknown or other
  misc_feature (252)..(252): n is a, c, g, or t
  modified_base (277)..(277): a, c, t, g, unknown or other
  misc_feature (277)..(277): n is a, c, g, or t
  modified_base (381)..(381): a, c, t, g, unknown or other
  misc_feature (381)..(381): n is a, c, g, or t
  modified_base (409)..(409): a, c, t, g, unknown or other
  misc_feature (409)..(409): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggnaagtcagngcattagcactatttaaatggtatcaganaatccaggaaacgccctaaactccngatctagtgatgactatcctactttgactaaaggtcggggtccaagtcgaaggttcaggtcggactaggtgtatcgtaggacagtacttcactctcactatcancagttctagactaacgttagtaacgttntttacgaaccttaacttaccgtacttagtaccaacgtaagtacgttaactacgttccgtaccccgtacggtaaccgttacgaccggaacggtaccgtaaaggtaacggaacgtaacgaaacgtacggtgtacggactacggtacctactactcgttaccg

SEQ ID NO: 288173 - DNA, 809 bp, Homo sapiens
  misc_feature: GYAE6OF02JNTRL.6.19.B08.1.454.CMB.1.raw
tcagatatcgcgagcacgaccggtgctcgatttagtgagtcagtaagggggagtcagtctcagtcaggacacagcatggacatgagggtcccgctcagctcctgggctcctgctactctggctcgaggtgccagatgtgacatccagatgacccagtctccatcctcctgtctgcatctgtacggacacgagagtccacctatccgaaccgtttggcccgggactaacggtccaggacgacctagttagtacctaccctttaattttaaacgtttaggttaacgttacgacggtaaggaacttacccgaaggggtaaaaccgtaccccctaaaacgttacccgtaggtaactaccgttagtagtacgttacggccgtaacttcctaacttttacggtaaccggtaaaacggtttccggggtaaccctaacgttaaccgtaaacgggttttaccgaaggttacggtcggtaacggtaggtaacgtcggttacggggactaggtacttttacaccgttactaccgtaccgaactttaccgaagttccgaacgttcgtaccggtacctaaacccggttagttaaaggtttaacttttagggtaaccttaaacgttaaccgttaacgttacgtaacctaaccgttacgtaaacgtttactaaccggtacccgtcccggttacggttacccgtcggttaaccccggagggtaaccccgaagggttaacggtaaaccgttaaacggtaacccggtaaggtttaaccgtacgggttaacgtacccggttaaggttacccctaagttacgttacccg

SEQ ID NO: 288174 - DNA, 575 bp, Homo sapiens
  misc_feature: GYAE6OF02HOYW4.6.19.B08.1.454.CMB.1.raw
  modified_base (267)..(267): a, c, t, g, unknown or other
  misc_feature (267)..(267): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcactatttaattgtatcagagaatccgaagggaaacncccctaaactcctagactctatgatgctactcctatttgacgtaaaggtcgggtacccagtacgtaaggttcaggtcggactaggtaggatcgtgggactagtactttcactctacaccatcagctagtctcgaccaacgtgtaaacgttatttcgaaccttaacttactacttacgtaccaaacgtagtaacgttacacgttaccgtccccgttaggtaccgttaccggaccgtaacgggaccgtaagggtacgaaacgtacgaaacgtacgtacggtacggcgtacgacctaacgtagttcttacg

SEQ ID NO: 288175 - DNA, 541 bp, Homo sapiens
  misc_feature: GYAE6OF02FR71U.6.19.B08.1.454.CMB.1.raw
  modified_base (226)..(226): a, c, t, g, unknown or other
  misc_feature (226)..(226): n is a, c, g, or t
  modified_base (253)..(253): a, c, t, g, unknown or other
  misc_feature (253)..(253): n is a, c, g, or t
  modified_base (264)..(264): a, c, t, g, unknown or other
  misc_feature (264)..(264): n is a, c, g, or t
  modified_base (283)..(283): a, c, t, g, unknown or other
  misc_feature (283)..(283): n is a, c, g, or t
  modified_base (351)..(351): a, c, t, g, unknown or other
  misc_feature (351)..(351): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtagacacagagtcacctatcacttgccgggacaagtcaganctatagcactattaattgtatcagganatcagggaacnccctaaatccagatctatnatgctactcctactttgacgtaaaggtcgggtacccatacgtaaggtcaggtggacgtaggtgatcgnggactagtatttcactctacacatcagcagtctcaccaacgtagtaagttactttcacttacttactactgtaactaacagttagttaccgacgttccgcccgtcggtaccgttccggaccgacggtaacgagggtaagtaaactacgaaaccgtacgtcggtaggtcgtacgacctcgtactcttaccg

SEQ ID NO: 288176 - DNA, 612 bp, Homo sapiens
  misc_feature: GYAE6OF02F5WG1.6.19.B08.1.454.CMB.1.raw
  modified_base (280)..(280): a, c, t, g, unknown or other
  misc_feature (280)..(280): n is a, c, g, or t
  modified_base (299)..(299): a, c, t, g, unknown or other
  misc_feature (299)..(299): n is a, c, g, or t
  modified_base (371)..(371): a, c, t, g, unknown or other
  misc_feature (371)..(371): n is a, c, g, or t
  modified_base (406)..(406): a, c, t, g, unknown or other
  misc_feature (406)..(406): n is a, c, g, or t
  modified_base (412)..(412): a, c, t, g, unknown or other
  misc_feature (412)..(412): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgaccccagtcctccatccctccctgtctgctatctgtaggacacagactcaccatctacgttcggccgggtacaagtcaagacgctaattagacctaacgttaattttaaagttggtatcgaaggaanaacgtacgaacgggaaacncccctaaactcctagtatctatgatcgctatcctattgaacgtaaggtcggtaccagtacagtcaggtgacnggtgactcgtggactagtactttcactcaccactnacgacnctagttcacgtccctaagtacggtaattacttttacgaaccttaacttacttacgtactaacgtaagagttactacgtaccgtccgggttaccctagggtaccgttaccggaaccgacggggaaccgttaacgggaacggtaaaccgaaccgtaaacggtacgacggttacggtactaccgactaccgtattccgtacgg

SEQ ID NO: 288177 - DNA, 508 bp, Homo sapiens
  misc_feature: GYAE6OF02GSKMO.6.19.B08.1.454.CMB.1.raw
  modified_base (504)..(504): a, c, t, g, unknown or other
  misc_feature (504)..(504): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccaagggaaagcccctaaactcctgatctatgatgcatccactttgcaaagtgggtcccatcaagttcagtggcagtggatcgtagggacagatttcactctcaccatcagcagtctgcaactgaagtattttgactaacttactaactgtcaaacgagagttacagtcgtcccgtcggacgttcgaccgacggtaccgaaggtaggaaataccgaaacgtaacgtggtacggctagacaccactntacg

SEQ ID NO: 288178 - DNA, 611 bp, Homo sapiens
  misc_feature: GYAE6OF02F0RD7.6.19.B08.1.454.CMB.1.raw
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagacgtcaccatcacttgccggcaagtcagancattancactattaatgtatcaganatcaggaaacnccctaactcctagatctatgatgacatcctactttgactaaagtcgggtacccagtacaaggtttcagttggctagtggactcgtaggacaggtatttcctactcgtacacctagtcagactagtctacgacctaaaccgtagtaagttattttcgaaccttaaactttacctacttacgtaacctaacgtacgtaacgtttaacgtacggttacccgtacccccgtagggttacccgttacgggaacccgtaacgggtaaccgtaaggggttaaggaaaccgttaaaccgaaaccgtaacggttacggtacggtaccgtacggtaccctaaccgttacttacgttacccg

SEQ ID NO: 288179 - DNA, 693 bp, Homo sapiens
  misc_feature: GYAE6OF02GPEW5.6.19.B08.1.454.CMB.1.raw
  modified_base (257)..(257): a, c, t, g, unknown or other
  misc_feature (257)..(257): n is a, c, g, or t
  modified_base (265)..(265): a, c, t, g, unknown or other
  misc_feature (265)..(265): n is a, c, g, or t
  modified_base (308)..(308): a, c, t, g, unknown or other
  misc_feature (308)..(308): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtccaccatcacgttcgccgggctaagtcagagctatacgctaacttaatttaaagtgtancgaggaanaactccggaaggaaacctacccctaaaatcctagtactcttangactcgactacttcctactttagaactaacgggttcggtaccaagtacgtaaggttcaggtaggactagggtagtactacggagggtaactaggttactttaccacttccgtacccaccgtaatcgtaccgacttacgtccgtacgacctaacccgtaggtaaactttactttacgaacctttaaccttacttaaccgttacgtaaccgtaaactaacggttaacttaccgtacggttaccccgtacccgttaccggggttacgttacccgggaaccggtaaccgggtaaccggtaaacgggtaaaccggtaaacgtaacccgtaaaaccggttagttacgggtaacgtacggttaccgaacctaccttacgtactttaccccgg

SEQ ID NO: 288180 - DNA, 802 bp, Homo sapiens
  misc_feature: GYAE6OF02JA912.6.19.B08.1.454.CMB.1.raw
tcagatatcgcgagcacgaccggtgctcgatttagtgagtcagtaagggggagtcagtctcagtcaggacacagcatggacatgaggtccccgctcagctcctggggctcctgctactctggcctccggaggtgccagatgtgacatccagatcgaccctagtctccactccctccctgtctcgctatcgtgtaggacactagagtccaccatcacgttggcccggataacgtcaagacgctaattacgcaccttatttaaaattggtatacgaaggacgaacttaccgaaagggtaaccgtacccccttaaaaccgtccttacgtaacttaccgttagtacgtaacgtacaccttaacgtacccgttaacgttttacgaacggtaaaacgggttccggggtaccctaacgttaacggtaaacgggttttaccgtacggttacgggtacgtaacgggttaggtacgttacggtaacggggtacctaaggtttaccttttaaccgtaccgtcctttaacccgaacccagtttaccgaacgtaccgtacgttaccggtacgtacccgtaaacttacggtaaagtttaaccgttttacggaacccttaaacgtttaacccttacggttaaccgttacctaaaccggtacgtaaacgtttacccggacgttacccgtaccccggttaccggtaccggttaccggaacccggtaacgggtaaccgtaagggtaaaccgggtaaataaaccgggaaaccgttaacggaggttccggaaccttcggaacctaaccgtactacgtttacg

SEQ ID NO: 288181 - DNA, 787 bp, Homo sapiens
  misc_feature: GYAE6OF02H4NL7.6.19.B08.1.454.CMB.1.raw
  modified_base (242)..(242): a, c, t, g, unknown or other
  misc_feature (242)..(242): n is a, c, g, or t
  modified_base (608)..(608): a, c, t, g, unknown or other
  misc_feature (608)..(608): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgagtgccagatgtgacatccagatgacccagtcctccatcctcctgtctgcattcgtgtacgacacgagtacgtccaccaagtctacttcggaccggggtactaagtccgaggancctaatttacgcctaacctttaaagttttaaattcggttaactacgaggaaagtaaactaccggaaacggggtaaaaccctacccctaaaaacccgttccgttacggtaaactttaccgtaataggtactcgaccttaacgttccccttaaggtttacggtaaccgtaaacggggttcggggtaacccctagttaaccgtaaacggtttcgaagggtcggtacgtaggtacggtagttacggtacgggaacttaggttactttacaccttctaacctacctagtacgacgtacgtagttccaagtaaccgtaacgttaagtaacggtttttacttaacggacctttaacgttaaccttccgttaanaacccgttaaagaggtttaccttaaaccggccgtttccccgtaaccgggtttaccggaacccggtttccgggaaaacggaccggtaacccggtaagggttaaacaaaccggtaaacctaaaccgggttacgtacggttaccgtacggaaccctaaccggaaccttgttaccgttaaccg

SEQ ID NO: 288182 - DNA, 694 bp, Homo sapiens
  misc_feature: GYAE6OF02H932V.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtccaccatcacttgccgggacaagtcagagcattagctaccttaatttaaattggtatacaaggagaataccgaagggaaacgacccctaaacctcctagactctaatgatgctactcctactttgacgtaaagggtcgggtaccctaagtaccgtaaaggtttacgaggttacgggacgtaagggtcggtacgttacgtacggggtacctaggttaactttttacccgacctttacctaccctaaaccctacttacccgaaggtacctaacggttccgtaacggacctaaaacccgttaggtaaagtttactttttacgaacctttaaacgtttacctaaccgttacgtaacctaaaccgtagtaacgtttaacgacgttccgtaccccgttacgggtaccgttccgggaccgtaacgggaccgtaaagggtaacggtaaacaaccgtaaacgtaaccgttaggttcggacttacgaccgtacctacgttccttacg

SEQ ID NO: 288183 - DNA, 570 bp, Homo sapiens
  misc_feature: GYAE6OF02F9B38.6.19.B08.1.454.CMB.1.raw
  modified_base (260)..(260): a, c, t, g, unknown or other
  misc_feature (260)..(260): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttggccgggcaagtcagagcattagctaccttatttaaattggtatcgagganatccgaagggaacacccctaaactcctagtactctatgatgcacttcctactttgactaagggtcgggtacccatacgtaaggttcagtggcaggtagatcgtggactagtattcactctacacctatcagtcagtctacgaccaacgtagtaattatttacgactaacttactactacgtacaaacgtgttaacgtacgtacgtaccgtccccgtaggtaccgttccggaccgtaacgggtaccgaagggtacgtaaactaaccgaaacgtacgtaggttacgacgtcgaccgtaccgtagtacttccg

SEQ ID NO: 288184 - DNA, 563 bp, Homo sapiens
  misc_feature: GYAE6OF02JJ7KU.6.19.B08.1.454.CMB.1.raw
  modified_base (451)..(451): a, c, t, g, unknown or other
  misc_feature (451)..(451): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctcctgtctgcatctgtaggacacagacgtcaccatcacttcggccgggacaagtcagagctattagctaaccttaatttaaattggtatcgaaggagtaactccgaagggaaacctaccccttaaactcctagactctatagatgcatcctacttagacgtaaggtcggtaccatcgtaaggttcagtgacgagtgactcgtaggatagtacttcactctacactatcagactacgtctacgacctaacgtagtaacgttatttacgactaacttactactanacaatacgtatacgagtccgccgtacgtacgtacgaccgacggaccgaagggtaacgtaaactaaccgtaaacgtacgtacggtacgacgtacgacctacgtacttcgtacg

SEQ ID NO: 288185 - DNA, 572 bp, Homo sapiens
  misc_feature: GYAE6OF02HBOKX.6.19.B08.1.454.CMB.1.raw
  modified_base (253)..(253): a, c, t, g, unknown or other
  misc_feature (253)..(253): n is a, c, g, or t
  modified_base (262)..(262): a, c, t, g, unknown or other
  misc_feature (262)..(262): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttggccggcaagtcagagcattagcacctatttaaatggtatcaganatcaggaanccctaaactctgatctatgatgcatcctatttcgacgtaaaagtcggggtaccatacaaggttcaagtgacgagtaggatgtagggacagtagtttacacctctacacgactacacgcaagtctacgtaccaactagtaagtattttacgactaacttaacctactagtaacctaagaacgtattaaccgtacgtaccgccccgtacggtaccggttaccgaccggtaacggaccgtaaagggtaacggaaacgttaaacgaaaccgtaacgtagtacggtccgtacgtccggaacctacgtcgttaacg

SEQ ID NO: 288186 - DNA, 797 bp, Homo sapiens
  misc_feature: GYAE6OF02IT719.6.19.B08.1.454.CMB.1.raw
  modified_base (220)..(220): a, c, t, g, unknown or other
  misc_feature (220)..(220): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtcctcatccctcctgtctgctatctgtaggacacagatcacctatcacgttcggaccgganaacggtcagagcaattacgcctaactttaatttaagttaggtactacgaggaagtaacgtaccgaagggtaaacccgtacccttaaaaccgtccgttacgtaacttccttaagttacgtacgttacgaccgttaaccgttacccttaacgtttaacggaacgttaaacggggttaccgggtaaccccggtaagttaacccgggtaacggttttaccggaacgggttacgggacggttaagggtacggttaacgtcgggtaacgggtaaccgttaaggttaccttttaaccgacttacccgttaaccaccgtaacgtccgaacgtacgtacgtacgtacgacccgtaacgtaggtaaactttacgttacctaccgttaaactttccgtaattaccgtaaccgtaaacgtaacgggtttacttaaaccggtacgtaacccggtttaccccggtaaccggttaacccgggttaccgggaaaccggtaaccgggtaacggtaaacgggttaaacgtaaacgtaaccggtaaacgtaacggttcgacggtaccttacgaacccgtacttagtcccgttacgg

SEQ ID NO: 288187 - DNA, 801 bp, Homo sapiens
  misc_feature: GYAE6OF02GBC9I.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtcctccatccctccctgtctgcatctgtacggacacagatcaccatcacttcggaccgggcaagtcaagagctattagcctaaccttaattttaaagttggtaatacgaaggaagtaactaccggaagggaaaccgtaccccctaaactccgtagacttactaatggatcgacctacttaccctaacgtttacgaccgtaaaggttccggggtaccctaacgttacgtaaacggtttcgaaggttcgggacgtagggtacggtaacgttcggtacggggtactaacggtttactttacctaccgttacccttaccgaacctaacgttaccaacgggtccttacggttaccttacggaaacccttaaaccgttaacggtaaacgttttacgttttaacggtacccttaaacgtttacctttaaccgtacgttaaacaaacgttacgttaacgtttaacgtaccggttacccgtacccccggtttacgggttacccgttacccgggaacccggtaaccggggtaaccgtaaacgggggttaaacggaaaacccgttaaacccggtaaaaacggttaacccggttgggtttaaccgggccgttaaaccggtacccgtaacccgtttacgttccgttttaacccgg

SEQ ID NO: 288188 - DNA, 944 bp, Homo sapiens
  misc_feature: GYAE6OF02IP6KI.6.19.B08.1.454.CMB.1.raw
  modified_base (94)..(94): a, c, t, g, unknown or other
  misc_feature (94)..(94): n is a, c, g, or t
tcagatatcgcgagcacgaccggtgctcgatttagtgagtcagtaagggggagtcagtctcagtcaggacacagcatggacatgaggtccccgntcagctcctggggctcctgctactctggctccgaggtgccagatgtgacatccagatcgacccagtctccatccctccctgtctgcatctgtagacacagagtccaccatccacttggcccgggacaagtcagagcaagttagacctaaccttattttaaaacgttggtaatcgaaggacgtaaacgtccgaaagggaaaccgtcccccttaaaacgttccttaggtacttaccgtagtacggtaattcggactaaccttccccgtaagtttacgaaccgtaaacgggttccggggtaccctagttaaccgtaaacggttttcgaaggttcgggtacgtacgggttacgggtaaactttccgggtaaggggtaaccgttaggttaccgtttttaccgaacccgttttacccgtaccccgaaaaaccgttacgtacccggtaaacggtcccgttaaacggtttcccggttaaaccggaaccccgttaaaaccggttttaagggttaaaaaccggtttttaacgtttttaaacccgggtaacccttttaaaaacccgttttttacccgtaaaccgtttaaccggttaaaccgtaaaaccggttacggtttaaaccggtttaaaccgttaaccggggttttaaccccgttacccccccggggtaaacgggtttaaaccccgggtttacccggggtaaacccggttaaacccggggggtaaacccggttaaacggggttaaccggtaaaaaaacccggtttacccggtaaaaaacccggttaacggtttaccgggttacgggtaaccctttaccggaaccccgtaaaccgtttaccgttaccggttttaacccg

SEQ ID NO: 288189 - DNA, 649 bp, Homo sapiens
  misc_feature: GYAE6OF02HDAZZ.6.19.B08.1.454.CMB.1.raw
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (263)..(263): a, c, t, g, unknown or other
  misc_feature (263)..(263): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtcctccatccctccctgtctgctatctgtagacacagagtccaccatcacttggccggnaagtcaagngctattagctacttaatttaaatggtatcgagganaatccgaaggaacacccctaaactcctagtatactatgtatcgactactcctaattcgaactaacggttcgggtacctagtacgtaacggttcgagtggctaggtcggatcggtaggactagttactttccgtactacctaccaacctatacgaacgacgtacgttaccgtacgaacctaaccgtaggttaaacgttacttttacgaaccgtttaaactttaccgtaacttacgttaaccaaacgttaacgttaacgttaacgtacgttacccgtccccggttaaccggttaccggttaccggaaccggaacgggtaaccgtaagggtaacgtaactaacgaaaccgtacgtaggtacgtaccgactaccgtactacgtcgttacc

SEQ ID NO: 288190 - DNA, 702 bp, Homo sapiens
  misc_feature: GYAE6OF02JAJYL.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccggaggtgccagatgtagacatccagatagacccagtcctccatccctcctgtctcgcatcgtgtagacacgagacgtcaaccatccacgttcggaccgggacaacggtaccaggagactaattaacgaccttaacctttaaattttaaagttggttaactacgaaggaacgtaaacgtaccggaaacgggaaaacctaccccgtaaaccttccgtaggtacttacttacgtactgtacgcctaactaccttacttacgtaacggtaaacggttccgggtacctacgttaacgtaacggttacgtaacggtaggctaacgggtacgacgttcggttacggaacgtacggttactttacctaccgtaccgtaaccctaaccgtactaccgaactcgtaccgtacgtacgtaacctacgttaaggtattacgtttacgaccttaacgttacctagtaacgtaaccgaacgtacgtacgtactacgtccgtacccggtcggttaccggtccgaaccggtaggaacgtaaggtaacgtaactacgaagttacgacgtgtcacgtacgtaactcgttcttcg

SEQ ID NO: 288191 - DNA, 741 bp, Homo sapiens
  misc_feature: GYAE6OF02FUM6F.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtagacatccagatcgacccagtctccatcctccctgtctagcctatcgtggtaggacacagtacgtccaacctatcctaacgtttcggacccggggacaaacggttccaagggacgacttaacttacggaccttaaacctttaattttaaaagttcggttaacttccgaagggaacgtaaacttaccggaaacggggtaaaaccgtaccccctttaaaacgtcccgttaggaacttaccttaagtacgacgttaggaccctacgttacccttacgttttacgaaccggttaaacgggttccggggtacccctaagttaacggtaacggtttacgaggttacggtactagggtcgggtactacgggtacgggactagtctttacgcttacctacactactacgactacgagtacctagaaccgaacgttgtaacgtttatttacgaacttaaaccttcttacgtaacgtactaacgacgttaacgttaccgacgttccgtccccgtagggtaccgtaccgaaccggtaacggaacggtaggtacggtaaacctacgaacggttacgtcggacgtccgttaaccgccacttacgtcgttaccg

SEQ ID NO: 288192 - DNA, 647 bp, Homo sapiens
  misc_feature: GYAE6OF02GKA5G.6.19.B08.1.454.CMB.1.raw
  modified_base (95)..(95): a, c, t, g, unknown or other
  misc_feature (95)..(95): n is a, c, g, or t
tcagatatcgcgagcacgaccggtgctcgatttagtgagtcagtaagggggagtcagtctcagtcaggacacagcatggacatgagggtccccgntcagctcctggggctcctgctactctggctccgaggtgccagatgtgacatccagatgacccagtctccatccctccctgtctgcatctgtaggacacagagtcaccatcacgttgaccggtacaagtcagagcaattagacaaccgttatttaaaagttggtatacgaaggagaatccgaagggtaaacacccgttaaaactcctagtactactatacgatcgctactccctatttacgacgtaaaggtcgggtaccatacgtaagttacgtagtacggactaaggtggaattcgtagggacagttactttacacgtttctaccaaccgtatcgaagtacgacgtactacgacctaaaccgttagtaacgttactttacgaactaaacgttactacgttagtacaacgtagtacgttacgacgttaccggccccgtacggtaacgttacccggaccggaaaggtacccgaaagggttacggaaaacttaaccgaaaaccggtacgttaggtaacggtcgtaacggaccctaacgttacgtacccgttacgg

SEQ ID NO: 288193 - DNA, 564 bp, Homo sapiens
  misc_feature: GYAE6OF02FV6DM.6.19.B08.1.454.CMB.1.raw
  modified_base (215)..(215): a, c, t, g, unknown or other
  misc_feature (215)..(215): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatccctccctgtctgcatctgtaggacacagagtcaccatcacttgccgggnaagtcagagctagttagcctaccttaatttaaattgtatcaggagaatccgaggaacaccctaactcctagatctatgatcgctactcctactttcgacgtaaaggtcgggtaccagtacgtaaggttcagttggcaggtggaatcgagggacagtatttcgactctccactacncgancgacttccgtacaccgtaaccgttagtaaacgttagttttacaacctaacttaacctactacgtacaactaagtactaagtacgtccgccctacggtacgtccgacgacggacaggtaacgaacttacgaaacgtaacgtggtacgccgtagaccaccgtctacttaccg

SEQ ID NO: 288194 - DNA, 546 bp, Homo sapiens
  misc_feature: GYAE6OF02GQ2E9.6.19.B08.1.454.CMB.1.raw
  modified_base (387)..(387): a, c, t, g, unknown or other
  misc_feature (387)..(387): n is a, c, g, or t
  modified_base (430)..(430): a, c, t, g, unknown or other
  misc_feature (430)..(430): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcacctatttaaattgtatcaggagaatccaaggaaacgcccctaaactcctagatctatgatgcatccactttgactaaaggtcgggtcccatcgtaaggttcagtggactaggtggatcgtaggactagtatttcactctacacatcagcagtcngacacctgaagtactttgacctaacttactacgtagtaccaanagtacttacagttccgaccccgttcggaccgttaccgacgtaacgggaccgtaaacgggtacggaaacttacggaaaacgttaacgtgtacggcttacgaccaccgtataccttcg

SEQ ID NO: 288195 - DNA, 653 bp, Homo sapiens
  misc_feature: GYAE6OF02HWCU7.6.19.B08.1.454.CMB.1.raw
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtcctccactccctccctgtctgcatctgtaggacacagagtcaccatcacttgccggcaagtcagagcattacgctaacttaatttaaatggtaancgaggaanaactccgaagggaaactcccctaaactcctgtactactatgatcgactattccctacgtttggactaaagggtcgggtacctatacgtaagttcagtgactagtaggatcgtaggactagtactttcgactctaccacctactacacgctacgtctagacctaaccgtaagtaaacgtttatttacgtaacctaactttacctaacttagtaacctaaacgtagtaacgtttacgaacggtcccgtacccccggttacggtaaccggtttaccgggaacccggaacgggtaaccggtaaagggtaacggttaaaaccgtaaccggtaaaaccggtacgttaacgggtaccgggtacgtaccgtaaacctaccgtaccgttacgttaccgg

SEQ ID NO: 288196 - DNA, 799 bp, Homo sapiens
  misc_feature: GYAE6OF02IK2KB.6.19.B08.1.454.CMB.1.raw
  modified_base (272)..(272): a, c, t, g, unknown or other
  misc_feature (272)..(272): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatcgacccagtcctccatccctccctgtctgctatctagtaggacacagacgtcaacctatccacgttcggccggacaagtcagcgcaattacgactaacgttaattttaaagttggttanacgaggtaagaaacgtaccgtaacggggaaaacctaaccccgttaaacgtccgtacgtaacttacctaagttacgtaactccgtaacgtacctttaacccgtaacgttttacgaaacgggttaaacggggtccgggttaaccctaaggttaaccgggttaaacgggtttccgaaggttacgggtaacgtagggttaacggtaacgtacgggttaacggtaacgtacgttaaccttttaccgaacctttccaaccgtaacctgtaaccgaagtacgttaccgtacgttaacgaccgtaaacgttacggaaagtttttacgttaaccgtaaccttaaacgtttaactaccggtaacgtaacctaaagtacgggtaaacttaccggtaaccgtccccgttaaccggttaccgggttaaccgtttacggaaccggttaaacgggacggttaacgggtaacgtaaaacgttaccggtaaaccgtagtagggtaccgtacgaccgtaccgtaacccgttattacccggttacg

SEQ ID NO: 288197 - DNA, 732 bp, Homo sapiens
  misc_feature: GYAE6OF02HVD27.6.19.B08.1.454.CMB.1.raw
  modified_base (203)..(203): a, c, t, g, unknown or other
  misc_feature (203)..(203): n is a, c, g, or t
  modified_base (429)..(429): a, c, t, g, unknown or other
  misc_feature (429)..(429): n is a, c, g, or t
tcagatatcgcgagcacgaccggtgctcgatttagtgagtcagtaagggggagtcagtctcagtcaggacacgaggcatggacatgacgggtccccgctcagctcctgggggcctcctgcgtactcgtggctccgaggtgccagatgtgacatccagatcgaccgagtctccacgtccctcctgtctgcattctggtagacanagacgtcaaccatcacttcggccgggactaagtcaaggagactaagttagacctaaccttaattttaaaacgttggtaatacgtaggaagtaacgtacccgaagggtaaaaccgaccccctaaacgttacctagtaactacttagtagtactcgacctaactcccttaactttcgaacgtaaacgggtccggggtacctacgtacgtaacggtttctaggttcggngtaaggtaggtactagggttcgggaacctaggttaaccttttacgacccttaccctacacccgtaagttacgacgactacggttacgtaccggtactaaccgttaagaaacgttttatttaaccgtacgttaaccctttaaggtaccttacgtaacaaacgttacgtacttttaacggacgttcccgtcccggtacggtaaccgttccgggaaccggtaaccgggtacgtaacggtaacgggtaaactaacggtaaaccggtaacgtcgggttagacgtccgaacgtacttaccgtcgtttac

SEQ ID NO: 288198 - DNA, 646 bp, Homo sapiens
  misc_feature: GYAE6OF02JPEJ5.6.19.B08.1.454.CMB.1.raw
  modified_base (203)..(203): a, c, t, g, unknown or other
  misc_feature (203)..(203): n is a, c, g, or t
  modified_base (224)..(224): a, c, t, g, unknown or other
  misc_feature (224)..(224): n is a, c, g, or t
  modified_base (252)..(252): a, c, t, g, unknown or other
  misc_feature (252)..(252): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
  modified_base (370)..(370): a, c, t, g, unknown or other
  misc_feature (370)..(370): n is a, c, g, or t
tcagatatcgcgagcacgaccggtgctcgatttagtgagtcagtaaggggaggtcgagtctcagtcaggacacagcatggacatgagggtccccgctcagctcctgggctcctgctactctgctccgaggtgccagatgtgacatccagatgacccagtctccatccgtccctgtctgactatctgtaggacacagagtcacntcactcggcggctagtcaggncattagctactattaacttgtatcgagnagtacgaggaacaccctaacgtcctgactctatnagtnctataccgtacttgactaacggtcggtacctagtacgtaacgttcacggtacgtcgtaggtcgtaacgtcgtacgggtanaacggttcttacgtaccgttcctactaacccgtacttaccgacgtactaaccgtcgtacttaccgacgttacggtaaacttagtttaaccgctaacgtttactacgtaccgttcaaaccgtgttaaacgtccgtacggtccacccggttaccggtactacccggtacgtaccgggtaaacggtaccgttaaaggggtaaaccaaccggttaaacgaaacccggtttcggacggtaaaccgttcccgacccgtaaacgttccgtttaccccggtaag

SEQ ID NO: 288199 - DNA, 628 bp, Homo sapiens
  misc_feature: GYAE6OF02HAHHH.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtcaccatcacttgccgggcaagtcagagcattagcaccttatttaaattggtatcaggagaatccgagggaaacgcccctaaactcctagatctatgatgcatccactttgaactaaaggtcgggtacccagtacgtaaggttcacggtggacaggtcggtatcgtagggactagtactttcacctctacacctactacacgctagtctacgaccaaaccgttggtaaagttactttttacgaccttaaaccttaccttaacttacgtacctaaacgtagtaacgttacgtacgttccgtcccccgtacggtacccggttcccgggaaccgtaacggggaacccggtaagggtaacggaaaccgttaaccgtaaaaccggtaaccgttaggtacgggtacctacggacctaacccgtacttaccgttccgg

SEQ ID NO: 288200 - DNA, 714 bp, Homo sapiens
  misc_feature: GYAE6OF02I5IS6.6.19.B08.1.454.CMB.1.raw
  modified_base (303)..(303): a, c, t, g, unknown or other
  misc_feature (303)..(303): n is a, c, g, or t
tcagatatcgcgagcacgaccggtgctcgatttagtgagtcagtaagggggagtcagtctcagtcaggacacagcatggacatgagggtccccgctcagctcgtgggctcctgctactctggctccgaggtcgccagatgtgacatccagatcgacccagttcctaccacttccctcctgtctgctattcgtagtacgaaccacgagtacgtaccacctatcctacgttcgggcccgggtactaagtacgagtagtacctagtacgacctaactttaattaaacgttgtaactacgaaggtanaacgtaccgaacgggaacctaccctaactcgtagtactactatagtatcgactacgtacctttaacgttacgtaacgtaaccgggttccggtacctaacgtaacgtaacggttacggtacggtacggacgtacggtaggtacgtacgggtacggaacgttacgtactttaccctacgttaccctactaacctactacgacgtactacgttacagtaaccgtaacgtagttaacgtttagttccaactttaacctactacggtactaactaacgtacgttacgtacggtccgtaccgtccgggttaccggtacggtaccgaaccgggacggtaacggtaacggtaacgaaaccgttaacggaaacgttacgtaggtaacggtactaccggtacctacgttactaccgttccg

SEQ ID NO: 288201 - DNA, 742 bp, Homo sapiens
  misc_feature: GYAE6OF02GHNQJ.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtgggctcctgctactctggctccgaggtgccagatgtgacatccagatgacccagtcctccatccctccctgtctgctatcgtgtaggacacgagacgtccacctatccacgttcggccggacaagtcaagagacgtattacgactaaccttaatttaaacgttggtaacttacgaaggtaacgtaacgtaccggaacgggtaaaacctaccccgttaaaactccgttagaacttaccgtaagtggtactcggtacctacgttacccgttaacgtttacggaaccggtaaacggttccggggtaccctaagtaccgtaacgggttacgtaacggtcggtacgtaggtacggacgttcgggtacgggtaacgtaagttacgtttacctaccgttacctaccaacccgtatacgaacgtaccgtacgtccgtacgaccgtaaacgtagttaaacgttctttaacgaaccttaacgttactaaccgttacgtaaccgaagttacgtaacgtaacgtacgttacccgacccgttacggaccgttaccgggaaccgtaacgggaccggttaaaggtaaccgtaaacgtacgtaaaacggttcgttacggtacggtacgtacgccgtaactacgttacgttacg

SEQ ID NO: 288202 - DNA, 606 bp, Homo sapiens
  misc_feature: GYAE6OF02GVZT8.6.19.B08.1.454.CMB.1.raw
  modified_base (213)..(213): a, c, t, g, unknown or other
  misc_feature (213)..(213): n is a, c, g, or t
  modified_base (248)..(248): a, c, t, g, unknown or other
  misc_feature (248)..(248): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctcatcctcctgtctgcatctgtagacacagatcaccatcacgttgccggganaagtcagagcatagcactattaattgtatcagganaatccgaaggaaacgtaccctaaactcctagactactatgatcgactactcctatttcgacgtaaacggtcggggtaccctaagtaccgtaaagggttctaggttacggacgtaggtcggtaagtccggtacggggaacgtaggtactttacacttacctaccaactactaccgagtacgtacgtcgtacgacctaaccgtaagtaaacgttattttacgacttaaacttactacgtcgtaactaagacgtagtacgtacgtaccgtcccgtcgtaaccgttccgaccgacggaccgtaagggtaacgaaacgtacgtaaacgacggttgtacggtcctagtaccacgtactactccg

SEQ ID NO: 288203 - DNA, 716 bp, Homo sapiens
  misc_feature: GYAE6OF02H2ZH4.6.19.B08.1.454.CMB.1.raw
  modified_base (228)..(228): a, c, t, g, unknown or other
  misc_feature (228)..(228): n is a, c, g, or t
  modified_base (245)..(245): a, c, t, g, unknown or other
  misc_feature (245)..(245): n is a, c, g, or t
  modified_base (277)..(277): a, c, t, g, unknown or other
  misc_feature (277)..(277): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccggaggtgccagatggtgacatccagatcgaccctagtcctccatccctccctgtcctgctattctgtacggacacagactcaccatccattggaccggganaaggtcagagacattanccaacttaatttaaagtggtatacgaggtaanactacgaagggaaacctacctaactctagtatactaatgtactgactctacctacgtttagaacgttaaggccggggttaaccagtacgtaaacgggttactaggtaggacgtaggtagtacgtcgtagggaaactaggtactttaccgactttccgtacaacgtactacagtcgtaacgtctacggtacaacgtttagaaacggttttagttacgtaaccttaaacgttaaacctacgttacggtaaacctaacgtaacgtacgttaaccgtaacggttccccgggtaacccctagggttaacccggtaccgggtaacccgggtaacgggtaaaccccgggtagggttaaaccgggaaaacgttaaccggaaaacggtaaaccctttagggtacggtcccggttaaccacccgggtaattacccgttacggttaaccc

SEQ ID NO: 288204 - DNA, 741 bp, Homo sapiens
  misc_feature: GYAE6OF02JJFWP.6.19.B08.1.454.CMB.1.raw
  modified_base (733)..(733): a, c, t, g, unknown or other
  misc_feature (733)..(733): n is a, c, g, or t
tcagatatcgcgagcacgaccggtgctcgatttagtgagtcagtaagggggagtcagtctcagtcaggacacagcatggacatgagggtccccgctcagctccgtgggctcctgctactctggctcgaggtgccagatgtgacatccagatgacccagtcctccatcccgtccctgtctgacatctgtaggacacgagagtccacattctacgttggcccgggataacggtcaggacgtacaagtttacgacctaacctttaagtttaaaagttgggtaactccgaagggtacgtaaacgttccggaaacggggaaacttcccccgtaaaacttcctaggtaactccttaattcgattacgactaccgttaccgttacgtttacgaaccgtaagggtcgggtaccctaagttacggtaaaggtttccaggtacggtacgtaacggtggaaccgttggtacgggaatagttctttaccaccgttcgaacctaaccgtatacgtacgaccgtagtccggttagaacctaccgttaggtaaacgttttcgtttaaccgatttaacccggtttacaaatttccgggaacttaaccgtaagggttaacttacgttaccgggttaccgtccccggttaacgtaccgggtacggttaaccgaaccggtagggtaacccggtggtaaacctaacgggtaaaccgacgtaggttaccggtaactgggaacccgtctaccgtntttaacgg

SEQ ID NO: 288205 - DNA, 607 bp, Homo sapiens
  misc_feature: GYAE6OF02G71H0.6.19.B08.1.454.CMB.1.raw
  modified_base (95)..(95): a, c, t, g, unknown or other
  misc_feature (95)..(95): n is a, c, g, or t
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (264)..(264): a, c, t, g, unknown or other
  misc_feature (264)..(264): n is a, c, g, or t
  modified_base (280)..(280): a, c, t, g, unknown or other
  misc_feature (280)..(280): n is a, c, g, or t
tcagatatcgcgagcacgaccggtgctcgatttagtgagtcagtaagggggagtcagtctcagtcaggacacagcatggacatgagggtccccgntcagctcctggggctcctgctactctggctccgaggtgccagatgtgacatccagatgacccagtctccatccctccctgtctgcatctgtaggacacagacgtcaccatccacttggccgganagtcaggancattagctaccttaatttaaattggtatacgagganaagtccgagggaaacnccctaaactccagtactactatgatcgactactcctacgtttgacgtaacggtcgggtacctaagttcgtaacggttcaggtcggactaggtggtacgttcgtagggactagttactttcaccttctaccctacacgtcgagtcgaacgtcgtacgtaaccaaccgttagaagttactttacgaaccttaacgtttactacttcgtaacctaacgtacgtacttacgtacggtcccgtacccgtacggtacgtaccggacgacgggtacgaaggtaaccgaagtacgaacgtacgtcggtacgcgtacgacctcgtacgtcgttacg

SEQ ID NO: 288206 - DNA, 620 bp, Homo sapiens
  misc_feature: GYAE6OF02F6FKQ.6.19.B08.1.454.CMB.1.raw
  modified_base (235)..(235): a, c, t, g, unknown or other
  misc_feature (235)..(235): n is a, c, g, or t
  modified_base (262)..(262): a, c, t, g, unknown or other
  misc_feature (262)..(262): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctcgaggtgccagatgtgacatccagatgacccagtctccatccctcctgtctgcatctagtagacacagagtcaccatccacttcggccgggacaagtcagagtcaattancaacttatttaaattggtatctagganaatctaagggaactaccctaaactccgtagatacctaagtgatgcgtaactcctactttaggacgtaaaggtcgggtacctagtacgtaaggtttcaggtacggcgtaagtaggtacgttcgtagggactagtactttcacgttaccgtacacctacgtacgaacgtactacgtctagaacctaaacgtagtaaacgttatttacgaacttaacttaactacgtctaactaacgagttaacgtacacgttccgacccgtaacggtaccgtacggtaccgtaacgggtaacgtaaaggtaacgtaaacgtaaacgaaacgttaacgtaggtcgtacgtacgtacgactacgtacttacg

SEQ ID NO: 288207 - DNA, 617 bp, Homo sapiens
  misc_feature: GYAE6OF02G4LXR.6.19.B08.1.454.CMB.1.raw
  modified_base (231)..(231): a, c, t, g, unknown or other
  misc_feature (231)..(231): n is a, c, g, or t
  modified_base (461)..(461): a, c, t, g, unknown or other
  misc_feature (461)..(461): n is a, c, g, or t
  modified_base (502)..(502): a, c, t, g, unknown or other
  misc_feature (502)..(502): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtcctccatcctccctgtctgcatctaggtaggacacagagtccaccatcacgttggccgggcaagtcaagngactattacgctaaccttaatttaaacgttggtaactacgaaggtaacgaactccgaagggaaacctacccctaaactcctagtactacctatagtatgactactcccgtaatttacgacgtaaacgggttccgggtacctaacgtacgtaacggttcgagtcggacgtaggtggacgtggtacgggatagtactttacaccttactactacactcacgtctaacgttcncgacctaacgtatagttatttcaacttactacctattcganaactgtactacgtcgtaccgtacccgtcggaccgttacggaccgtacgggtaccgtaagggtaacgtaaactacgtaaaccgacgttacggtaggcttacgactactgtacttcg

SEQ ID NO: 288208 - DNA, 735 bp, Homo sapiens
  misc_feature: GYAE6OF02FI2KB.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatcgacccagtcctccactccctccctgtctgctatctagtacggacacagactccaccatacctacgttcggacccgggacaaggtcaagagactagttacgcctaacctttaattttaaacgttggtaacttaccgaaggtaacgtaactaccggaacggggtaaacctacccccgttaaaccgtccgtacgacttacctaagtgtacttcgacctacttaccctacgtttacgaccgtaaacgggtccgggtacccagttaccgtaaggtttcgtacggtggtacgtaggttacggtacgttacggtacgggtaaccgtagttacgtttaccaaccgttacctaccgaaccctaacttccgtaacgtcgttaacgtccgtaacggaaccctaacgtaggttaaacgttacttttaacgtaccttaactttaccgttacgtaccgttaacctaagtacgtaacgtttacgtacggtacccgtacccggttacggtaaccggttccgaaccggacgggaaccgtaaggtaacgaacgtaaccgaaggtacgtaggtcggtctacgtaccaccttcgtcgttaccg

SEQ ID NO: 288209 - DNA, 718 bp, Homo sapiens
  misc_feature: GYAE6OF02JTM38.6.19.B08.1.454.CMB.1.raw
  modified_base (193)..(193): a, c, t, g, unknown or other
  misc_feature (193)..(193): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctcgaggtgccagatgtgacatccagatcgacccagtcctccatccctcctgtctgcatctgtaggacanagacgtacaccatcgtacgtcggaccggacaagtcaagacgctattacgcctaaccttaatttaaagttggtatacgtagagtaactaccgaagggaaacctccctaaactccgtagactcttaagtgtatcgactacgtaccttacgttgaaccgtaaaggtcgggtacctacgtacgttaaacgggtctaaggtcggacgtaaggtcggtaacttcggtacggtaacggtagttaactttccgactttaccgacccttaacacgtacgtacgtactacgttaccgtagaacccgtacgttaagttaacttaacggttttacaaccgttaaaccctttaccgttaaccggtacgttaacctaaaccgttaaggtacgttttaaccggacgtttaaccccggacccgtttacccggggtaaccgtttaccggacccggttaacggtacgtaaacgggtaacgtaaacgtaaccgtaaacggttacgtaacggtacgttaccgacgtactaccgtactacgttccg

SEQ ID NO: 288210 - DNA, 876 bp, Homo sapiens
  misc_feature: GYAE6OF02IWAM8.6.19.B08.1.454.CMB.1.raw
  modified_base (133)..(133): a, c, t, g, unknown or other
  misc_feature (133)..(133): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtnccagatgtgacatccagatgacccagtctccatccctccctgtctgcatctgtaggacacagagtcaaccgatcctacttcggaccgggacaacggtcaagagactaattacgcctaaccttaattttaaagtttggtaacttacgaggaagtaaacgtaccaaggggaaaccgtacccccttaaaactcccttaggtacttaccttaagttacgaatcggactaacttccctaacgttttcgacgtaaaacggtcggggttaccccaagtacgtaacggtttccgaggttcggacgtaggtacggtacgtacgtgggtaaccgtagtacgttttacctacgtttaccctaccgtaaacccgtaactaccgtaacgtccgtaacggttacctacggtaacccgttaaacccgttaggttaaacgtttaccgttttttacggaaacccgtttaaaaccgttttaccgttaaccggttaggtttaaaccctaaaaccggttaacggttaaaaccggttttaacccgttacggttaacccccgggttacccccggtttacgggttaaacccgggttaaccccggggtaaccgggtaacccggggtaaacccggttaaacggggggtttaacgggtaaaacccgttaaccggttaaaaacccgggaaacccgggttttacggtaacgggtaacccggttaccgggttaaccccttaacccgtaaccggtttccccgggttttaaccg

SEQ ID NO: 288211 - DNA, 720 bp, Homo sapiens
  misc_feature: GYAE6OF02I3INK.6.19.B08.1.454.CMB.1.raw
  modified_base (329)..(329): a, c, t, g, unknown or other
  misc_feature (329)..(329): n is a, c, g, or t
tcagatatcgcgagcacgaccggtgctcgatttagtgagtcagtaagggggagtcagtctcagtcaggacacagcatggacatgagggtcccgctcagctcctggggctcctgctactctggctccgaggtgccagatgtgacatccagatgacccagtctccatcctccctgtctgcatctgtagacacagatcacctatctacgttcggccgggcaaggtcagagctaattagcctaaccttaatttaaaagttcggtaattacaagggtaacgaaataccgaacggggaaactacccccttaaaactccctagtaacttctaagtnaatcgactactaccctaacgttttgaacgtaaacggtcggggtaaccctaatacggtaaggttaccgtaggtcggactacggtaggaactcgggttaggggaactaagttacgtttacctaacgtaccttaaccaacccgtaacttacgacgtacgtaaacgtttccgagaacccgtaacgttaacggttaaaagtttaccttttaacgaaccgtttaaacttaaacgttaacccttggttaaccctaaaacgtacgggttaaacttaagtaccggttaccggtaccccgtaacggttaccgtacccgggtaaccaacggggtaacgaacggttaaaggaactaactaaaacgtacgttgtcggacgtcaccgtaactacgtagtttaccg

SEQ ID NO: 288212 - DNA, 725 bp, Homo sapiens
  misc_feature: GYAE6OF02GIVQX.6.19.B08.1.454.CMB.1.raw
  modified_base (540)..(540): a, c, t, g, unknown or other
  misc_feature (540)..(540): n is a, c, g, or t
  modified_base (707)..(707): a, c, t, g, unknown or other
  misc_feature (707)..(707): n is a, c, g, or t
  modified_base (719)..(719): a, c, t, g, unknown or other
  misc_feature (719)..(719): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccggaggtgccagatgtgacatccagatcgacccagtcctccactccctccctgtctcgctacttcgtcggtaaggacctaacgagtacgtaccaacctactacctaccgttccgggacccgggaactaacggtccgaaggacgtacttaacttacgaccttaacctttaaattttaaacgttaggttaactacgtaagggaagtaaaccgtaccggaacggggtaaaccctaacccccttaaacgtccgtaagtactacttagtacgagtcacctactaccgttactttacggaacgtaacggggttccgggtaccctaagtaccgtaagtttcgtaggtcggtactagggttcgacgttcggtacggacggtatttactttccgaccttcgtacccactacgtacaccggtntacgtcctagaacccgtacgtaagttaacggtttactttacgaaccttaacttaccgtacttacgtaacaacgtacggttactacgtaaccggtctaaccccggtgtaacccggtaccggacgtacgggacctaagggacgtaacgtaacgaacgtgtacgcgtacncgacctgtactnttaccg

SEQ ID NO: 288213 - DNA, 733 bp, Homo sapiens
  misc_feature: GYAE6OF02GCGRP.6.19.B08.1.454.CMB.1.raw
tcagatatcgcgagcacgaccggtgctcgatttagtgagtcagtaaggggggagtcagtctcagtcaggacacagcatggacatgagggtccccgctcagctccgtggggctcctgctactctggctccggaggtgccagatgtgacatccagatcgacccagtcctccatccctcctgtctgcatctgtaagacacgagacgtaccacatctacgttcggccgggacaaggtcaagaagtctaattagactaaccttaatttaaagttaggtaatacgaaggaagaactaccgaaggaaacgtacccctaaactccgtagactactatagatcgtactacgtacctacgttacgaacgtaaaggtccgggtaccctactacgtaacggtttacgtaggtacggagtaggtacggtatacgttacgggaactaggtactttaacgacgttacctaccgtaaccactacgtacgtacgtacgtcgtacgtaaccctaacgttaagtaacgttaagttttaccgaaccttaaacttaccttaacgttacgtaaacgtaacgttaacggtacgttaaaccgtacggttacccgtaccccggttaccgggtaaccggtacccgggtaacggtaaccgggtaaccggtaacggggtaacggtaaaccgttaaaccggtaaaccggtaaccggttaggtaccggtactaccggtaaccctaccgttacgtaccgttacg

SEQ ID NO: 288214 - DNA, 760 bp, Homo sapiens
  misc_feature: GYAE6OF02HTGEH.6.19.B08.1.454.CMB.1.raw
  modified_base (657)..(657): a, c, t, g, unknown or other
  misc_feature (657)..(657): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgactatccaagatgacccagtcctccatccctccctgtctgctatctaggtacggacacgtagacgtacacctatctaaccttggcccggggataacggtccaaggacgctaagtttacgacctaacctttaatttaaaaagttcgggttaactacgaagggaacgtaaacgttccggaaacggggtaaaccctacccccttaaaacgttcccgtaggtaactacgttacgttagaacttcggacctattacccgttaactttcggaacgtaaccgggtacggggtaccctaagtacgtaaacgggtttcacgggtacgtacggtaacgttcggtaagttccgggtacgggtaacgtagggtttaacctttttacccaccgtttaccgtacccctaaccttacgttacgaaccgtacctacggtttaaccgtgtaacccctaaacgttaggtaaacgttttacgtttacgtaacttaacctttaccttacgttacgtaacaacgtagtacgttacngttacccgccgttacggccgttaccggacgtacggtacggtaaggtaccggtaaactaacaacgtaacggtgtacggtctaccggacaaccgttctgttaccg

SEQ ID NO: 288215 - DNA, 870 bp, Homo sapiens
  misc_feature: GYAE6OF02JFCJX.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtcgccagatgtgactactccagataccgaccagtcctcctatccccgtaccgttgtctcgacctatccttaggtacggacaacgaggtactaccacctatacctacgttcggccccgggtaataacgtccgaacggagtacctaagtttacggtacctaaaccctttaaatttttaaaggttagggttaaattccggaaaagggaaccggtaaaacggtttaaccccgaaggggggtaaaaaaccccgtccccttaaaaccgtttacccgtacgtaacttaccgttaagtacgtaactcggaccctaacgttcccctaaagttttcggaaccgttaaagggttcccgggtaaccctattaccggtaaacggggtttccaaggtttacgggactaaacggggttggacccggtttaagggacccggggtaacttaacggttaccttttccaaccggtttacccaccttaccaaccgttaccgtacggacctaacggtccgttaacgaacccgtacgttaacggttatttaaccgtttataaccgttaacgtttactaaccggttacaccgttaaactaggttaacttaccggttacgcccgtttacccggccgttaaaccgggtcggtaacccgtaacggggtaaccgtaaaccgggtaacggtaaaccctaacggtaaaacggttaccggtaccgtttaggaccggttacgaccccggtaagtacccgttagttccccg

SEQ ID NO: 288216 - DNA, 675 bp, Homo sapiens
  misc_feature: GYAE6OF02GLCP5.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtagacacagagtcaccatctacttcggccgggtacaagtcagagctagttagctaaccttaatttaaattggttaatacgaggagaactaccgaagggaaaacgcccctaaaactccgtagatcctatagatcgactactcctaacgtttgacgtaaaaggtcgggtaccctagtaccgtaaggttcgagtgggtactaggtacggatccgtaggtacgtacgtaacttttacgtaccttcctaaccgtacctactcaacggtactacgtacgtccgaaccgtaaccgttaagtaactttagtttacgacccttaaacgtttacctacttagtaccgaacttagtaacgttacgtaacggtcccgtacccgtaccgggtaccgttaccgggtacccgaagggtaaccgtaacggtaacggtaaaacgtaacccggtaaacgaacgttacggaggtaccgtaccgtaacccaccgttacttaccgttaccg

SEQ ID NO: 288217 - DNA, 788 bp, Homo sapiens
  misc_feature: GYAE6OF02HFCL7.6.19.B08.1.454.CMB.1.raw
  modified_base (203)..(203): a, c, t, g, unknown or other
  misc_feature (203)..(203): n is a, c, g, or t
tcagatatcgcgagcacgaccggtgctcgatttagtgagtcagtaaggggggagtcagtctcagtcaggacacagcatggacatgacgggtccccgctcagctccgtggggctcctgctactcgtgggcctccggagggtcgccagatggtgacactccagtatccgacccagtcctccactcccctccctgtctgcacttcnggtaaggaccagaggactccaacctatcctacgttcgggcccgggactaacgtcgagacgtactagttacgacctaactttaagttttaaacgttggtaatcggaagggtaaacgtaacgtaaccggaaacggggtaaaacccctaccccttaaacgttccgttagtaaccttaccgttaatcggtactcgtacctactttacccttaggtttacggaacggtaacgggtccgggtacctacgttacggtaacgtttacggacggttaggtcggtaacggtacgggtacggttaccgggtacgggtaaaccgttacgtttaacctttaccgtaacgttcccctaaccgtaacccttagtacccggaacgtacgttaccggtcctaacccggtaacaaaccggtttaagttacgtttacgttaacgtaaccttaactttacggtaccgttactaataaccggttaagtacctaccgtacggtacccgtacccgtccgtaacgggttaccggaaccgggtacgaacggttaaccggtaagtaaccgactaaacgggtgtacggtcgaccgtcacgtacttcgtgtac

SEQ ID NO: 288218 - DNA, 614 bp, Homo sapiens
  misc_feature: GYAE6OF02JIXUL.6.19.B08.1.454.CMB.1.raw
  modified_base (195)..(195): a, c, t, g, unknown or other
  misc_feature (195)..(195): n is a, c, g, or t
  modified_base (260)..(260): a, c, t, g, unknown or other
  misc_feature (260)..(260): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatggtgacatccagatgacccagtcctccatcctccctgtctgcatctgtaggacacngagtccaccatcacgttggccggcaagtcagagctatagctaactatttaaatggtatacgaganaactcgaagggtaaacgcccctaaagtccagtactctatgactcgactactcctacttagaacgtaacgggttcggtaccatacgtaaacgttcgaaggtcggacgtaggtaggtacgtacgtacgggtaaccgagttacgtttacaccttaccgtaccaacccgtatccgaacttacggtacgtacgtacgacctaaccgtagtaacgtttaacttcgaacgttaacttaccgtacttacgaacgttaacagttaacgtctaaggtccttacccgtggtaccgtacgaccggtaagaccgtaaggtacgaaactagaaaccgtacgtgacggctacgaccacgttcgtctacg

SEQ ID NO: 288219 - DNA, 810 bp, Homo sapiens
  misc_feature: GYAE6OF02F37TD.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtcctccacttccctccctgtctgcattctgtaggacacagacgtccaccatcacgttcgggccgggacaagtcaagacgactattacgacctaacctttaattttaaaacgttggtaactacgaagggaagtaacgtaccgaacggggaaaccctaccccttaaaaccgtcctaggtacttactagtacgtacttcgacctaacgttcccttaacgttacgaaccggttaaacggggtcccggggtaacccttaacggttaacccggtaaaggtttcggtaacggttagggtcgtaaggggtttacggacgttacggtaacggggtaaccgtaagtttaccgttttaccaaccgtttccctaaccgtaacctaccttaccgtacgtaccgttacgttaccgacgtaaacccgtacggtaacgtttaacgttacgtttttaccgaaaccttaaccctttaaccgttaattaccggttaacctaacgtaggtttaaaccgttccggtaacgtttccccggacccgtttacgggtaccgtaccgggaaccgtaaccgggtacggtaacgggaaccttaaacccggtaacggtaaacccgaaggtttccgggtacgtacccggtaacgccgtaacccgttgtacgtttacccgg

SEQ ID NO: 288220 - DNA, 681 bp, Homo sapiens
  misc_feature: GYAE6OF02GDSHY.6.19.B08.1.454.CMB.1.raw
  modified_base (673)..(673): a, c, t, g, unknown or other
  misc_feature (673)..(673): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtctccatcctccctgtctgcatctgtaggacacagaacgtccacctatcctacgttcggaccgggactaaggtcaaggacgacctaattacgacctaaccgtttaaattttaaacgttggtaatacgaaggagtaactaccggaagggaaacctacccctaaacttccgtagacttactaagtgtaatcgactacttacccgtacgtttacgaacgtaaagggttccgggtaccctaagttacgtaacggtttacgacgggttacgacgtaggtacgggtacttcggtaagggtaactagtttactttaccgaacttccgtaccctaaccgtactacgtaactcgaagttcctaacgtaactaaccgttagttaagttactttacgaccttaaacgttactacgttacgactaaacgcgttaagttacgactccgtacccgtagtacgtccgaaccggagtaaccgtaaggaccgtaacaacgtaacgtacgtgacgtacgtgaccacgttanccttacgg

SEQ ID NO: 288221 - DNA, 720 bp, Homo sapiens
  misc_feature: GYAE6OF02GOSN3.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtccaccatcacttggccggcaagtcagagctattacgctaccttaatttaaattggtaatcgaggagaatccgaagggaaaccacccctaaaactccgtgatactatgatcgctactcctacgtttcgacgtaaacggttcggggtaccctagtacgtaaacggttcgagtcggacgtaggtacggtagtcgttacggggactaaggttacttttaccgacgtttccgtacctaaccgtacttacgaaccgtctaacgttcctacggtaccctaaacccgtaggttaaaacgtttacgtttttacgaaccttaaacgttttaccgtaacgttccgttaacctaaacgtacggtaacgttaaccgtaccggttaccgtacccccgttacgggtaaccggttaccccgggaaccggaaccgggtacccgtaaacgggtaacggtaaaaccgtacccgaaaacggttaaccgttacgggttacggtaccgtaccgtacccgtaaccgttaccgttactttaaccgg

SEQ ID NO: 288222 - DNA, 674 bp, Homo sapiens
  misc_feature: GYAE6OF02JMT46.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctcctgtctgcatctgtaggacacagacgtcacctatcacttcggccgggcaagtccagagcattagctaacctatttaaattggtatcgagagaatccgaggaaacgtccccgtaaaactccgtagtactacgtatcggtaatcgacctactacccttaactttacggaaccgtaaacgggttacgggggttacccaacgttaccgtaaaaggtttcgtaacggttcgggacgtaaggtcggtacgtcgtaggggtaaccagttactttacgtacctcgtaccacctataccgagtctacgtcacgtacctaaccgtagtaacgtttacgtttacgtaaccttaactttactacgttaacgtacctaaactaacgggtacttacgtaaccggtcgtaccccggttacggtacggttaccgggtacccgtaacgggaaccgtaacgggtaaggtaaactacgtaaaccgtacgtgtacggtctacgaccgtaactcgtacgttacg

SEQ ID NO: 288223 - DNA, 693 bp, Homo sapiens
  misc_feature: GYAE6OF02FYTGJ.6.19.B08.1.454.CMB.1.raw
  modified_base (229)..(229): a, c, t, g, unknown or other
  misc_feature (229)..(229): n is a, c, g, or t
  modified_base (565)..(565): a, c, t, g, unknown or other
  misc_feature (565)..(565): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtagacacagagtcaccatctacgttcgccgggacaagtcgaganctattagctaccttaatttaattaggtatacgaggaagaactaccgaacgggaaaccgtaccccttaaaacctccgtagacttactagtagtagtcgactacttaccttacgtttacgaacgtaaggtccgggtaccctaagtaaccgtaaggttaccgtaggtacgggtacgtaaggtaggtaccgttagggtaccggtactaacgttactttaccgtaccttaccggtaaccctaaccgtactaccgtacgtaccgttacggtacctacggaacccttaaaccgttaggtaaacgttcgtttacaaccgttaacttacgtacttagtacctaanagtacttaccgacgttcccgacccgttacgtacggtaccgaacgtaacgggtaccgaagggtaacgtaacgaaccgtaacggttaacgtacggtacggtacgtccggacctacgtacgttcgttaacc

SEQ ID NO: 288224 - DNA, 778 bp, Homo sapiens
  misc_feature: GYAE6OF02HWTKE.6.19.B08.1.454.CMB.1.raw
  modified_base (95)..(95): a, c, t, g, unknown or other
  misc_feature (95)..(95): n is a, c, g, or t
  modified_base (234)..(234): a, c, t, g, unknown or other
  misc_feature (234)..(234): n is a, c, g, or t
tcagatatcgcgagcacgaccggtgctcgatttagtgagtcagtaagggggagtcagtctcagtcaggacacagcatggacatgagggtccccgntcagctccgtggggctcctgctactctggctccgaggtcgccagatgtgacatccagatcgacccagtctccactccctcctgtctagctatcgtggtacggacacgagacgtccactactctacgttcgggccggtanaacgtcaagcgtactattacgacctaacgtttaattttaaagtggtactacgaacgggtaataacgtaccgaaaggggtaaaccctaaccccgtaaaacgttccgtagtaacttacgtaacgtcgtaacgtcgtacctacttacctacgtttacggaacgtaacgggttccgggttaaccacgttacgttaacggttcgaggtacggtacgtaacgggtcggttaacgtccggtaacgggtaacgttacgttaacgtttcccgtacgttacctaccgtacttaaaccgtccgaacgtaccgttacggttaccacggttaaccgtaacgttaacggttaacgtttaacgtttaccgaacgtttaaccttaacgtccgttagtaaccctaagtacgtttacgtaaccgtcgttacccgttacccgggtaggttaaccggtccggtaaccggacgggtacggttaacgggtaaaccgtaaccgtaacggtaaccgttaacggtccgtacggttccgaccgtttacccgaacttccggtacttaccgg

SEQ ID NO: 288225 - DNA, 856 bp, Homo sapiens
  misc_feature: GYAE6OF02G4NBG.6.19.B08.1.454.CMB.1.raw
  modified_base (221)..(221): a, c, t, g, unknown or other
  misc_feature (221)..(221): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccggaggtgccagatgtgacatccagatcgacccagtcctccatcctcctgtctgctatctgtagacacagatcaacctatcacttggaccggganaagtcagtagctaattacgactaccttaatttaaacgttggtaatacaggaagtaacgacgtaagggaaactaccccgtaaactaccgtagtaacgttactaagtacgtaattcggaacttaacgtacccttaacgttttacgaaccgttaaaaacgggtccggggttaaccctaagttaccgtaaagggtttcgtaacggtacggggtactaagggtacggtaacgttacgggtacggggtaaacgttaacggttaacttttactaaacccgtttacctaacccgtaaacccgtaaacgttaaccggtaaccggtaacccgtaggtttaacccgtacgtaaacccgttaaaccgtaaggttaaaacggtttacttttaacggaaccctttaaaaccgttaaacctttaacggttaacgttaaacccgaaaacgtaacggtttaaaccgttaacgttaaccgggttacccgtacccccgggttaaacggttaacccgggtttaaccggaaaccggttaaccgggaaacccggttaaacggggtaaacggtaaaaacggttaaaccggtaaaaacggtaaccgtttaacgggaacggttaccgtacggtaaccctaaccggtatcccgtttaaccg

SEQ ID NO: 288226 - DNA, 965 bp, Homo sapiens
  misc_feature: GYAE6OF02HN6Y3.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtcctccactccctccctgtctgcatcgtaggtacgacacgagactccacctatacctacttcgggaccggacaaggtcgagacgactaattacgactaacctttaaattttaaacgttggtaacttacgaaggtaacgtaaacgtaccggaaaggggtaaacccgaacccccgtttaaaacctcccgttagtaacctttacctaaagtttaccggtacgttacggtacccttaaccgttaccctttaacgttttaccgggaaaccgttaaacgggggttaccccggggttacccctaaacggtttacggtaaaccggggtttcgtaaacggggttcggtaacgggttaacgggttacgggtaacgtttacggttaacgggggtaaaccttaacggtttaaccgttttaccgtaacccgttttaccgtaacccctaaacctttaaccgttaccgaaccgggttaccttaaccgggttaccgttaacccgaaacccgtttaacccgggttaacgttaaacgggtttttaaccttttaaccggaaaccctttaaaccgtttaaccctttaaccggttaaccgttaacccgtaaacggttaacgtttaaaccggttaaccgttacccgggttaccccgtaacccccggtttacgggtaacccgggttttacccggggaaaccgggtaacccgggttaaccgggttaaacggggtaaaccgtaacggttaaacccggaaaacccggtttcggttaaccggtccgtaacggttaccgtaacccgttacgtaccgtttcccgtttaacccgg

SEQ ID NO: 288227 - DNA, 832 bp, Homo sapiens
  misc_feature: GYAE6OF02JX4UL.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatcgacccagtctccatccctccctgtctgctatcgtggtaggacacagacgtaccaccatcacgttcggcccgggacaagtcgaggacgctattacgacctaaccgtttaattttaaaagttggttaactacgtaagggaagtaacgttacccggaaagggaaaaccgtacccccttaaaaccgttcccgttaggtaactttaccgttaagtacggtaacttcggaaccttaaccgtttacccgttaaacgttttacggaaccggttaaacgggtttaccggggtaaccccttaaagttaaccggttaaacggtttcgaaggttacgggacgttaggttacggtacttacggtaacgggaacgttaacgttacgttttaccaaccttaccgtacctaacgtactaccgtacgtaccgtacgttaccgacgtaaccctaacgttaggtaaacgttttacgttaccgaaccgtttaaacctttacgtaccgttaacgtaaaccgtaactaacggttaacgttaccgtaacgggttacccctacccgggttacggtaaacccgggttaccgaacccgggtaacgggttaaccgtaaacgggtaacgtaaaccgtaaccgttaaacggtaacgttcggtaacggttaccaaccggttacctaaccgggttacttccgttaccgg

SEQ ID NO: 288228 - DNA, 653 bp, Homo sapiens
  misc_feature: GYAE6OF02GYNHT.6.19.B08.1.454.CMB.1.raw
  modified_base (405)..(405): a, c, t, g, unknown or other
  misc_feature (405)..(405): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagagtccaccatccacttcggccgggcaagtcagagcattagcaaccttatttaaatggtatcgagagaactccgagggaacgacccctaactcctagatacgtatgatgactactcctacgttacgacgtaaggtcggggtacccatacgtaaggttcaggtggacgtggtacgagtcgtagggactagtactttcgtactcgacctaccntacgacgtacacgttcgacgtacctaaccgtaggtaagtttactttaccgacttaaccctttaacgttaccttacggtactaaccgtaggtaacgttaacgtacggttccgtacccccggttacgggtacccgttaccgggaacccggaacggggtaacccggtaacgggtaacggtaaaccgttaccgggaaaaccgttaccggttagggacggttaccgtacgtacccaccgtaccttcgttaccg

SEQ ID NO: 288229 - DNA, 739 bp, Homo sapiens
  misc_feature: GYAE6OF02GYOJJ.6.19.B08.1.454.CMB.1.raw
  modified_base (217)..(217): a, c, t, g, unknown or other
  misc_feature (217)..(217): n is a, c, g, or t
  modified_base (280)..(280): a, c, t, g, unknown or other
  misc_feature (280)..(280): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctcctgtctgcatctgtaggacacagagtcaccatcacttcggccgganaagtcagagcattagcacctatttaaatggtatcagagaactcgaaggaaacgcccctaaacncctagactctatgatgacatacctactttgacgtaaaaggtcggggtacccaagttaccgaaaggtttccgagttaggctaaggtcggattacggtaggggactaggttactttaccgaactttcctacctaaacctaacttacgaacgggtacctacggttacctcgggtaaaccctaaaccgttaaggtaaacgttttagtttttacggaaaccctttaaaacgttttaaacccgttaacgttaacgttaacctaaaaacggtacggttaacgtttaaaccggtaacggttacccggtaacccccggtttacgggtaaaccggttttccgggaacccggtaaacggggtaaccgttaaacggggaacggttaaaaaccggttaaaccgaaaaccgggttaaacgtaccgggttaaggtacccggttaacgaacccgaccgttattaacccgttacgg

SEQ ID NO: 288230 - DNA, 688 bp, Homo sapiens
  misc_feature: GYAE6OF02IXQDJ.6.19.B08.1.454.CMB.1.raw
  modified_base (96)..(96): a, c, t, g, unknown or other
  misc_feature (96)..(96): n is a, c, g, or t
  modified_base (141)..(141): a, c, t, g, unknown or other
  misc_feature (141)..(141): n is a, c, g, or t
  modified_base (144)..(144): a, c, t, g, unknown or other
  misc_feature (144)..(144): n is a, c, g, or t
  modified_base (148)..(148): a, c, t, g, unknown or other
  misc_feature (148)..(148): n is a, c, g, or t
  modified_base (428)..(428): a, c, t, g, unknown or other
  misc_feature (428)..(428): n is a, c, g, or t
  modified_base (675)..(675): a, c, t, g, unknown or other
  misc_feature (675)..(675): n is a, c, g, or t
tcagatatcgcgagcacgaccggtgctcgatttagtgagtcagtaagggggagtcagtctcagtcaggacacagcatcggacatgagggtccccgntcgagctccgtgggctcctgctactcgtgctacgaggtcaccagntgngacntccagatcgacctagtccaccgattcctccgtgtctcgctatcgtggtaacgacaggacgtagtcccaccgtatccggtactttacggggaccgggtactaaggttacacgggacttacgtagttacacctaactttaagtttaaccgttgtacgacgaggaatacgtaaccgtaacggtaaccttacctaacgtcccgtagtaccttacgtagtacgtacgtcacctacgtaccttagttcgaacggtaggtccgaactggtacgtacgttgaggtacncggtagtacgctaaacggtcgaacttacgtagttccctagttccgaacgttccaagttacgacgtacgtcgtaccggttacgactaaccggttaagtacccgtttattaccgaactaacccggtttactaccgggtaactacgtaacgtaacgtaaccgtgaccgttccgtaaccggcgtacgtaaccggacgacgtaccggtaagtaccggttacaacgggtcgtagtaccggtcggtataccgtncggtacttacgtc

SEQ ID NO: 288231 - DNA, 620 bp, Homo sapiens
  misc_feature: GYAE6OF02GBYDC.6.19.B08.1.454.CMB.1.raw
tcagatatcgcgagcacgaccggtgctcgatttagtgagtcagtaagggggagtcagtctcagtcaggacacagcattggacatgagggtccccgctcagctcctggggctcctgctactctggctccgagtgccagatgtgacatccagatgacccagtctccatccctcctgtctgcatctgtaggacactagacgtcaaccatcacgttgccgggctaaggtcagagcattagcacttaagtttaaagttcggtatacgaggaactaataccgaagggtaaacgaccccgttaaaatcctagtaattcgttaataggatgactatacctactttcgagtaaaggttcgggtcccaatcgaaaggttcgagtcgacaggttgactgtaggacagtctttacgacttctacgacctatcacgactaggtacctagacctaaccgtaggttaatactttttacgacttaaacttacctaagtctaacaactagtacgttacgacgtttcccgacccgttcgggaaccttccgggaaccgaacggtacccggaaaggttacggtaaacaccgtaaacggtacttaggtacggtacctacgaacctaccgtatccgttaacg

SEQ ID NO: 288232 - DNA, 764 bp, Homo sapiens
  misc_feature: GYAE6OF02G96MO.6.19.B08.1.454.CMB.1.raw
tcagatatcgcgagcacgaccggtgctcgatttagtgagtcagtaagggggagtcagtctcagtcaggacacagcatggacatgaggtccccgctcagctcctgggctcctgctactctggctccgaggtgccagatgtgacatccagatcgacccagtcctccatcctccctgtctgctacttcgtagtaacggacctacgagtacgtacccaacctactaccgtaaccgtttccgggacccggggtaactaacggtccgaaggaacgactaacgttacaccttaaccctttaaagttttaaacgttggttaactacgaagggtaacgtaactaaccggaaacgggtaaacccgtaacccccttaaacgttaccgtagtaactacttaagtacgtaatcgtacctacttcccgtaacgttacgaaccgtaaaggttccgggtaaccctaagtaccgttaacggttcgaacggtggacgtacggtagtacgtccggtagggtaacgtagttaactttaccgacttaccgtacacccgtaatccgaacgtcgtacttacgtacgacctacgtaacgtaacttacgtttacaccgttaaacttccgtaatacgtaacgtaacgacgtttaacgttcgtaacgttcccggttacccgtaccggtaccgggttaccgaaccggttaaccgggaacgtaacggtaacgaaacggtaactaaacgtaccggtagtaccggtcgaccgaccgttacccgagttccttaccg

SEQ ID NO: 288233 - DNA, 803 bp, Homo sapiens
  misc_feature: GYAE6OF02HO5E4.6.19.B08.1.454.CMB.1.raw
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
  modified_base (228)..(228): a, c, t, g, unknown or other
  misc_feature (228)..(228): n is a, c, g, or t
  modified_base (773)..(773): a, c, t, g, unknown or other
  misc_feature (773)..(773): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccggaggtgccagatgtgacatccagatcgacccagtctccatcctcctgtctgctatcgtgtacgacacgagatcgaccntctacttggccgganagcaganctatagctacctatttaaagttgtatcgaaggagaactccgaagggaaacctaccccgttaaactcccgtagtaaccttcgtaagttcgaaagttcgaccgttaactaccgttaacgttcggtaaacgttaaaaggggtccggggttaacccctaagttaccggttaaacggtttccgtaaaggttcggtacggttaaggtagggtaacgtttccggtaaggggttaaccttagttaaccgtttaccgtaacccggttaccttacccgtaccctaacgtaccggtaacgtacgtacggttactcccggaaccgttaaccgttaacggttaaacttttacggttttacctaaaacctttaacctttaccgtttaacgttaacgtaccctaaaaagttcgtaaacggtttaccgtaacggtttcccccggtaaccggttacccgggtaaccggttacccggaaacgggtaaccgggaaacgggttaacggtaaagggtaaacccgtaaggtaaaacccgtacggttcgggttaacggtcgtaaaccnccggtttaaccctacgttccgtttaaccgg

SEQ ID NO: 288234 - DNA, 808 bp, Homo sapiens
  misc_feature: GYAE6OF02GTGYB.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtcctccatccctccctgtctgcatcgtgtagacacagacgtcaccatccacgttcggcccgggacaaggtcaagacgctaattacgacctaacctttaaattttaaaacgttggttaattacgaagggtaacgtaaactccggaaacggggaaaaccgacccccttaaaaccgtcccgttaggaacttacgttaatcggactcggtacctacttccctaacgttttgaaccgtaaaggttccgggtaccctacgtaccgtaacggttcgtaagggtacggtacgtaggttacgggtacgttacggtagggggtaacctaacggttactttttaacccgacctttaccgtaacccgtaacctaaccgttacggtaaccgtaccgtacgttccgtacgtacccttaaaccgtaggttaaacgtttacgtttttaaccgacctttaaacctttacgttaaccgttacgttaacctaaacgtaaacgttaacgtttaaccgtacgggttaccccgtacccggttaaccggtacccgggttacggaacccgggaaacgggtaccggtaacgggtaacggtaaaaccggtaacgtaaaaccggtaacgtcggttacgggccgtaaccggtaccctaaccgttacgtgtttaccg

SEQ ID NO: 288235 - DNA, 767 bp, Homo sapiens
  misc_feature: GYAE6OF02I7JFR.6.19.B08.1.454.CMB.1.raw
  modified_base (199)..(199): a, c, t, g, unknown or other
  misc_feature (199)..(199): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatggtgacatccagatcgacccgagtctccatcccgtcctgtctgctatctggtacgacanagacgtcaacctatactacgttcggacccgggtactaacgtacagacgactacgtacgctaaccttaaattttaaacgttaggttaactcgaaggtaagtacctaacggaagggaaacctaacccctaaacgtaccgtagtaactacgtatagaatcgtactacttacccttagtttacgaaccggtaacgggttaccggggtaaccaacgttacggtaacggttcgtaacggtacggtaccgtaggggttacgtaacgttcggggtaacgggtaaccttaacggtacttttaccgctttacccgtacgaacttactacgagtaccgtacgtactacgtactaacgtacggtaaactttacgtttacgaacttaacgtttaccacttacggtaacaaacgttcgttaacgttcgttaccgtccggtaaccccgtcggtaacccgggtttacggaacccgggtaacggtaaccgggttaacgtaaagggtaaaccgtaaaccggaaccgttaacggttccgggtacgtaccggtccgtaaaccctaccgggtttactcccgtttaacgg

SEQ ID NO: 288236 - DNA, 717 bp, Homo sapiens
  misc_feature: GYAE6OF02IKVUL.6.19.B08.1.454.CMB.1.raw
  modified_base (309)..(309): a, c, t, g, unknown or other
  misc_feature (309)..(309): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcacctatcacttggccggactaagtcaagacgctattagcctaaccttatttaaattggtatcgaggagaatccgaagggaaactcccctaaatcctagtaactctatgtancgactactcctatttgacgtaaggtccgggtaccagtacgtaagttcgagtggactaggtggtactcgtagggtactagttactttccgaacttcgtaccaacctacgtactacgacgtaaggttcctacgtaccgaaacgttagtaaacgtttacgtttaccgaaacctttaacgtttaacctaacttacgtaacctaaacgtacggttaacgttaacgtacggtttacccgtaccccgggttacggttaacccggttaccgggtaacccggtaccgggtaaacccggttaacggggtaaacggtaaacccggttaaaaccggtaaaccgggttaaccgttacggggttaaccggtacccgttacgggtaacccctaaaccggtttaccgtttcccggtttaaccgg

SEQ ID NO: 288237 - DNA, 778 bp, Homo sapiens
  misc_feature: GYAE6OF02HOVRL.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggcctcctgctactctggctccgaggtgccagatgtgacatccagatgacccagtcctccatcctccctgtctgcatctagtacggacacgagagtcaccatcacttggccggacaagtcaggacgctaattacgacctaaccgttaattttaaaagttggtaactacgaagggtaacgtaaacgtccgaaaaggggaaaacctacccccttaaaacgtccgtacgtaacttaccgttaagtacgtacttacggacccttaacttaccccgttaagttttaccggaaccggttaaaacggggttccggggtacccctaagttaaccggtaacgggtttaccgaagggttacggaccgttagggttacgggtaatttccgggtaacggggtaacgtaacgtttacttttacccgaacctttcgtaaccctaactaacgttaccgaaccgttccaacggttcgtacgaaccctaacgtagttaaagtttatttccgaaactttaaccttaacctacgttacgaactaacgtacgttaacgtacgtacggtaccccgcccggttacggaccgttacggaaccggtaacgggtaacggtaaagggtaacgtaaacgtaaccggtaaaacgtacgttcggtacggacgtacgtaacctaaccgttagttcgttaccg

SEQ ID NO: 288238 - DNA, 811 bp, Homo sapiens
  misc_feature: GYAE6OF02I6XN9.6.19.B08.1.454.CMB.1.raw
  modified_base (217)..(217): a, c, t, g, unknown or other
  misc_feature (217)..(217): n is a, c, g, or t
  modified_base (263)..(263): a, c, t, g, unknown or other
  misc_feature (263)..(263): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccggaggtgccagatgtgacatccagatgacccagtctccatccctcctgtctgcatctgtaggacacagacgtacacatcacgtgccgganaagtcagagctattagactaacctaattaaattgtaatcaaggtanaactaccgaaggaaacgacccctaaaacgtcctacgtagtacttaagacgactgtactaactacccgttaacgtttcgaacggtaaaacgggttccggggtaaccctaaacgttaccgtaaacgggtttaccgaaggggttacggacctaaggggttaccggtaagttccggttaacgggaccgttaaaggttaacttttaccgtaacctttaccttaaccctaaacctaaccgtaccgtaaacggaaccgttaaggttaacccgtacggtaaacccctaaccgttaaggtaaaacgtttttaccgtttaacgtaaccctttaaaaccgttttaaacctacgttaacgtaacctaaaacgtaacggtaaaccgttaaccgtaacgttaccgggttacccccgtaccggtaaccgggttaccggtaaacccggaaaccgggtttaaccggaaaacgggttaacgaaaacggttaaacccgtaaaaacggttaacgtaacgggttacgaacggtaacccgtaacgtaaccctaccgttacgtttaacccg

SEQ ID NO: 288239 - DNA, 749 bp, Homo sapiens
  misc_feature: GYAE6OF02H7T8J.6.19.B08.1.454.CMB.1.raw
  modified_base (167)..(167): a, c, t, g, unknown or other
  misc_feature (167)..(167): n is a, c, g, or t
tcagatatcgcgagcacgaccggtgctcgatttagtgagtcagtaaggggggagtcagtctcagtcaggacacagcatggacatgacgggtccccgctcagctcctggggctcctgctactctggctccggaggtcgccagatgtgacatccagatcgaccagtccnccactccctcctgtctgctatcgtggacggacacagactccacctatccgtacggtcggaccggggactaacgtacaggagcctagttacgacctaacttttaaagttttaaagttcggtaacttacggaaagggtaacgtaaccgtaccgggaaaccggggtaaaaccctaacccccttaaaacccgttcctagttacgttacttagttacggtactacgaacctaccttaccgtttacgtttacggaacgttaaacggggtccgggtacctagtaaccggttaggttcgaggtcgagtaggtgtacgtacggtacggactagttaccttccacctaccgacctaactacgtacgactccgtacgtctacgtaaccgtaacgttaagtacggttttaacttacgacctttaacctttacgaactacggttaaccaaggttaccggtacgttaaccgtacgggtaccgttaccccggtacgggttaccggaccccgggtaaggtaccgggaacggtaagggtacgaaacctaaccggtaacgtaccgtgggaacctgtaaccgccctaagttccgcttaccg

SEQ ID NO: 288240 - DNA, 838 bp, Homo sapiens
  misc_feature: GYAE6OF02JSK6V.6.19.B08.1.454.CMB.1.raw
tcagatatcgcgagcacgaccggtgctcgatttagtgagtcagtaagggggagtcagtctcagtcaggacacagcatggacatgacgggtccccgctcagctcctgggctcctgctactctggctccggaggtgccagatgtagacatccagatcgacccagtcctccatccctcctgtcctgacatctgtaaggacacagtacgtccaacctagtacctaacgttcggacccgggactaaaggtccaaaggtagtacctaagtttaacgaccttaaacctttaaagttttaaaaagttagggttaactaaccgtaagggaacgtaaacgttacccggaaaacgggggaaacctacccccgttaaaactccgttacgtaactaaccgttagtaacgtagttacgaccgttacttacccgttaacgtttacgaaccggttaaaaccgggtcgggttacccctaaattaaccggttaaaggttccgtaacggtcgggtaacgtacggttacggtaacgttcgggtaagggaaccgttaaggttaccttttacaaccgttacctaaccggtaaccctagtacccgtaagtacctacgggttacgtaacccgtacctaaaccgtttggtaaaccgtttaagtttacgtaacccgtttaaacttacctaacgttacgtaactaaacgttacgttaacgttaaacgtccgtaccgtaccggtttacccggtaccggtttacccgaacggtaaccgggacgtaacggtaacgggtaaacctaaccggtaacgtaacggtacggttaccggtaccttaccgaaccgacgttacgtacccgtttacg

SEQ ID NO: 288241 - DNA, 777 bp, Homo sapiens
  misc_feature: GYAE6OF02G535E.6.19.B08.1.454.CMB.1.raw
  modified_base (521)..(521): a, c, t, g, unknown or other
  misc_feature (521)..(521): n is a, c, g, or t
  modified_base (768)..(768): a, c, t, g, unknown or other
  misc_feature (768)..(768): n is a, c, g, or t
tcagatatcgcgagcacgaccggtgctcgatttagtgagtcagtaagggggagtcagtctcagtcaggacacagcatggacatgagggtccccgctcagctcctggggcctcctgctactctggcctccgaggtgccagatgtgactatccagatcgaccagtctcactcctcctgtctgcatcgtgtagacacagacgtcaccatccaccgttcggacccgggacaacgtcgaacggacgctaattaagtcctaaacctttaaattttaaaagttcgggtaattccggtaaagggtaacgtaacttacccgggaacgggtaaaacccgtacccccgttaaaaacttccccgttaggaccttaccgttaagtggtaagttcgaactaccgttacccttacgttttaccgacgtaaacgggttccgggtaccctaagtaccgtaacggttcaggtcgagtaggtaggtacgtcggtaggaacttaggttacctttaccgtacttacccgtacctaccgtacncgtaacgacgtcgttccgtacgaccctaaccgttagtaagtttactttaccgacctttaaaacttcccgtaacgttcgtaacctacggtaaccggtacgtttaaccgccggttacccggtaccccgttaggggtacccgttaccggggtaccccggaaacggttaccgggaagggtttaacgaaacggttaaaccgaaccggttagggtaccggtacggtacggtacccgtaactccgttaccggtntttaacccg

SEQ ID NO: 288242 - DNA, 907 bp, Homo sapiens
  misc_feature: GYAE6OF02FUJHX.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatcgacccagccctccatccctccctgtctgcatctgtaggaccagagacgtcaccatcctacttcggcccgggtacaaagtcgaaggacgtacctaagtttacgacctaaccttaaattttaaaagttacggtaattacgaagggtaacgtaaacgtaccggaaacggggtaaaaccgtacccccttaaaaacgttcccgtaggtaacttaccgttaatacgacgtacgaccttaaccttacccttaacgttttacggtaaccggtaaaacgggttccggggtacccctaacggttaacccgtaaaacgggtttaccgtaaaggggttacgggtaaccggtaggggttaccggtaaaacgtttccgggttaaacggggtaaccgtaaacggttttaacgttttcccgaacgtttaccctaaccccgtaaaccgtacttaacgtaccggtaccttaagggttccctaccgggtaaccctaaaccggttaggtaaaccgttttacgtttaccaacggtttaaaccttaacccgttaacgttaccgtaaacctaaacggtacgttaaccgtttaacctacgggttaccccgtcccggttaaccgggttacccgggttaccgtacccgggaaacggggttaacccgtaaacgggggtaaaccgttaaaaccttaaacccggtaaaacccggtaaccggttcggtttaacccgggtaactacccggtaaccctaccgttaccggttacccgtttacccgg

SEQ ID NO: 288243 - DNA, 729 bp, Homo sapiens
  misc_feature: GYAE6OF02JH3PV.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctcctgctactctggctccggaggtgccagatgtgacatccagactcgacccagtcctcctactccctccctgtctcgctacttcgtggtaacggaccaacgagagtaccacctatcctaccgttcgggccgggactaacgtcgaagacgactacgttacgaccttaactttaagtttaaagttggtaactacgaaggaagtaacgtaccggaaacgggaaaccgtacccctaacgtacctagtacttacgtagtacgtactcgactacgtaccttacgtttacgaacggtaacgggtccgggtacctaagtacgtaacggttacgacggtcggtagtacggtggtacgtacggtacgggtaacttaggttacttacctactacccgtactaccgtatccggactacgtacgtaccgtacgaacctaacgtagtaacgtttacttacgtaacctaacgtttactacgttacgtaacgtaaacgtcgtaaacgttacgtacgttacccgacccggtacggtaaccggtcggaaccgtacgggaacgtaaggtaaaccggtaaacctaaccgtaaccggtagtacggtcgtaccgtacgaccgtaaccgtccttacgttccg

SEQ ID NO: 288244 - DNA, 606 bp, Homo sapiens
  misc_feature: GYAE6OF02G9XSJ.6.19.B08.1.454.CMB.1.raw
  modified_base (234)..(234): a, c, t, g, unknown or other
  misc_feature (234)..(234): n is a, c, g, or t
  modified_base (370)..(370): a, c, t, g, unknown or other
  misc_feature (370)..(370): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctcgaggtgccagatgtgacatccagatcgacccagtctccatccctccctgtctgctatctagtaggacacgagacgtccaccatcacttcggcccgggacaagtcagganctaattagcaccttaatttaattggtatacgaggagaactccgaaggaaacgacccctaaactcctagactactatagatcgctactcctactttacgactaacggtcgggtaccagtacaaggttcaggtcgganaggtagtagtcgtacggactagtactttcaccgtactaccaacctactcgacgtacgtacgtctacgacctaaccgtagtaaacgttatttacgaccttaacttacttactacgtactaactagtaactacgtacgtaccgtcccgtacggtacgttaccgaccggtacggaccggtaaggtaacaacgtaactaacgtacgtaggtacgtacgtaccgactacgtattccgtacg

SEQ ID NO: 288245 - DNA, 649 bp, Homo sapiens
  misc_feature: GYAE6OF02G1S9K.6.19.B08.1.454.CMB.1.raw
  modified_base (95)..(95): a, c, t, g, unknown or other
  misc_feature (95)..(95): n is a, c, g, or t
  modified_base (231)..(231): a, c, t, g, unknown or other
  misc_feature (231)..(231): n is a, c, g, or t
  modified_base (304)..(304): a, c, t, g, unknown or other
  misc_feature (304)..(304): n is a, c, g, or t
  modified_base (629)..(629): a, c, t, g, unknown or other
  misc_feature (629)..(629): n is a, c, g, or t
tcagatatcgcgagcacgaccggtgctcgatttagtgagtcagtaagggggagtcagtctcagtcaggacacagcatggacatgagggtccccgntcagctccgtggggctcctgctactctggctccgaggtgccagatgtgacatccagatgacccagtcctccatccctcctgtctgcatctggagacacgagatcaccatctacgttcggccggacaagtcaagganctaagttacgctaaccttaagtttaatggtatcgaggaactaagtccgaagggtaacacccctaaactcgtanacttctagtgtaacgtcgtacacgttcctacgttttacgacgtaacgggtcgggtacccaagttacgtaacgttcgaggtggacgtaggtagacgttacgaggtaccgtagttctttaccgaccttccgtaacctaactacacgttacgcgttaacgttcgtaacacccttaaacgtgtaaactttacgtttacgaaccttaacttaaccgtttctaacgtactaaacgtggtttaacgtacgttacgcccgttaccgtacgggtaccgtacgggaccgtaaggtaccgaacgggtagaactaaccggaagtaacggttgacggntaccgacaccttagtctacg

SEQ ID NO: 288246 - DNA, 779 bp, Homo sapiens
  misc_feature: GYAE6OF02IAQHI.6.19.B08.1.454.CMB.1.raw
  modified_base (95)..(95): a, c, t, g, unknown or other
  misc_feature (95)..(95): n is a, c, g, or t
tcagatatcgcgagcacgaccggtgctcgatttagtgagtcagtaagggggagtcagtctcagtcaggacacagcatggacatgagggtccccgntcagctccgtggggctcctgctactctggctccgaggtgccagatgtgacatccagatcgacccagtctccatccctccctgtctgctatcgttaggacggacacgagtacgtaccaacctatcctaacggttcggacccgggtactaaagtccgaggactctaagttacgacctaacctttaaattttaaacgttggtaactacgaggaataacgtaccgaagggaaacccacctaaacctctgtaattctaatgatcgactacttacctagtttagacggtaacggtcgggtacctacgtacgtagtcgtaggtggtactaggtcggtacgttacggaggtactacgtttactttaccgtaccgttcaaccgtactacgtacgaacggtacttaacgtccgtacgacccttaaacgttacggttaaacgttttagttttaccgaacctttaaaccgtttaacctacgttacgtaaaccgtaaggttacgttaacggtttaccgtacccggttacccgttaccccgggtacgggtttaacccgggttaccggaaccgggttaaaaccgggggtaccgttaaagggttaaacccggtaaaccttaaaccggtaaacccgggtaggttacggtacccgggttacgtaacccggtaaccctaggtttacccgttcggtttaacccg

SEQ ID NO: 288247 - DNA, 579 bp, Homo sapiens
  misc_feature: GYAE6OF02FRVHX.6.19.B08.1.454.CMB.1.raw
  modified_base (273)..(273): a, c, t, g, unknown or other
  misc_feature (273)..(273): n is a, c, g, or t
  modified_base (359)..(359): a, c, t, g, unknown or other
  misc_feature (359)..(359): n is a, c, g, or t
  modified_base (384)..(384): a, c, t, g, unknown or other
  misc_feature (384)..(384): n is a, c, g, or t
  modified_base (453)..(453): a, c, t, g, unknown or other
  misc_feature (453)..(453): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatccctccctgtctgcatctgtaggacacagacgtcaccatcacttcgccgggcaagtcagagcattagcacctatttaaattggtatcaggagaatccgagggaaacncccctaaactcctgatctatgaatgcatcctactttgactaaaggtcggggtcccatacgaacggttcaggtggcgagtggatcgnggactagtatttcactcctcacctntcagctagtctcgacaaccgttgaacgtattttcgacttaacttactctcgtacaacgagtacgttacngttaccgccccttacgggtaccgttaccgggaccgtaaacgggccgtaaagggtacggtaaacgtaaccgtaaaccgtaacgtagggttacggacccgttcgaccctaccgtacttcgttaacccg

SEQ ID NO: 288248 - DNA, 1037 bp, Homo sapiens
  misc_feature: GYAE6OF02IJAWO.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatcgacccagtctccactcctcctgtctgctatctgtaggacacgagacgtccacctatctacgttcggcccgggacaacggtcgaggacgctaattacgacctaacgtttaaattttaaaagttggtaactacgaagggaacggtaaacgtaccggaaaacgggtaaaacccgtaccccttaaaaccgttcccgtagtaacgttaccgttaaagttcgtaactcggtaaccttaccttacccgttacgttttaacggaaccgttaaacggggttccggggttaccctaacggttaccggttaaacgggtttccgtaacggggttcgggtaaccgtaaggggtacgggttaaacgttccggggttaaggggtaacccgttaggtttaaccttttcccgtaacccgttttacctaacccggaacccttaacgttaaccgaacggttacctaccgggtttacccgtaacggttaaaccccggttaaaccgttaaacgggttaaaccgttttttaacgtttttaaacccggtaaaacccccgttttaaacgttttaaccggtttaaacccgttttaacgggtaaaacccccttaaaacggggtttaaaccgtttaaaccgggttttaaacccggttacccgggtttaaccccccggtttaacccccggggggtttacccgggtttaaacccgggggttaaaccccggttaacccgggggtaaaaccgggggttaaaccccgggttaaaccgggggttaaaaaccgggtaaaaccggtttaaaaaccccggaaaaacccggggtttaacccggttacccggggtttaacggtaaccccgggttacccggtaaccccgttaaccggttaaccccgtttccggtttaaccccgg

SEQ ID NO: 288249 - DNA, 742 bp, Homo sapiens
  misc_feature: GYAE6OF02FJGH0.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctgctccgaggtgccagatgtgacatccagatgacccagtctccatcctccctgtctgcatctgtacggacacagacgtcaccatccacgttcgccgggcaacgtcagacgaccattacgactaaccttaacgttttaaaattcgggtaactcaagggacgtaaacgtaccgaaggggtaaacctacccccgtaaaaccttcccgtacggtattaccttaacgttagactacggtacctacttcccttaaccgtttacggaaccgtaaacggttaccggggtccctacgttaccgtaaacggtttcgacggttcggacgtacggtacggtactacggtaggggtaacctacggttactttaccgaaccctttccgttaccgaaccctaacgttaccgaacgtccgtacgttacgttacgacctaaacccgttagttaaacgttaacgtttttaacgaacccgttaaactttacctaaccgttactacaaacgtaagtaccgttacgtacgtccgtaccccgtacggtaccgttaccggacccggtaacggtaaccgaagggttaacgaactaaccgaaaccggtacgtacggtcgaccgtacggtaccaccgtacgtcttaccg

SEQ ID NO: 288250 - DNA, 756 bp, Homo sapiens
  misc_feature: GYAE6OF02HTLW4.6.19.B08.1.454.CMB.1.raw
  modified_base (231)..(231): a, c, t, g, unknown or other
  misc_feature (231)..(231): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatcgacccagtcctaccactcctccctgtactgctatctaggtacggacacgagacgtacaccatacacgtcggaccggganaagtcagagctaagttacgacctaaccttaattttaaaacgttcggtaactcgtaaagggaagtaacgtaccggaaaggggtaaaaccctaccccttaaacgttcccgtaggaacttaccgttaagtacggtatacgctaacttaccccttaagtttacggaactaaacggggttccggaacccttaagtaccgtaaaggttcgaaggttagacgtagggtagtacgttacggtaggaactagttactttcgaacctcgtaccaactagtcaacgtccgtacgttacgacgtaacctaaccgtaagttaagtttatttccgggtaaaccttaacgttaccttaatacgtaacgtaaacgtacgttacgttaacgtacggttcccgtacccggtagtaacccgggttacgaacccggtaacggtaacggtaaaacgggttccgaaaacgtttaaccggaaaacggtaaccgtacggttacggtaccggtacccgtaaccggtaccttacggttccgtttaacccgg

SEQ ID NO: 288251 - DNA, 671 bp, Homo sapiens
  misc_feature: GYAE6OF02GGJVE.6.19.B08.1.454.CMB.1.raw
tcagatatcgcgagcacgaccggtgctcgatttagtgagtcagtaagggggagtcagtctcagtcaggacacagcatggacatgagggtccccgctcagccctacggtcgggctaccgtggctacgtctagggcctccgaggtgccagatgtgacatccaaggatcgacccagtcctccatccctcctgtctgacatctgaggacacgagactccaccatacgtacttcggaccgggacaacggtcaaggactactaattacgactaaccttaattttaaagttggttaactcgaaggaacgtaacaccggaaacgggaaaccacccctaaactcgtatactactatagatcgactacttacctacgtttacgaacgtaacggttcgggtacccaacgttacgtaaaggttccgaaggtcgtacgtaggtgtacgttacggagggactaggtacctttacacttaccgacctacgtacagtacgactacgtctacgacctaactagtaagtatttacgactaacgttactacgtagtaaccataacgacgttacgtacgtaccgtacccgtacggtccgttaaccggaccgtaacggaaccggtaagggtaacgtaaacgtaaccgaaacggtacgtaggacgtcgtacggaccacgttacgtaccttacg

SEQ ID NO: 288252 - DNA, 744 bp, Homo sapiens
  misc_feature: GYAE6OF02HC766.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatcgacccagtctccatccctccctgtctgcatcgtgtaggacagagactcaccagtctacttggccgggacaacgtcagagctaagtagacctaacttaagtttaaagttggtaactacgaaggaagtaacgtaccggaaggggaaaccctaccccgtaaaacttccgtagtaacttacgttagtgtaactcggtacctacttacccgttacgtttacggaaccggttaaacgggttccggggtaccctaagttaaccgggtaacggttacgacggttcggacgtagtggtacgtcgttacgggaactacgttaatttccctacgttcctactaccgtatacggtactaccgtagtactacgtaccgaaaccgttagtaacgtttagtttaccgtaccttaaacgtttacctagttacccgtaagaaaccgttagtaacgttaaccggtacggtacccgttacccgggttacggtaacccggttcccggtaacggaaccgggtacggtaaacggtacggtaaaaacgttaccggtaaaaccggttccgttaggtaaccggttcgacgtaaccccgtaacttcggttaccttccg

SEQ ID NO: 288253 - DNA, 532 bp, Homo sapiens
  misc_feature: GYAE6OF02FTLGX.6.19.B08.1.454.CMB.1.raw
  modified_base (251)..(251): a, c, t, g, unknown or other
  misc_feature (251)..(251): n is a, c, g, or t
  modified_base (281)..(281): a, c, t, g, unknown or other
  misc_feature (281)..(281): n is a, c, g, or t
  modified_base (373)..(373): a, c, t, g, unknown or other
  misc_feature (373)..(373): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcactattaaattgtatcaganaatcgaggaagccctaaactcctgatctangatgcatcctatttgactaaaggtcgggtacccatcaaggttcagtgcagtggatcgtgggacagtatttcactctacactatcagcagtcncgacaacgtagaatntttanacctaacttactactcgtacaacgtagtacttacgacgttcgaccccgttcggtaccgttccggaccgtaacgggaccctaagggtcgaaataccgaaaacgtacgttagacggtactacggaccacgtactcttaccg

SEQ ID NO: 288254 - DNA, 648 bp, Homo sapiens
  misc_feature: GYAE6OF02H0NUC.6.19.B08.1.454.CMB.1.raw
  modified_base (192)..(192): a, c, t, g, unknown or other
  misc_feature (192)..(192): n is a, c, g, or t
  modified_base (260)..(260): a, c, t, g, unknown or other
  misc_feature (260)..(260): n is a, c, g, or t
tcagatatcgcgagcacgaccggtgctcgatttagtgagtcagtaagggggagtcagtctcagtcaggacacagcatggacatgagggtccccgctcagctcctggggcctcctgctactctggctccgagtgccagatgtgacatccagatgacccagtctccatccctcctgtctgcatctgtaggacanagagtccaaccatcacttgccgggacaagtcagagcaattagcactaatttaaatggtaatcgagganaatccaagggaaacaccctaaactcctagatctatagatgacataccactttgaacaaacggtgggtaccctagtcgtaagttcagtggacgtaggtagtacgtacgtggggaactacggtacttttaccgaacctcgtaccctaaccgtaacttcgaagtacctaacggtcctaacggacctaaaccttaacggaaagtttactttacggaccttaaacgttacgttaaccttaggtaaccgtaaactacggtaacgtttaacgacggttacccgtaaccccgtagggttaaaccggtccggtaaccggaacgggtacgtaaagggtacgtaaacgtaacgaaacgtaacgtgtacggtctaccgtaccgtactacgtacgttaccg

SEQ ID NO: 288255 - DNA, 744 bp, Homo sapiens
  misc_feature: GYAE6OF02I2T18.6.19.B08.1.454.CMB.1.raw
  modified_base (224)..(224): a, c, t, g, unknown or other
  misc_feature (224)..(224): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtctccatccctccctgtctgcatctgtaggacacagagtcaccatcacttgccggacaagtcaganctatagctacctatttaaagttggtatcaggtagactaccgaagggaactacccctaaacgtctagtacttactatgagtcgactactccctactttcgacgtaacggttcgggtaccctaagttaccgtaaacggtttacgaacggttcgggacgtaaggttacgggtaagttaccggtacggggtaactagggttacttttaccgaacctttacctaaccgtaccctaagtacccgtagtacccgtacgttccgtagaacccgtaaccgttaggttaacgttatttttacgaacccgtttaaaccgtttaaccgttaaccgttacgttaaccaaacgttagttaacgtttaaccgtacggttacccgttaccccggttacggttaacccggttaccgggtaacccgtaacggggtacccgttaaacgggtaacggttaaaaccgtaccggtaaaacccgtacgttaaccggttacggccgttaaaccggacccgtaaccgttaccgtccgtttacccg

SEQ ID NO: 288256 - DNA, 747 bp, Homo sapiens
  misc_feature: GYAE6OF02HRUHG.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggcctcctgctactctggctccgaggtgccagatgtgacatccagatcgacccagtcctaccactccctccctgtctgctatctggtacggacacagacgtaccaccatcgacgttcggccgggacaagtcgagacgactaagttacgacctaacctttaaagttttaaaagttggtaactacgaagggtaacgtaaacgtaccggaaacgggtaaaacccgtaacccccttaaaaccgttcccgtaaggtactaacgttaagtagtacgtcgtacctacgttacccttacgttaggaacgtaaacgggtccgggtacctacgtacgtaaggtctagggtcgtacgaggtagtacgtacggtaggacgtagttacttacctacgtactacctaactactacgacgtctacgttacacgtaaccgtaacgttaaggttaagtttacgtttaacgaaccttaaaccgtttacgttaccgtacgtaaacgtaacgtacgttaacgttaaccgtacgttaccgtaccccggttacggttacccggtaccgggaacggtaacgggtaacggtaaacggtaacgtaaaccctaaacggtaaacgttacggtgtacggtacgacgtaccgaacgttactcgttaacg

SEQ ID NO: 288257 - DNA, 807 bp, Homo sapiens
  misc_feature: GYAE6OF02F8IX5.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtcctccactccctccctgtctgctatctggtaggacacagacgtacaaccatacctacgttcggaccggacaagtcaggacactagttacgacctaacctttaagtttaaaagtttgggtaattacggagggtaacgtaaacgtaccggaaacggggaaacccctaacccccttaaaaccgttaccgtacggtacttacgttagtaggtacttcgacctacttaccgtacgtttacgaacggtaaacgggtccgggtaccctaagtaccggttaagggttacacgggtcggtacgtagggttcgtagtccgggtaagggtactagtttacctacctaccgtctaccactacgtacacgtccgtagttccgtacctaaccgtaaccgtaggttaacgtttacgtttacctaacgttaacctttcgttaactaccgtaacgtaaacggttacggtaaaccgtttaccggaccggttaccccggtccccgttaacgggggttacccgttaacccgggaacccgggtaacggggtaaccggtaaacggggttaaaccgtaaaccgtaaaccggtaaaacccgggtttagttaccggggttacggtaaccctacccggttacccgtaaacccggtttgtttaccccgttcgg

SEQ ID NO: 288258 - DNA, 781 bp, Homo sapiens
  misc_feature: GYAE6OF02G8VKT.6.19.B08.1.454.CMB.1.raw
  modified_base (94)..(94): a, c, t, g, unknown or other
  misc_feature (94)..(94): n is a, c, g, or t
  modified_base (133)..(133): a, c, t, g, unknown or other
  misc_feature (133)..(133): n is a, c, g, or t
  modified_base (146)..(146): a, c, t, g, unknown or other
  misc_feature (146)..(146): n is a, c, g, or t
  modified_base (225)..(225): a, c, t, g, unknown or other
  misc_feature (225)..(225): n is a, c, g, or t
  modified_base (285)..(285): a, c, t, g, unknown or other
  misc_feature (285)..(285): n is a, c, g, or t
tcagatatcgcgagcacgaccggtgctcgatttagtgagtcagtaagggggagtcagtctcagtcaggacacagcatggacatgaggtccccgntcagctccgtgggctcctgctactctggctccgaggtcnccagatcgtgacntaccagatcgacccagtctccatccctccgtgtctgctatctggagacacgagacgtcaccatcacgtcggaccggganaacgtcagacgtactagtacgccttaaccgtttaatttaacgttggtacttacgaggtanaaccgtcggaaacggtaaactcccccttaaacgtaccgtagtactaccgttaagtacggtagcgaccgttacttaccccgttaggtttaaccgacggtttaaacggttcccgggtaacctaacttaccggtaaacggtttcacgggttaacgcgtaaagggttgtacgtttccgacggggttaaatcgttaccgtttaccgtaaccgttaccgaccctaaaccgtttcgacgttaacccgttggaccttaccggtacgaacccgttaaccgtaattaaaggtttcgttttaaccgaacttttaaaccgtttcgtaacctttcgaaaacgtaacgttcgtaaacgttcgtaccggttaccctacccggttaaacgggtgggtaaaccctagggaaacccggtaccgttaagggggttaacaaacccgttaaacggtaaacgaccgggttttacggtaccgtccgttaaggtcccgttaacctaggtttccttacccg

SEQ ID NO: 288259 - DNA, 760 bp, Homo sapiens
  misc_feature: GYAE6OF02JGUR5.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctcgaggtgccagatgtgacatccagatcgaccctagtcctccactcctcctgtctgctatctgtacgaccagagacgtaccacctactacaaccgttcgggccgggtacctaaggtcaaggtacgactagtttacgacctaaccttaaatttaaacgttggtaactacgaggaagtaacgtaccgaacgggaaaccgtaccccttaaactccgtagaacgtacttagtgtaacgtcgtacctactacctacgtttacgacgtaaacggtccgggtaccacgttacgtaacgttacgtagtcgggtaactagggtaggtacttcggtacgggtaactacggttactttacgtacctaccgtaccctaaacgcgtacgaccggtaacgtctttccggtaaccggaaccttaaccggtaagttaaagttacgttttacccaaacgtttaacctacgttaacctacggttaacaaccgtttaaggtaccgttaacgtacccgggtcctacccgggttacggtaccgttaaccggggaacgacgggttaacccgggaaagttaacccggtaaataaccggaaaacccggttaaggtccgtacgggaccgttacgaaccgtttacctaccgttgtttaaccg

SEQ ID NO: 288260 - DNA, 785 bp, Homo sapiens
  misc_feature: GYAE6OF02H9APY.6.19.B08.1.454.CMB.1.raw
  modified_base (281)..(281): a, c, t, g, unknown or other
  misc_feature (281)..(281): n is a, c, g, or t
  modified_base (298)..(298): a, c, t, g, unknown or other
  misc_feature (298)..(298): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatcgacccagtcctccactcctccctgtctgctatctagtacggacacgagagtccaacatcgacgttcgccggacaagtcgaagacgactattacgacctaacttaatttaaagttggtatacgagganaactcgaacggtaaacnccctaactcctagtactactagtagacttcgctacttccgtacgtttacgaacgtaacggggttccggtaaccctagttaccgtaagttaccgaggtcggacgtacggttaggacgttacggtacgggacttaacggttaacttttacccgactttaccaccgtaaacccgtacgttacctaacgaccgttacgtacccgttacggtaacccttaaacggtaggttaaacttttaccgttttacgaaacccttttaaactttacccgtaggtttaacccgtaaacggtaaaaccggttcggttaaaccggtttaaaccggtaccgttacccggttacccccgggttaacgggttaacccggggtttaccccggaaaccggggttaaccggggaaacccggttaagggaaaccggttaaaccaaaccggtaaacccggtaacgtacggttaccggacgttaccggaccctaacttcgttcgtttaccg

SEQ ID NO: 288261 - DNA, 871 bp, Homo sapiens
  misc_feature: GYAE6OF02HOKMC.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatcgacccagtcctaccactccctccctgtctcgctatcgtagtaggacacgagagtaccaccatctacgtcggaccgggacaagtcgagacgtactaagttacgaccttaaactttaaagttttaaacgtggtaactcggaaagggtaataacgtaaccggaaacgggtaaaaccctacccccttaaaagtccgtaagttaccgtattaacggtagtacctacgaacccttaccgttacccgttaaacgtttaccggggtaaccggttaaaaccggggtttccccggggtaaccctaaaccggtttaaccgggttaaacgggtttaaccgaagggggtttaccgggtacgttaaacggggttacggggttaaccgttccggggtaaacccgggttaaagttaccgggttttaaaccgttttcccgttaaaccctttaccccgtaacccgttaaacgaaccgttacgaaccgttaacggttagttaaccccggacgttaaccgtaaaaccttaggggttaaacttttacgtttaaccttaaaccgttaactttaccgtagtaaccggttaacaaacggttagtaaccggttacgtacggtcccgacccggtttagggaaccccgtcggaaacggtacccggtaaacgggagtaaaaccgtacggtaaaaccgtcgtaacggtttggaccttacggacctaacgtacgtctcgtttaaccg

SEQ ID NO: 288262 - DNA, 665 bp, Homo sapiens
  misc_feature: GYAE6OF02GKIK2.6.19.B08.1.454.CMB.1.raw
  modified_base (229)..(229): a, c, t, g, unknown or other
  misc_feature (229)..(229): n is a, c, g, or t
  modified_base (656)..(656): a, c, t, g, unknown or other
  misc_feature (656)..(656): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatgacccagtcctccatccctccctgtcagcatctgtaggacacagatcaccatcctacgttcgccgggacaagtcaganacattagcaccttaatttaaacgttggtaatacgaggataactccgaaggaaacgtacccctaaactctacgatactatagactgactactcctacgtttagaacgtaaggtccgggtacctagtacgtaacggtttcgaaggttcggacgtacggtcggtaacgttcgtaggggtacctagtacgttttacctcgtaccttacccacctactacgaaccgtccgtaacgttcgtacgacctaaaccggttagtaaaacgtttacttttaacgacctttaaaccttccttaaccgtacgaacctaaacgagttaacgttccgagttcccgaccccgtacggttaccgtaccgggaacccgacgggtaaccgtaaggtaaggaaactacgtaaacgtaacgttcggtacgtacgtcgacctacccgtntaccgttcg

SEQ ID NO: 288263 - DNA, 700 bp, Homo sapiens
  misc_feature: GYAE6OF02FII4H.6.19.B08.1.454.CMB.1.raw
  modified_base (135)..(135): a, c, t, g, unknown or other
  misc_feature (135)..(135): n is a, c, g, or t
  modified_base (517)..(517): a, c, t, g, unknown or other
  misc_feature (517)..(517): n is a, c, g, or t
tcagatatcgcgagcacgaccggtgctcgatttagtgagtcagtaagggggagtcagtctcagtcaggacacagcatggacatgacgggtccccgctcagctcctggggctcctgctactctggctccggaggtnccagatgtgacatccagatcgacccagtctccatcctcctgtctgcatctgtagacacagacgtcacatcacgttcggccgggactaagtcaaggtagctaattacgacctaaccttaattttaaaacgttggtaacttcgaaggtaacgtaactaccggaaggggtaaacctaccccttaaaactccgtagacgttactatagacttcgactactcctacgttcgaacgtaacggtcgggtacccaagtacgtaacggttcgaaggttacggacgtaagggttcgtaacggttcggtacggggaactacgttactttaccgacttacctacctaacctataccgagtactacgttactacgaccgtaacgtagtaaacttntttacgaacttaacgttactacgttacgaccgaaacgtgtaacgttacacgttccgtacccgttagggtaccgttaccggaaccgtacgggtaaccggtaacggtaaacggtaacgtaaaccggtaacggttaacgttacggtacggtacctacggtaacccgtaccggttatcccgttaacg

SEQ ID NO: 288264 - DNA, 705 bp, Homo sapiens
  misc_feature: GYAE6OF02HZ3TW.6.19.B08.1.454.CMB.1.raw
  modified_base (199)..(199): a, c, t, g, unknown or other
  misc_feature (199)..(199): n is a, c, g, or t
  modified_base (232)..(232): a, c, t, g, unknown or other
  misc_feature (232)..(232): n is a, c, g, or t
  modified_base (267)..(267): a, c, t, g, unknown or other
  misc_feature (267)..(267): n is a, c, g, or t
  modified_base (329)..(329): a, c, t, g, unknown or other
  misc_feature (329)..(329): n is a, c, g, or t
tcagatatcgcgagcacgaccggtgctcgatttagtgagtcagtaagggggagtcagtctcagtcaggacacagcatggacatgagggtccccgctccagctccgtggggctcctgctactctggctccggaggtgccagatgtgacatccagatcgacccagtctccatccctccctgtctgcatctgtagacacagngtcacatcacgttcggaccgggcaagtcgaganactattacggacctaccttaatttaaagttgttanacgaggagtaagtccgaacggtaaaccgacccccttaaacgtcctagtacttacgtagttanacgtagctactacccgttacgtttaggaaccgtaaaggtccggggtaaccctagtaccgtaaacggtttccgaaggtggacgttagggtaggtacttcgggtagaccgtaaggttacttttaccgaacgttcctacctaccgtataccgtaggtccttagtctacgaccgtaacgttagttaacgtttagtttctaaaccgttactttaacctaacgttacgtaactaactaacggttacgtttacggtaccgtccggttaccccggtttaacggtccgggttaccgtaaccggaccgggttaactaaacggggtaacgaaacggttaccgtaaacgttacgacggtacgtctaccgacctacgtacttacgtacg

SEQ ID NO: 288265 - DNA, 718 bp, Homo sapiens
  misc_feature: GYAE6OF02GH4M8.6.19.B08.1.454.CMB.1.raw
tcagatatcgcgagcacgaccggtgctcgatttagtgagtcagtaagggggagtcagtctcagtcaggacacagcatggacatgaggtcccgctcagctcctggggctcctgctactctggctccgaggtgccagatgtgacatccagatgacccagtctccatcctcctgtctgcatctgtagacacagagtccaccatacacttcggccgggactaaagtcaagagtccaagttacgactaaccttaattttaaaagttggtaattccgaaggtaagaaactccgaagggaaacgtacccctaaactccttagatactatgaactgacacttcctactttacgacgtaaacggtcgggtaccctagtacgtaacgttccgaggttgacgtaggtcggaacttcggtacgggaactaggttacttttacccgactttacctaccgtaacccacgtttaccgacgtaccgtaacggttccctagtaacccgtaaaccgtttagtaaacggtttacttttacggaaccctttaacgttaaccctttaagttacgttaacaaacgtaaccggttacttaaacccgacggttacctacccccgggttaccggtaacgttacccgggaaccgtaacgggtaaccgtaacgggtaacgaaaaccgttaacgaaaccgttaacgtagggtaccgtacgtaccgaacgtacctacgtttgtaacc

SEQ ID NO: 288266 - DNA, 973 bp, Homo sapiens
  misc_feature: GYAE6OF02F6E61.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtctccatccctccctgtctgcatctgtagacacagagtcaccatcacgttcggccggcaagtcgaagagctaagttacgcctaaccgttaaattttaaaagtttaggtaacttacgaagggtaacgaaacgttacccggaaacgggggtaaaacccgtaacccccctaaaacccgttaccccgttaagtaacgttaccttaagtacggtaacgttcgacctacgttaccctaacgtttacgaacgtaaaacggttccggggtaccctaagttaccgtaaggtttaccgtaggtacggtacgtagggttaggaccgtttacggtacggggtaaacgtaaggttaaccctttttaaccggtaccttacccgttaccctaaacccggtaacttacccggtaacggtaccgttaaacggttaccggttaacccggtaaacccgtaacccgttaaggggtttaaacgttttaacgtttttaaccgtaaaccccttttaaaacctttttaaacccggttaaccgttttaaccggtaaacccgtaaaccgttaaacggttaaaccgggttttaacccggttaaccggtttaccccgggtaacccccggtttaacccggggttaaacccgggtttaacccggggaaacccggttaaacccggggggtaaaccgggtaaaccggggttaaaacgggttaaaaccggttaaaaccccggtaaaaaccgggtttaaacccgggttaacggggttacccgggaaccccgttttaaccgggtaacccgttaaaccccggttaccggttttaacccgtttaacccgg

SEQ ID NO: 288267 - DNA, 840 bp, Homo sapiens
  misc_feature: GYAE6OF02ITMDI.6.19.B08.1.454.CMB.1.raw
  modified_base (95)..(95): a, c, t, g, unknown or other
  misc_feature (95)..(95): n is a, c, g, or t
tcagatatcgcgagcacgaccggtgctcgatttagtgagtcagtaagggggagtcagtctcagtcaggacacagcatggacatgagggtccccgntcagctcctggggctcctgctactctggctccgaggtgccagatgtagacagtccagatacgacccagtcctccacgtcccttcccgtgtctcgctattccgttaggtaacggaccaacgtaaggacgtacccaacctaattacccgacgtttacggacccggggtataaacggtcaaggacgacctaagttacgacctaaacctttaaattttaaacgttcggttaactacgagggaacgtaaccgtaccggaaacggggtaaacccgtaccccttaaaaccgttccgtaggtaacttaccgtaagttggtaacttacgacctaacttcccgttaacgttacgaaccgtaaagggttccgggtaccttaagtacgtaacgggttaccgtaggtcggtacgtaagggtcgtagttacgtacgggaacgtacgttacgtttacaccgttcctaacccgaacgtaactaccgtaacgtaccggttatacgttccggaaaccttaaccggttaacggtaaagtttacttttaccggtaaaccttaacccttttacaacggtttcaaaccggtaaacttcgtaaacgttacccgtacgttacccgggtccccgttaccggttaaaccggtccgggaacctaacgggggtaaactaacggggtaaccggtaaacgttaaacccggttaaagacccgggttaggttaacggcgtaacccgggtaccttacgttaaccgttccgtttaaccg

SEQ ID NO: 288268 - DNA, 575 bp, Homo sapiens
  misc_feature: GYAE6OF02F3A5N.6.19.B08.1.454.CMB.1.raw
  modified_base (215)..(215): a, c, t, g, unknown or other
  misc_feature (215)..(215): n is a, c, g, or t
  modified_base (268)..(268): a, c, t, g, unknown or other
  misc_feature (268)..(268): n is a, c, g, or t
  modified_base (391)..(391): a, c, t, g, unknown or other
  misc_feature (391)..(391): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgacccagtctccatcctccctgtctgcatctgtaggacacagagtcaccatcacttgccgggnaagtcagagcattagcacctatttaaattggtatcagagaatccagggaaacnccctaaactcctgatctatgatgcatcctactttgactaaaggtcggggtacccagtacaacggtttcagtggacaggtggatccgtagggacagtatttcactctacaccatcagtcagtcngacaacctagaagtattttagacctaacttacctactgtaccaagtacgtacttacgagttccgtcccgtacggtacgttccgggacccgaacgggaacccgaagggtaacggaacgttaacccgaaaacggtaaccgttaggtacggtaccgttaccggaccaaccgtacttacgtttacccg

SEQ ID NO: 288269 - DNA, 721 bp, Homo sapiens
  misc_feature: GYAE6OF02GBMAK.6.19.B08.1.454.CMB.1.raw
  modified_base (95)..(95): a, c, t, g, unknown or other
  misc_feature (95)..(95): n is a, c, g, or t
  modified_base (220)..(220): a, c, t, g, unknown or other
  misc_feature (220)..(220): n is a, c, g, or t
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
tcagatatcgcgagcacgaccggtgctcgatttagtgagtcagtaagggggagtcagtctcagtcaggacacagcatggacatgagggtccccgntcagctcctggggctcctgctactctggctccgaggtgccagatgtgacatccagatgacccagtcctccatcctcctgtctgcatctgtaggacacagacgtcaccatccacgttcgccggganaagtcagacgcattagctaaccttaatttaaagttggtatcgaggaanaatccgaaggaaacnccctaaactcctagatctatgatgctatcctactttcgacgtaacggtcgggtacctagtacgtaaggttcctagggtcgacgtaggtacgtagtacggtagggaacctagttaactttccgaaccgttcctaaccaccgtaactacggacgtacctacggttaccttacggaacctaaccgttaggtaaacgtttactttaccgaacgtttaaacctttaacgtaaccgttcgttaacaaacggttaggttaaccgttacggtaccgttacccgttaccccggttacgggttaaccgttacccgggaacccggttaacggggaacccgttaaaggggtaacccgtaaaacggttaacccggtaaaaacggttacggtaccggttacggtaaccgggttaccgtaaccccgtaaccgtttaccttaccgggtttaacg

SEQ ID NO: 288270 - DNA, 730 bp, Homo sapiens
  misc_feature: GYAE6OF02I6CQA.6.19.B08.1.454.CMB.1.raw
  modified_base (93)..(93): a, c, t, g, unknown or other
  misc_feature (93)..(93): n is a, c, g, or t
  modified_base (150)..(150): a, c, t, g, unknown or other
  misc_feature (150)..(150): n is a, c, g, or t
tcagatatcgcgagcacgaccggtgctcgatttagtgagtcagtaagggggagtcagtctcagtcaggacacagcatggacatgaggtcccgntcagctccgtgggctcctgctactctggcctccgagtcgccagatgtgacatccagntgacccagtctccatccgtcctgtctgctatcgtagtaggacacagacgtccactactcctacgtcggaccggactaacgtcgaagacgactaagttacgcctaaaccgttaatttaaacgttggttaactcgaacgggtactaacgtaccgaaggtaaaaccgtaccccttaaaacgtcctaaggtaactttacgtacgttagtacgtcgactaacgttacccttaacgtttaccgtacggttaaaacggttccgggtaacccctagttaccggtaaacggttcgtaacgggtgtaacgtcggtacggtacgtcggtacgggactaacgttcgtttaccaccttctaaccactataccggactacgacgtttcgaacgtacccaacgtagttacgttatttacgaccgttaaacttccggttactacgttaacgaaagttccgtaagttacgaccggttacccgaccggtttaccgggaaccgtttcggaaccgacgggtaactaaccggggtactaaaacggtacgaaccgttaaggaccgtttacggccgttaccaccgaccgtttatcccttacgg

SEQ ID NO: 288271 - DNA, 866 bp, Homo sapiens
  misc_feature: GYAE6OF02HT1NR.6.19.B08.1.454.CMB.1.raw
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatcgacccagtctcatcctccctgtctgcatctgtagacacagagtcaccatcacttggccggactaagtcagacgctaagttacgacctactttaaacttttaaaagttggttaactccgtaagggaacgtaaacgttacccggaaaacggggaaaacccgttaacccccgttaaaaaccgttccccgtaggtaacttaccgttaagttacggtaacgttacgacctaccttacccgttaccgttttacggaaaccgttaaaacggggttccggggtaacccctaacggttaaccgttaaacggggttttccgtaacgggttacggggtaacgttaagggtacggggttaacttaccgggttacgggggaaccttaacggtttaactttttacccgtaacccgtttacccgttaacccgtaaaccctacgttaaccggacggtaaccgtacgtttaccgtaccgttaacccgtaaaccgttaacggttaaacgttttaacttttaccggttaacctttaaacccgtttaacctttaaccgttacgtaaaccgtaaaccgttaggttaaccgttaaccgtacgttcccgttacccggtaccggtaaccggttaccgggaccggtaacgggaaccgtaacgggtaacggtaaaccgtaaccgtaaaccggtacgttacggtacggtaccgtaccgactaaccgttccacgtttaccg

SEQ ID NO: 288272 - DNA, 836 bp, Homo sapiens
  misc_feature: GYAE6OF02FI49T.6.19.B08.1.454.CMB.1.raw
  modified_base (95)..(95): a, c, t, g, unknown or other
  misc_feature (95)..(95): n is a, c, g, or t
tcagatatcgcgagcacgaccggtgctcgatttagtgagtcagtaagggggagtcagtctcagtcaggacacagcatggacatgagggtccccgntcagctccgtgggctcctgctactctggctccgaggtgccagatgtgacatccagatgacccagtcctccatccctccctgtctgcatcgtagtacggacacgagactacaccatccgacgttcggaccgggtacaaagtccgaaggacgactaatttaacgacctaaccttaaacttttaaagtttaggtaactttacggaacgggaagtaaacgtaccggaaacggggtaaacccgtaacccccttaaaacgttcccgtagaacttaccttaagtacggtaacttcggaacctactttacccttaacgtttacgtaacgaaacggttccggggtaccctacgttaacgtaaacgggtttacgtacggttacgggaccgtaagggtcggttaacgttaccggtacgggtaacgtacgtttaacgttttaccctaccgtttaccgttaccaaacccgttaacgtaaccggtacggtacccgtacggttaccgttaacgggaaccccttaaaccgttaacggttaaacgttttacggttttaaccgtaaccttaaaccgttttacctaaccgttacgttaaaccgtaaacgttaacggtacgttaacgtccggttacccgtccccgtaacggtacccgggttaccgaacccggtaacgggtaaccggaacgggttaaccggaaacctacggtaaaccgtaggttacgtcggtacgtaccaccgacgttacgttcctaaccgg

SEQ ID NO: 288273 - DNA, 766 bp, Homo sapiens
  misc_feature: GYAE6OF02H3D00.6.19.B08.1.454.CMB.1.raw
  modified_base (95)..(95): a, c, t, g, unknown or other
  misc_feature (95)..(95): n is a, c, g, or t
  modified_base (143)..(143): a, c, t, g, unknown or other
  misc_feature (143)..(143): n is a, c, g, or t
tcagatatcgcgagcacgaccggtgctcgatttagtgagtcagtaagggggagtcagtctcagtcaggacacagcatggacatgagggtccccgntcagctccgtggggcctcctgctactcgtggctaccggaggtgccganatgtgaccatccagatcgacccagtcctacgacgtccctccgtgtactgactattcgtagtaacggaccaagacgatacccgaccgtaatccgtaacgttggaccccggggactaacgtccgagaccgtactaacgttacgaccttaaccgttaaagttttaaacgttcggttaactacggtaaacggaacgtaacgttacccggaaagggtaaacccgtaacccccttaaacgtcccgttaggtaaccctttacgtaacggtacgtagtaccgtacgttaaccttaccgttaacgtttacggaacgttaacgggttacgggtaccctaacgttacggtaaacgtttccgaaaggttcggtacgtacgggtacgttacgtacggtacggtactacgtacgtttacaccgtttcactactagacgacgtctagaccgtacgacgacgttagaacttagttacccgaacttaaccttgtacttacgaacgttagaccgttaataccggttacgccgttaccgtcggtaacgttccgaaccgttacgggaactacggttaacgaaaccgttacaacggttaccggtacgtacgaccgtactacccgtacgttaccgtacttaccgg

SEQ ID NO: 288274 - DNA, 703 bp, Homo sapiens
  misc_feature: GYAE6OF02H4ZM5.6.19.B08.1.454.CMB.1.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtcgccagatgtgacatccaagatcgaccccagtctccactccctccctgtctgcatctgtagaccaanagagtcaccatcacttcggccgganaagtcagacgactagttagacctaccttaattttaaagttaggttactacgaaggtacgaaacgtccggaacgggtaaaaccgtacccctaaaccgttaccgtagtaacttaccgtaagtagagttcgacctacttaccgttaacgtttacgaaccgtaacgggtcgggttaccctaacgttaccgttaaacggttcgaacggtcggtacgtacggtaggtcgttacgtacggggacgttaaggtacttttacccgtaccgttccgttacaaccttcgtaacgtacggacgttagtcgtacgaacctacggtacgttaagttacgtttactaccgtaacttacgtaacttacgtaaccgtaatacgtaacgttactacggttccgacccggtagtaccgtcggtaaccggacgtaacggtaacggtacgtaactaaccgaacgtaactggacgtacgcgaccctagtacctcgttaccg

SEQ ID NO: 288275 - DNA, 785 bp, Homo sapiens
  misc_feature: GYAE6OF02H0344.6.19.B08.1.454.CMB.1.raw
  modified_base (740)..(740): a, c, t, g, unknown or other
  misc_feature (740)..(740): n is a, c, g, or t
tcagatatcgcgagcacgaccggtgctcgatttagtgagtcagtaagggggagtcagtctcagtcaggacacagcatggacatgagggtccccgctcagctccgtgggctccgtgactactcgtggctaccggaggtcgccagagttcgtacgacactaccgatacgtaccgaccgtacgtcctcctacctccctccgtagtctgaccttagtccgtaggacggactacgacggtaactcctaaacctcgttccgtacggttaccgggaccggttaacgtacgtaaccgaaggtaacgtacgttaacgttacgtaaccgttaacggtttaaatttaaaggttacggtaacgtacggaaacggtaacgtaaccggtaaccgggaacgggttaaaacccgtaccccgttaaaccggttacgtaacgttacgttacgttaacgtcgtaacgttcgaaccgtttaactccgttacgttacgtaacggtacggtacgtaccctaaggtacgtacgtacggttagccggtagtacggtgtagtacggtacgtacgtaacttcctacgttacacgtaccgtaacgtacgacgtacgtactagtactacggtaacgtaagtacgttacgtacttaacggtaccttaacgtcgtaactaccggtaaccgtaacttacggtacgtaacgtacgtcccggtaaccggtcggtaccggtaacggcgtaacgtaggtaacgtaacgaacgtanaaccgtttacggcgttacgaccgtatccgtacgtactcgttaacg

SEQ ID NO: 288276 - DNA, 650 bp, Homo sapiens
  misc_feature: GYAE6OF02G0ML7.6.19.B08.1.454.CMB.1.raw
  modified_base (282)..(282): a, c, t, g, unknown or other
  misc_feature (282)..(282): n is a, c, g, or t
  modified_base (427)..(427): a, c, t, g, unknown or other
  misc_feature (427)..(427): n is a, c, g, or t
  modified_base (531)..(531): a, c, t, g, unknown or other
  misc_feature (531)..(531): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgaccctttagctccatccctccctgtctgctatctgtaggacacgagtacgtacacctatccacttcggcccggacaagtcagagactattacgctaaccttaatttaaaacgttggtatacgaaggtanaaactacccgaagggaaaccgtacccccttaaacgtccgtacgtacttacgtagtgaattcgactacgtaccctacgtttacggaactaaacgggtccggtaccctagtaccgtaagttcgagttggacaggtgagtacgtgganagtatttcactctacacgatcgagtcgtatcagaacctacgtataacgttatttaacgacttaaactttacctaacgtctaaacaacgaacgttacggtaaccnggttacccgtacccgttacggaacggttccggaaaccgacgggaacggtaaaggacggaaacttaaccggaaacgttaacgtggtaccgtacggtacaaccgtaccgtattcccgtacg

SEQ ID NO: 288277 - DNA, 754 bp, Homo sapiens
  misc_feature: GYAE6OF02FIU8F.6.19.B08.1.454.CMB.1.raw
  modified_base (137)..(137): a, c, t, g, unknown or other
  misc_feature (137)..(137): n is a, c, g, or t
  modified_base (746)..(746): a, c, t, g, unknown or other
  misc_feature (746)..(746): n is a, c, g, or t
tcagatatcgcgagcacgaccggtgctcgatttagtgagtcagtaagggggagtcagtctcagtcaggacacagcatggacatgagggtccccgctcagcctccgtggggctcctgctactctggcctccggaggtnccagatgtgacatccagatcgacccagtctccatccctcctgtctgcatcgtagtaggacacgagacgtaccaccatacctacgttcgggaccgggactaacggtcgaaggacgctaacttacggacctaacctttaagttttaaaacgtttcgggtaattaccggaagggaagtaacgtaccggaacggggtaaacctacccccgttaaactccgtagacttactaagtgacgtcgactacgttaccttaacggtttcgaaccggtaacgggttccgggtaaccctaagttacggtaacggtttcggaaggtcgggtacgtacggtggaacgttacgggtacggggaactagttacctttaccgaccgtttaccctacgtaacccttagtaccgtacgtcgtacggttaccgtcgtaaccccgtaaagttcgttaaacgtttcgttttaacaaacccgtttactttaaccgtaccttacggtaaccaaacgtttagtaaactttccgacggttacccgacccgttaagggtcccgtacgggtaacgtacgggacccgaaggtaaccgaaacgtacgtaaccggtaggtcgacgtcgacgacctaactntaccgttc

SEQ ID NO: 288278 - DNA, 763 bp, Homo sapiens
  misc_feature: GYAE6OF02ITHF5.6.19.B08.1.454.CMB.1.raw
tcagatatcgcgagcacgaccggtgctcgatttagtgagtcagtaagggggagtcagtctcagtcaggacacagcatggacatgagggtccccgctcagctccgtgggctcctgctactctggctccggaggtcgccgagatgtgacatccagatcgaccagtcctcctactccctcctggtctcgctacttcgtaggtacggaccacgtaggactacgacctatacctacgtacgggccgggactaacgtacgaacggtacgtacctaacgttacgacctaacctttaaacgtttaaacgtttacggtacgttacgaacggtaaggtaaaccgtaccgggaaacgggtaaaaccccgttacccgttaaaccgttccgtacgttaacggttcttaacggtacgtacgtaacgccttaccgttaccgttacgtttacgaaccggttaacggggtaccgtacctaacggtacgtaacggtgtacggtacggtacggtacggtggtacgtacggtaggtacgttacgttacctttcgtaccttcgacctacgtacgtcgtacggtaccttaagtcttaacgacggtaaccgttagtaacgttttgtaccgttaacgtaccttactacttacgaaccgttaaggtcgtaacggttactaccggttaccgtcccgggttacgaaccggttcgacggtaaccgggtaagaacggttaggaaccacggtaacgtacgtggttacgtcgaccgtgtacgtaccgtcggtac

SEQ ID NO: 288279 - DNA, 688 bp, Homo sapiens
  misc_feature: GYAE6OF02FZAS8.6.19.B08.1.454.CMB.1.raw
  modified_base (227)..(227): a, c, t, g, unknown or other
  misc_feature (227)..(227): n is a, c, g, or t
  modified_base (531)..(531): a, c, t, g, unknown or other
  misc_feature (531)..(531): n is a, c, g, or t
tcagatatcgcgagcacgaccggtgctcgatttagtgagtcagtaagggggagtcagtctcagtcaggacacagcatggacatgagggtccccgctcagctccgtggggctcctgctactctggctccgaggtgccagatgtgacatccagatgaccctagtcctacactccctccctgtctgcatcgtgtaagacacagcgtacaccatactacgttcgccggtanaagtcgagacgcaattacgctaaccttaattttaaagtggttaactacgaggtaacgaacgtaccggaacgggaaacctaacccctaaacgtccgtacgaacgttacttaagtcgtaactcgaacctacttaccttaacgtttacgaaacgttaaaggggtcccggttaacctaacgttaacggtaacggttacgtaacgtcggtaacaggggtttacacgttacggtacggtactagttacctttacgaactttccaacgtaacgtactcgactacgtctcgactacaacgtaggttaacttnttacgaacttacgttaaactgtaacacaacgtgttaacgtcgacgttccgtaaccgtcgtaccggttacgaaccggtaacggaaccgtaacggttacaaaacgtaaccgtaacgtaacgtacgtagtaccacggtaacctaacgtgttcttaaccgg

SEQ ID NO: 288280 - DNA, 772 bp, Homo sapiens
  misc_feature: GYAE6OF02HAVOZ.6.19.B08.1.454.CMB.1.raw
tcagatatcgcgagcacgaccggtgctcgatttagtgagtcagtaaggggggagtcagtctcagtcaggacacagcatggacatgacgggtccccgctcagctccgtggggctcctgctactctggctccggaggtgccagatggtgacatccagatcgacccagtctccatccctccctgtctgcattcgtagtaggacacgagatcaaccatcacgttggccggacaagtcgagagctaatacgactaaccttaatttaaagttaggtaatacgaaggtaataaacgtaccggaaacggggtaaaaccctaaccccttaaaaccgtccgttacgtaacttaccgttaagtagtacgtcgtaacctacgttacccttaacgttttacggaaacgggttaaaacggggttccggggttaacccctaaaggttaaccggtaaaacggggttttcgaaagggtttccgggaacgtaacgggtaggggttaacttaccggggtaacggggtaaacttaggtttacctttacccggaacttacccgttaacctaacccgtaagttaccgaacgaccgttaacggtaccgtacgtaacctaaaacggttggttaaactttaacgttttaccgaaactttaaccgttaactaccgttagttaaccaaacggtagtacgtaactcggtaccgtcccggtacgaccggtacgaccgtaggaacggtaggtaacggaactaacgaaacgacgtgtacggactacgactaccgtataccgtc

SEQ ID NO: 288281 - DNA, 677 bp, Homo sapiens
  misc_feature: GYAE6OF02HH02R.6.19.B08.1.454.CMB.1.raw
  modified_base (235)..(235): a, c, t, g, unknown or other
  misc_feature (235)..(235): n is a, c, g, or t
  modified_base (271)..(271): a, c, t, g, unknown or other
  misc_feature (271)..(271): n is a, c, g, or t
  modified_base (274)..(274): a, c, t, g, unknown or other
  misc_feature (274)..(274): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgccagatgtgacatccagatgaccccagtcctccatccctccctgtctgcatctgtagacacagagtaccaccatcctacgttcggcccgggacaagtcaagngctaattagctaccttatttaaattggtatcagganaanccgaagggaaacgaccctaaactcctagtatctatgatgactactcctacgtttagaccgtaaggtcggggtaccagtacgtaaggttacaggtggcgaggtggatcgtacggtacagtactttacactacgtactacctactacgacgtactacgttcgtacgtacctaaccgtaggttaacgttacttttacgtaaccttaactttacctacgttacgttaactaacgtacggtacgttaacgtacgttacccgtaccccgtccggttaaccggttaccgggtaccgaacggggtaaccgtaacggggtaaacgggtaaaccgttaaaccgtaaaaccggtaaccgttacgggttacggtaaccgttaccggaaccgtaaccctacgttacccgtttaacg

SEQ ID NO: 288282 - DNA, 836 bp, Homo sapiens
  misc_feature: GYAE6OF02HZE01.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatcgacccagtcctccactcctccctgtctgctatctgtaggacacgagacgtcaaccagttaccacgttcggacccgggactaaggtccaaggtacggactagtttaacggacctaccgtttaaactttttaaaagttcggttaacgtacgtaagggtaaacggtaaacgttaccgtaacggggtaaaacgtacccccgttaaaacttcccgtaagtacgtacttacgtacgtatacggtactactacctacgttttacgacgtaaacgggttcggggtacccaacgttacgtaacgggtttacgacggttcgggactaacgggttcggtaacttaccggtacgggttaaagtaacggtttacgttttaacccgtactttaccgtaccctaaccgtaccttacgtaaccggtacttaacggtaccgttcgtaaccgtaaacccgttagttaaacgttacgttttaacgtaaacccgttaaacgtttaaccttaaccgttacgttaaacctaaagtaaccggttaacgttaaccgtaacggttcccgtacccccgggtttcggttaaccgttaccgggaaccgttaaccgggaccgtaaacgggttacggtaaacgttaaccgaaaccgttaaccggtcggttaccgtcgttaaccggaccctaaccgttacgttaccgttaacccg

SEQ ID NO: 288283 - DNA, 703 bp, Homo sapiens
  misc_feature: GYAE6OF02FL5NC.6.19.B08.1.454.CMB.1.raw
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagatcgacccagtctccatccctccctgtctgcatctgtacggacacagacgtccaccatccacttcggccgggacaacgtcagagcattagcaccttaattttaaattggtatcgaaggagtaatccgaagggaaacgacccccgtaaaacctccgtagtactaccgtatgatgctactcctactttgacgtaaacggtcgggtaccatacgtaaggttctaggtcggtagacggtagacgttcgtacgggaactacggttactttaccgaccttcctaccaaccgtactaccgacgtactaacgttccgtaacgtacccgaaccgttaagtaacgtttagttttaccgtacgttaacctttaaccttaaccgttcgttaaccctaagtaaccgttaacgttaaccgtacggttacccgtaccccgttaccgggtaccggttacccggtaaccggtaacgggaaccggtaaggggtaaccggtaaacgttaaacccgaaacggtaccgttcggtaaccggtaccggtacgaccctacccgtacgttcgtttaccg

SEQ ID NO: 288284 - DNA, 854 bp, Homo sapiens
  misc_feature: GYAE6OF02IVJSD.6.19.B08.1.454.CMB.1.raw
  modified_base (226)..(226): a, c, t, g, unknown or other
  misc_feature (226)..(226): n is a, c, g, or t
tcagatatcgcgagcacgaccggtgctcgatttagtgagtcagtaagggggagtcagtctcagtcaggacacagcatggacatgagggtccccgctcagctcctggggctcctgctactctggctccgaggtgcagatgtgacagtccagatgacccagttctccatccctccctgtctgcactcgtgtaaggacacgagagtccacatactacgttcgccggganaagtccgagtacgactattagaccaaccttaagttttaaacgttggtaactaccgtaagggaacgtaaacgtaccgaaaagggaaaccgtaccccttaaaaacgttccgttaggtaacttactaagttacgtaagtaccgactaacttccccgtaacgttttacggaaacgtaacgggttcgggtacccgtacgtaaccgttaacgggttaacgtacggtacggacgtaagggtacgtagttacgtaagggaccttaaaggttacctttaacccgtaaccgtttcgtaacccctaaacgtacttaacggaaccggtacctaaacgggtcttaacgaacctaacccggttaagttaacgttaacgttttaccgtaaaccttaaacgttttaaacctacccgttaagtaaaccgtaaacgtaacggttaacgttaccgtaaccgggtttaccccttaccccgggtttcccgggtaacccggtttaacccgggaaaccgggttaacccggggtaaaacccggtaaacggggttaaacgtaaaaacccggtaacccgtaaaaacgtttacccggaaggttaaccggtacccgttagtaaacccgggtaccttaaccgggtctttaaccccgg

SEQ ID NO: 288285 - DNA, 675 bp, Homo sapiens
  misc_feature: GYAE6OF02FL6QQ.6.19.B08.1.454.CMB.1.raw
  modified_base (255)..(255): a, c, t, g, unknown or other
  misc_feature (255)..(255): n is a, c, g, or t
  modified_base (293)..(293): a, c, t, g, unknown or other
  misc_feature (293)..(293): n is a, c, g, or t
tcagatatcgcgagcacgaccggtgctcgatttagtgagtcagtaagggggagtcagtctcagtcaggacacagcatggacatgagggtccccgctcagctcctgggctcctgctactctggctccgaggtgccagatgtgacatccagactgacccagtctccatcctccctgtctgcatctgtaggacacagagtcaccatccacttgccgggcaagtcagagcattagcacctatttaaattggatcagganataccgagggaacgcccctaaactccagactactagtnatgctactcctactttacgactaacggttcggggtacccagttaccgtaaacggtttcaaggttagggtactaagggtacggtaacgttcgttaaggggacctaggtaattttaccgtaccttaccgttaccaacccgtacttaaccgacggtactacggttaccttacgtaccgtaaacccgttaggtaaacgttaacgttttttacgacccttaaactttaacctacgttacgtaacctaacgtaacggtaacttaacgtacggttccgtaccccgttacggtaccggttaccggtacccgaacgggtaccgaacgggtaagtaacgtaacgtaaacggtaacgtagttacggactacggacctaccctacttacttacg

SEQ ID NO: 288286 - DNA, 758 bp, Homo sapiens
  misc_feature: GYAE6OF02GAD7C.6.19.B08.1.454.CMB.1.raw
  modified_base (195)..(195): a, c, t, g, unknown or other
  misc_feature (195)..(195): n is a, c, g, or t
tcagatatcgcgagcacgaccggtgctcgatttagtgagtcagtaagggggagtcagtctcagtcaggacacagcatggacatgagggtccccgctcagctccgtggggcctcctgctactctggctccgaggtgccagatgtgacatccagatcgacccagtctccactcctcctgtctgctatctgtagacanagagtccacatcgacgttgccgggactaagtcagagctattagacctaacctttaatttaaacgttggtaatacggtaacggaagtaacgtacccggaacgggtaaaacccgtacccccgttaaactccgttaggtacttaccgtagttacgacgtacgacctaacttacccgttaacgtttcgaacggttaaaccgggtcgggttacccctaaggttaccgtaaacgggtttcgtacgggtacggtacgtaggtacggtattaccggtacgggaactacgttaactttccgtacccttactaaccgtacctacgtacgactacgttacgtactaccgtaacaaccgttagttaaagtttacgttacgtaaccttaacttaccgttaactacgtacttaaacgacgtttaacgttaacggccgttccggttaacccggtacgttaccgggtaccggtaaccggaccgggttaacggtaacgggtaacgtaaacgtaaccggtaaaccgttcggtacggttacggaccggttaaccgacccgtaacggttcccttagttacccg

SEQ ID NO: 288287 - DNA, 680 bp, Homo sapiens
  misc_feature: GYAE6OF02G9XML.6.19.B08.1.454.CMB.1.raw
  modified_base (217)..(217): a, c, t, g, unknown or other
  misc_feature (217)..(217): n is a, c, g, or t
tcagatatcgcgagcacgaccggtgctcgatttagtgagtcagtaagggggagtcagtctcagtcaggacacagcatggacatgacgggtccccgctcagctccgtggggctcctgctactctggctccgaggtgccagatgtgacatccagatcgaccagtctccactcctcctgtctgcatctgtagacacagacgtcacatcacgttgccgganaagtcagagcattacgctaaccttaatttaaaagttggtaatcgaaggacgtaactccgaaagggaaacctaccccgtaaaactccgtaggtaacttactagtacgagtcgacctacttacctacgtttaggaacctaaacgggttcgggtaccctaagttacccgtaaagggttccaagggttcggactaagggttcgtaacgttcggtaacgggaacttaggttacttttaccgaacctttaccgtacctaaccgtactaccgtacgtaccgtacgttacgaccgtaacctaacgtagttaacgttatttacgacctttaaacttacctacgttacgtaactaaagtacgtaacgtacgtacgtaccgtcccggttacggtaacggtccgaaccgacggtaacaaggtacaaagtacgtaaacgtacgtaggtcgtactacggacctacgtatccgttacg

SEQ ID NO: 288288 - DNA, 770 bp, Homo sapiens
  misc_feature: GYAE6OF02GMIJP.6.19.B08.1.454.CMB.1.raw
  modified_base (92)..(92): a, c, t, g, unknown or other
  misc_feature (92)..(92): n is a, c, g, or t
  modified_base (227)..(227): a, c, t, g, unknown or other
  misc_feature (227)..(227): n is a, c, g, or t
  modified_base (273)..(273): a, c, t, g, unknown or other
  misc_feature (273)..(273): n is a, c, g, or t
tcagatatcgcgagcacgaccggtgctcgatttagtgagtcagtaaggggagtcagtctcagtcaggacacagcatggacatgaggtcccgntcagctcctggggctcctgctactctggctccgaggtgccagatgtgactagtccagatcgacccagtctccatccctcctgtctgcattcgtagtacggacacaggacgtccacctatcacgttggaccggganagtcgagagctattacgcctacttaagtttaatgtactacgagganacgtaccgaagggtaaccaccccttaaacgtccgtagtaacttacgtagtacgtagttcgacgtactacccgttagttacggaacgtaaacgggttccgggtaccctaacggttcgtaacggtttacgtacggtacggtaccgtaaggttacggacgttaccgggacggtaacgtagtttaccgtttacgtaccgttacctaactacccggtattaacccgacggtacttacggttaccgttaacgtaacccgtaaccgtttaaggggtaactttttaccggtttaacgtaaccgtttaacccgtttaacgtttaaccgttaccgttaaacctaacggttaacggttaaacgtttccggtaacgttaccccgttacccggttacgggttaaccgtccccgggtaacgtacgggtaaccgtacgggttaacgtaaaccgtacgtaaacggtacgttacggttacggtacgaccgtacctaacgttccgtacctttacg

SEQ ID NO: 288289 - DNA, 788 bp, Homo sapiens
  misc_feature: GYAE6OF02FV0PR.6.19.B08.1.454.CMB.1.raw
  modified_base (214)..(214): a, c, t, g, unknown or other
  misc_feature (214)..(214): n is a, c, g, or t
  modified_base (572)..(572): a, c, t, g, unknown or other
  misc_feature (572)..(572): n is a, c, g, or t
tcagatatcgcgagcacgaccggtgctcgatttagtgagtcagtaagggggagtcagtctcagtcaggacacagcatggacatgacgggtccccgctcagctccgtgggctcctgctactctggctcgaggtgccagatgtcgacactccgagatcgaccctagtcctccactccctccctgtctcgctatcgtgtacgacacagacgtcaccntaccgtacgtcggaccggactaagtacaggactactattacgactaacctttaagttttaacgtggtactacggaggaagtaacgtaccggaacgggtaacctaaccccgtaacgttccgtagtactacgtagtacgtatgactacttaccttaccgttacggtaacggtaacgggtccgggtacctaggttaacggttaacggtcgtagggtcgaggtacgtacggtacgttcgggtaacggtactagttaccttaccgtaccgttacctaccacctagccgaaacgttcgtacgctaaccgcgttaaaccgttgtaactttacgttacttaaacccgttacttaccttaccgttanaaaccgttaaacgtaaggtacccgttaaccggttaccggtaccccgggttcccggttaacggtaccccggggtaaccgggaaccggtttaaccgggaaaacccggtttaggggtaaaacccgttaaaacgtaaccccggtaaacgggtttaccggtaaccggttcgggtaaccgtccggttaaccccgaacggtttacccggttcgtttaaccccg

SEQ ID NO: 288290 - DNA, 727 bp, Homo sapiens
  misc_feature: GYAE6OF02GCEIM.6.19.B08.1.454.CMB.1.raw
  modified_base (522)..(522): a, c, t, g, unknown or other
  misc_feature (522)..(522): n is a, c, g, or t
tcagatatcgcgagcacgaccggtgctcgatttagtgagtcagtaagggggagtcagtctcagtcaggacacagcatggacatgagggtccccgctcagctccgtgggctcctgctactctggctcgaggtgccagagtgtgacatccgaagatcgaccctagtctaccatccctccctgtctgcatcgtgtaacgacacgagacgtacaccatcacgttcggccgggataacggtcaagagctattacgctaaccttatttaaagtggtatacgagagtaaactcgaaaggtaaccacccccttaaaatccgtagtactacttaagtgtaacgtgactaacttcccttacggttataacggtaaccggttcggtaccctagtaccgtaaaggtttacgaaggtacggtacgtaggttcgtagtaccgtaggggtaacctagtacctttacgacttaacccaccaaccgtactacaacgttcaacgttctacgaacctaaggtagttaacgttacgtttacncctaaaactttccggtacttaacgtaacgtaaacgtgtaaccggtttaagtcccggaaaccgttccccgttaaacgggaccgttaccccgggaaaggtaacccgggtaacgtaaacggttaacggttaaaactaaccgggtaaaaccgttcggacgggttacgtaaccgtccggttaaaccccgtttaacggtcctttacccggg

SEQ ID NO: 288291 - DNA, 901 bp, Homo sapiens
  misc_feature: GYAE6OF02IVT0T.6.19.B08.1.454.CMB.1.raw
  modified_base (97)..(97): a, c, t, g, unknown or other
  misc_feature (97)..(97): n is a, c, g, or t
tcagatatcgcgagcacgaccggtgctcgatttagtgagtcagtaagggggagtcagtctcagtcaggacacagcatggacatggacgggtccccgntcagctccgtggggcctcctgctacgtctggcctaccggaggtcgaccagtattggtacgacactccgaaggtactcggaacccctagttccttcccaacttcccctccctggtaccttccgactaacttccgtaggtacggaaccaacgaggtaaccgttacccaacccttaagttttacccttccgggggacccggggtaacctaaaggttaccccgaaaggtaaccggtaccttaagttttacccgaccttaaccgttttaaacttttaaaaggttcggttaacgttaccggaagggtaaacgtaacctaaccggtaacgggggaaaacccctaacccccgttaaaacctcgtaaccgagttaccgtagtacgtagtaccgtacctacttaccttacgttaacggaccgtaacgggttcccggacctaacgtagttaacggtacgtacggtaggacgtaggtacggtctagggtacgtacgttaccgttacgttacccgtacctacgtaccctaaccacgttcgtaacgtcgtaccggtcgttaccaaccggttaacccttaggtaactttacgttacgttaaccgttaactacgtttacgtacgtaacctaagtaaccgttagtaccggttaccgttaccccgtcccgttaaaccggtccgggtaaccgttaaccccgggtaacggtaaccgggttaaccgggtaaacgtaaccgggttaaacctaacgggtaaaccggttccggaccgtaacgttcccgtaaaccgtacccgtttaccgtttaccgaccggttttaccc

SEQ ID NO: 288292 - DNA, 254 bp, Homo sapiens
  misc_feature: GYAE6OF01AWDHR.40.86.H09.1.454.CMB.1.raw
  modified_base (253)..(254): a, c, t, g, unknown or other
  misc_feature (253)..(254): n is a, c, g, or t
tcagtctagcgactcacgaccggtgctcgatttagtgctatagacttgggtttgggacagatttcactctcaccatcaccagcctgcaggctgaagatgtggcggtttattactgtcaacaatattctggtcaatctcattctttcggcggagggaccaaggtggagatcagacgaactgtggctgcaccatctgtcttcatcttcccgccatctgaagtcgctagactgagcgggctggcaaggcgcatagnn

SEQ ID NO: 288293 - DNA, 312 bp, Homo sapiens
  misc_feature: GYAE6OF01DV91U.40.86.H09.1.454.CMB.1.raw
  modified_base (262)..(262): a, c, t, g, unknown or other
  misc_feature (262)..(262): n is a, c, g, or t
  modified_base (264)..(268): a, c, t, g, unknown or other
  misc_feature (264)..(268): n is a, c, g, or t
  modified_base (270)..(275): a, c, t, g, unknown or other
  misc_feature (270)..(275): n is a, c, g, or t
  modified_base (277)..(312): a, c, t, g, unknown or other
  misc_feature (277)..(312): n is a, c, g, or t
tcagtctagcgactcacgaccggtgctcgatttagtgctatagactttggggtttggggacagatttcactctcaccatcaccagcctgcaggctgaagatgtggcggtttattactgtcaacaatattcctgtcaatctcattctttcggcggagggaccaaggtggagatcgagacgaactgtggctgcaccatctgtcttcatctcccgccatctgaagtcgctagactgagcgggctggacaaaggccgacattaggntnnnnnannnnnncnnnnnnnnnnnnnnnnnnnnnnnnnnnnnnnnnnnn

SEQ ID NO: 288294 - DNA, 277 bp, Homo sapiens
  misc_feature: GYAE6OF02IVN05.40.86.H09.1.454.CMB.1.raw
  modified_base (256)..(256): a, c, t, g, unknown or other
  misc_feature (256)..(256): n is a, c, g, or t
  modified_base (258)..(277): a, c, t, g, unknown or other
  misc_feature (258)..(277): n is a, c, g, or t
tcagtctagcgactcacgaccggtgctcgatttagtgctatagacttgggtttgggacagatttcactctcaccatcaccagcctgcaggctgaagatgtggcggtttattactgtcaacaatattctggtcaatctcattctttcggcggtagggtaccaaggtggagatcagacgaactgtggctgcaccatctgtcttcagtcttcccgcatctgaagtcgctagactgagcgggctggcaaggccgcatagntnnnnnnnnnnnnnnnnnnnn

SEQ ID NO: 288295 - DNA, 605 bp, Homo sapiens
  misc_feature: GYAE6OF01CSASU.2.11.A11.1.454.CMB.1.raw
  modified_base (229)..(229): a, c, t, g, unknown or other
  misc_feature (229)..(229): n is a, c, g, or t
tcagacgctcgacacacgaccggtgctcgatttagctacgactgcgaaagggaaaggggacgtctcagtcgaggacacagcatggacatgagggtccccgctcagcctcctggggctcctgctactcgtggctccggaggtcgccagatgtgacatcctgatggacccagtctccatccctccctgtctgcatctggtaggagacagagtcaccatccacttgccgggnaagtcagagcattagcagcttattaatggtatcagcaagaaaccagggaaacgccccgtaaaactcctagactcctaagtcgttacagtcctaagtttgaactaaaggtcgggtacccagtcgtaaaggttcaagtcggacgtagtggtatcgtagggtacagtatttcgactctacacctatcacgtcgagtcacgacaaccgtgaagtatttgactaacgtttacactagtacaacgtagtacgttacaaccgtcccctagggtaccgttccggaccgaaacgggaaccaaagggtacggtaaaactaaccgaaaacgaacgttggtcgggtacctaggtacccaacctaagttccgttgttaccttcgtaacc

SEQ ID NO: 288296 - DNA, 657 bp, Homo sapiens
  misc_feature: GYAE6OF01B28IK.2.11.A11.1.454.CMB.1.raw
  modified_base (200)..(200): a, c, t, g, unknown or other
  misc_feature (200)..(200): n is a, c, g, or t
tcagacgctcgacacacgaccggtgctcgatttagctacgactgcaaaggggaaaggggagtctcagtcaggacacagcatggacatggagggtccccgctcagctccgtggggctcctgctactctggctccggaggtgccagatgtgacatcctgatcgacccagtcctccatccctccctgtctgcatctgtagganacagagtcaccatcacgttggccgggacaagtcagagcattagcagtacttaatttaaattggtatcagacaacgaaaccgaagggaaaccacccctaaactcctagatctatgtacatctagtttgacgtaaggtcgggtaccatacgtaaggttcgaggtggcgtaggtggatcgtgggactagtactttcacttctaccacctatcagctagtctcgacctaacctagtaagttattttacgacttaaacctttactaacgttgtacctaaacgtacggttaacgttaacccgtaacccggtttacccccgtagggttacccggttaccggaacccggtaaacggggtaacccggtaagggttaacggtaaaaccgtaacgtaaaaccggtaacgttgggtacggtaccgtacgacccgtaacctacgttacgttcgttccgttccgtaacccg

SEQ ID NO: 288297 - DNA, 748 bp, Homo sapiens
  misc_feature: GYAE6OF01DPR7C.2.11.A11.1.454.CMB.1.raw
tcagacgctcgacacacgaccggtgctcgatttagctacgactgcaaagggaaaggggagtctcagtcaggacacagcatggacatgagggtccccgctcagctcctggggctcctgctactctggctccgaggtgccagatgtgacatcctgatcgacccagtcctccactccctccctgtctgctatcgtaggtaggagacagacgtaccaccactctacgttcggccggactaacgtcgagacgactagttacgacgtaacgtactttaaagttttaaagttaggtaactaccgaacgaaccgaaaacggaaaaccggaaacgggaaacccctaaccccgttaaaaccgtccgtagtaacttacttagttacgttaactacgttaccgtaagtttacgaacggtaacggttccgggtacctagtacggtacgttacgaggtacgagtagtacggtagtcggtaggacgtagttacgttacctacgtacctactaacctactaccgaacgtcctaacgtaccgtacgtaaccgtaaacgtaggttaagttacgtttaaccgtaaccttaacgttaaccgtactacgtaacctaacgtaacgttacgttaacccgtacccggttacccgtacggtaaccggtaccggaccgtaacgggaaccgtaagggaactaaacgaacggtaaacgtcgtacggtcgtaccgtcgtaaccgtacttacgttccgttacgttccttccgtacccg

SEQ ID NO: 288298 - DNA, 873 bp, Homo sapiens
  misc_feature: GYAE6OF01DTI2S.2.11.A11.1.454.CMB.1.raw
  modified_base (111)..(111): a, c, t, g, unknown or other
  misc_feature (111)..(111): n is a, c, g, or t
  modified_base (838)..(838): a, c, t, g, unknown or other
  misc_feature (838)..(838): n is a, c, g, or t
tcagacgctcgacacacgaccggtgctcgatttagctacgactgcaaagggaaaggggagtctcagtcaggacacagcatggacatggacgggtccccgctcgagctccgngggctcctgctactcgtggcgtccgaggtcgaccagatggtacgactacttccgtgaacgtaccgacctacgtcctaccctaccttcccgttcccgttcgtacgtcgtcctagtcgttaggtaggaacgaacgacgtaacgtaccaacctacgttaccgtacgttcggaccgggactaaggtacgagacgtacgtaacttacgactagtttaactttaaagttttaaggttcgtaacgtacgaacgtaacgtaaaacggtaaacccgaaacgggtaaaccccttaaccccttaacggttaccgtagttaaccgtttacgttaacgtttaccgttaacgttaccgttaaccgtttagggttaccgaaaccgttaagggtcccgttaacgtaacgtacggtttacggtacggttaggtacgggtacgtagggtaccgaacggttcgggtaacgtactttaacgttccgtttactcgtaccctaacgtccctaacgtacgccggttaaacgtcgttaactaccgggtaacctaacggttagtttaaccgttttacgtaacctaaaccgtttacttttaaacgggtactaaccgtaagtaaaccggtttcgtaaacccgttcccggttaacccggttaacccgggttacggttaaccggttacccgggaaacgggtaaggtaaccggtaaacggtaccgtaaaacgtacggaacgttaggtacggtcgtanaccgtacctagtaccgttgtaaccttccgacttcc

SEQ ID NO: 288299 - DNA, 745 bp, Homo sapiens
  misc_feature: GYAE6OF02HZVVF.2.11.A11.1.454.CMB.1.raw
  modified_base (159)..(159): a, c, t, g, unknown or other
  misc_feature (159)..(159): n is a, c, g, or t
  modified_base (180)..(180): a, c, t, g, unknown or other
  misc_feature (180)..(180): n is a, c, g, or t
  modified_base (265)..(265): a, c, t, g, unknown or other
  misc_feature (265)..(265): n is a, c, g, or t
  modified_base (441)..(441): a, c, t, g, unknown or other
  misc_feature (441)..(441): n is a, c, g, or t
tcagacgctcgacacacgaccggtgctcgatttagctacgactgcaaagggaaaggggagtctcagtcaggacacagcatggacatgacgggtcccgctcagctccgtgggctcctgctactcgtcggctccggaggtcgccagatgtcgactactccngactacgacccagtcctaccnctccctccgtgtctcactatcgtaggaggaacacgagacgtaccaacctactaccgtcgtacgggacggacaacgtacggaacgngaccttagtacgcgtaagttagtttaaactttaaggttacgtacaccgaaggaaccaaacgggtaaaccgacggaaaacccttaccctaacgtctaagtacttactaagttaccgtaactacgtaccgttaagtacgaacggttacgggtccggtactagtaccgaaggtcacggngtagtacggtgaccgtacggtagtaatcggttaccttacacctacgtaacacgtactacgacgtacgtagttaccgacgaacgtaacgtagttaagttacttaacgttaactttaacgttacgtacgttcgtaagtacaacgttaacgtaagttaaccggttaacggtaaccgtaaaccggttacgggttaaaccgaccgggttaaccggaacgggtaaccggggtaagttaacggtaaacctaacggtaaacggtccgttaacggcgttacgaccgtacgtaacctcgttacgtaccttacgg

SEQ ID NO: 288300 - DNA, 547 bp, Homo sapiens
  misc_feature: GYAE6OF01EQ3P3.39.29.C07.1.454.CMB.1.raw
tcagtcgcactagtcacgaccggtgctcgatttagagtgctacgaagggaaagggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctggttacccattcaccacctttgctctcagctgggtgcgacaggcccctggacaagggcttgagtggatgggttccgtctacaacacaaaccatgcccagaagttccagggcagagtcacatgaccacagacacatccacggacacagcctacatgaactgagcagcctgagatttgacgacacggccatgtattactgtgcgtaggtctcttcgaccaaactgatggtagaacgtaaaaggggtttgaacgttcgtacggggccgaacggggtaacccgtacggtaccacccgtcctcccgtaccg

SEQ ID NO: 288301 - DNA, 647 bp, Homo sapiens
  misc_feature: GYAE6OF01C97L4.39.29.C07.1.454.CMB.1.raw
tcagtcgcactagtcacgaccggtgctcgatttagagtgctacgaagggaaaggggacccaaaaaccacacccctccttgggagaatcccctagatcacagctcctcaccatggactggacctggagcatccttttctggtggtagcagcaacaggtgcccactcccaggttcagctggtgcagtctggagctgaggtgaagacgcctggggcctcagtgaaggtctcctgcaaggcttctggttacccattcacctactttgctctcagctgggtgcgacacggccctggacaaggcttgagtggatgggttcctctacaacacaaaccatcgacccagtaacgttccgagggcaaggagtccacatcgaaccacacgacacatccaacggacacacgacctaacagtacggaactggacgcagccgtagagtagttacgaccgacgaccggacctaagtacgtaacgttactcggtacgacggtacggtccttaccgtttaccgacccgtaaacgtcgtagttacgggtaacgtaaacgggttaaaaaggggtttacggtaaccggtttccggtaccgggggtaacccggtaaccggggtaacccgttacggttacccggtaccccggttccgtcccgtacccgg

SEQ ID NO: 288302 - DNA, 539 bp, Homo sapiens
  misc_feature: GYAE6OF01BAAZD.39.29.C07.1.454.CMB.1.raw
tcagtcgcactagtcacgaccggtgctcgatttagagtgctacgaagggaaaggggacccaaaaaccaaacccctccttgggagaatcccctagatcacagctcctcaccatggactggacctggagcatcctttcttggtggtagcagcaacaggtgcccactcccaggttcagctggtgcagtctggagctgaggtgaagacgcctggggcctcagtgaaggtctcctgcaaggcttctggttacccattcaccacctttgctctcagctgggtgcgacaggcccctggacaaggggcttgagtggatgggttccgtctacgaacacaaaccatgcccagaagttccagggcagagtcaccatgaccacagacacatccacggacacacgcctacataggaactagagacagcctagagatttgacgacacggacatgtattacgtgtgcgagtctctcgccaactgagtgtagaacgaaaagggttgacgttcgtcgggccagggaaccctggtaccaccggtctccgtcgtaccg

SEQ ID NO: 288303 - DNA, 547 bp, Homo sapiens
  misc_feature: GYAE6OF01BWYI5.39.29.C07.1.454.CMB.1.raw
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctggttacccattcaccacctttgctctcagctgggtgcgacacggcccctggacaagggcttggagtggatgggttccgtctacaacacaaaccatcgcccagaacgttccagggcagagtcaccatacgaccacacgacacactccgaacggacacagcctacataggaactgagcagcctgagtattgacgacacgcatgtattactgtgacgtagtctcttcgacaactgagtggtagaacgtaaagggttgacgttcgtcggggaccgacgggtaaccctcggtaccacccgtcgtcctccg

SEQ ID NO: 288304 - DNA, 694 bp, Homo sapiens
  misc_feature: GYAE6OF01CFS2J.39.29.C07.1.454.CMB.1.raw
  modified_base (336)..(336): a, c, t, g, unknown or other
  misc_feature (336)..(336): n is a, c, g, or t
tcagtcgcactagtcacgaccggtgctcgatttagagtgctacgaagggaaagggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttcgtcggttacccattcacctaccttttgctctcagcgtgggtgcgacacggcccctggacagggcttgagtggatggtccgtctacaacacaaaccntcgccaagagttccgagggcagacgtcaccatcgaaccacagaacacactaccgaacggaacacacgacctaacagtacggaactagacgacgaacgtacctaggaagtaacgtttagaaccgaacgaaccggacccgtaagttacgttaacgttaacgttacggttacggaccgggtacggttccttaccgtttacccgacccgtaaaacgtacggtaacgttacgggttaacggtaaaaccggttaaaaacgggggttttacggtaaccgtttccgggtaccgggggtacccggtaaccggggtaaaccccgttacgggttaacccgtaaccccggttcccgtccccgttacccgg

SEQ ID NO: 288305 - DNA, 585 bp, Homo sapiens
  misc_feature: GYAE6OF01BGD1B.39.29.C07.1.454.CMB.1.raw
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctggaggtgaagacgcctggggcctcagtgaaggtctcctgcaaggcttctggttacccattcaccacctttgctctcagctgggtgcgacaggccctggacaagggcttgagtggatgggttccgtctacaacgacaaaccatcgacccagaacgttccgaggccagacgtacaccatgacacagacacatccaacggacacagacctacagtaggaactgagacagcctagagtatttacgacgaacgaccggacctagtcgttacttacgtgtacgtcggtacggttcctcgttccgacctaaacgtcgtatacggtagaaacggtaaaagggtttgtacgttcgtacggggaccaacgggtacccgtcgtacaccgttcgtccgtaccg

SEQ ID NO: 288306 - DNA, 547 bp, Homo sapiens
  misc_feature: GYAE6OF01CA9V6.39.29.C07.1.454.CMB.1.raw
  modified_base (429)..(429): a, c, t, g, unknown or other
  misc_feature (429)..(429): n is a, c, g, or t
  modified_base (495)..(495): a, c, t, g, unknown or other
  misc_feature (495)..(495): n is a, c, g, or t
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctggttacccattcaccacctttgctctcagctgggtgcgacaggcccctggacaagggcttgagtggagtgggttccgtctacaacacaaaccatcgcccagaacgttccgagggcagagtcaccatcgaccacagacacatccacggacacacgcctacatggaactgagcagctgagattgacacncgcatgtattactgtcgcgtagtctcgttacgacaacgtgtagtggtagaacgtaaaaggggtttnacgttcgtacgggaccgacgggtacccgtacggtaccaccgtctccgtaccg

SEQ ID NO: 288307 - DNA, 535 bp, Homo sapiens
  misc_feature: GYAE6OF01B0VRK.39.29.C07.1.454.CMB.1.raw
  modified_base (369)..(369): a, c, t, g, unknown or other
  misc_feature (369)..(369): n is a, c, g, or t
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctggttacccattcaccacctttgctctcagctgggtgcgacaggcccctggacaagggcttgagtggatgggttccgtctacaacacaaaccatgcccagaagttacagggcagagtcacatgaccanagacacatccacggacacagcctacatgaactgagcagcctgacgatttgacgacacggcatgtattactgtgcgagtctcttcgacaaacctgatggtagaacgtaaaaggggtttgacgttcgtcgggccgacgggaacccgtggtaccaccgtctccgtaccg

SEQ ID NO: 288308 - DNA, 798 bp, Homo sapiens
  misc_feature: GYAE6OF01C9KTL.39.29.C07.1.454.CMB.1.raw
  modified_base (282)..(282): a, c, t, g, unknown or other
  misc_feature (282)..(282): n is a, c, g, or t
tcagtcgcactagtcacgaccggtgctcgatttagagtgctacgaagggaaaggggacccaaaaaccacacccctccttgggagaatcccctagatcacagctcctcaccatggactggacctggagcattccttttcttggtggtagcagcaacaggtgcccactccaggttcagctggtgcagtctggagctgaggtgaagacgccgtgggcctcagtgaggtctccgtgcaaggcttcgtcggttaccattccacctactttgctctcagtcgtgggtncgacacggccctggacgaagggtcttggacggtggacgttcggggttacctacgtaacgaaacctaaccaaaacctgtaccgacccctaagtaaccggttccgaacggggcaaggtacgtaccaaccgaagtaccggaacccaacgaagaacctaacaacgttaccccgaacggaacaaccgacggtaccctaacgagttacgggaaaccgtaggaacgacgaacgtacccgttaggaagttacgtttacggaaccgtaaccgaaccgggaccctaagttacgttaactttaccgtaggtacggtaccgggtacggttacccgtttacccgttaccgtaacccgtaaacggttcgtaacggtttacggggtaaacggttaaaaaccgggttaaaaacgggggttttcgtaaaccggttttcccggggtaaccggggtaaccccgggtaaacccggggttaaccccggttaccggggtaaccccgttaacccgggttcccgttcccggttaacccgg

SEQ ID NO: 288309 - DNA, 623 bp, Homo sapiens
  misc_feature: GYAE6OF01EAUJM.39.29.C07.1.454.CMB.1.raw
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctggttacccattcacctacctttgctctcagctgggtgcgacacggccctggacaagggcttgagtggagttgggttccgtctacaacacaaaccagtcgaccagaacgttccagggcacgagtcacatcgaccaacagacacataccacggacacacgacctacactaggaactaggagccacgcctagagtatttacggacgacgaccggactagttagttaacttacgtagtcggacggtaggttccgttaccgttaccgtaccctaaagtgtaacgttaggtacggtaaacggtaaaaggggttttcgaacgttccgggtacgggacccgtaacgggttaacccgtacggtacccgtacccgttccgtcccgtacccg

SEQ ID NO: 288310 - DNA, 677 bp, Homo sapiens
  misc_feature: GYAE6OF01DXJ7R.39.29.C07.1.454.CMB.1.raw
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgccgtggggcctcagtgaaggtctcctgcaaggcttctcggttaccattccacctaccttttgctctcagtcgtgggtgcgacgacggcccctaggacgaagggcttggaggtggagttcgggttccgtctaacaacacaaacagtcgaccctagaacgttccgaggacagacgtacacatacgaacacgagaccacactaccgacggacacgacgacctacgacgtacggaacgtcgaagacacgtaccgtaggagtaacgtttacggaaccgacgaaccggactaagttacgttaacgttacgttaggtacggtaccggtacggttccttaccgttaccgacctaaacgtcgtacgtagggtaacgtaaacgggttaaaagggttcgttaaccggttccgggtaccggggtaaccgtaaccggggttaccccgtacgggttacccgtacccggttccgtcccggtacccg

SEQ ID NO: 288311 - DNA, 624 bp, Homo sapiens
  misc_feature: GYAE6OF01CA37W.39.29.C07.1.454.CMB.1.raw
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctggttacccattcacctacctttgctctcagctgggtgcgacacggcccctggacaagggctgagtggatgggttccgtctacaacacaaaccatcgacccagaacgttccgagggcagagtcaccatcgaccacagacacactccgacgacacacgcctacataggaactgacgacgacgcctaggacgtaagtttacgaacgaccgaccggactattacgttattacgtaggttacgccggtacggttccttacgttccgacctaaacgtcgtacgtagggtacgtaaacgggtaaaacggggttttacgacggtttcgggacggggtacccggtaaccgggtaacccgtcggtacccgtacccgttccgtcccgtacccg

SEQ ID NO: 288312 - DNA, 630 bp, Homo sapiens
  misc_feature: GYAE6OF01EAT7A.39.29.C07.1.454.CMB.1.raw
  modified_base (284)..(284): a, c, t, g, unknown or other
  misc_feature (284)..(284): n is a, c, g, or t
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaggcttctggttacccattcacctacctttgctctcagcgtgggtgcgacncggccctggacgagggcttggagtggagttcgggttccgtactacaacaacaaaccatcgaccagaacgttccgagggcagacgtcacatacgaccacagacacactaccacggacacgacgacctacacgtacgaactgacgcgaacgtccgtaggacgtaacgtttacgaaccgaccgaccggacctagttacgttaacttacgtggtacgtacggtacgttccttaccgttcgacctaacgtgtacgttgggtaacgtaaacggttaaacggggtttagtacggttcggtacggggtaccgaacgggtacccgtacggtacccgtaccgttccgtccgtaccg

SEQ ID NO: 288313 - DNA, 550 bp, Homo sapiens
  misc_feature: GYAE6OF01A3A4T.39.29.C07.1.454.CMB.1.raw
  modified_base (410)..(410): a, c, t, g, unknown or other
  misc_feature (410)..(410): n is a, c, g, or t
  modified_base (496)..(496): a, c, t, g, unknown or other
  misc_feature (496)..(496): n is a, c, g, or t
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctggttacccattcaccaccttttgctctcagctgggtgcgacaggcccctggacaaggcttgagtggatgggttccgtctacaacacaaaccatcgcccagaacgttccagggcagagtacaccatcgaccacagacacatccgacgacacagcctacatagactaganacagcgtagagtattgacgacacgctatgtatactgtcgcgtacgtctctcgacctaacgtgataggtagtaacgtaaaggggttnacgttcggtacgggacaacggggtacctacgggtacctaccggtcctccgtacg

SEQ ID NO: 288314 - DNA, 780 bp, Homo sapiens
  misc_feature: GYAE6OF01D68EG.39.29.C07.1.454.CMB.1.raw
tcagtcgcactagtcacgaccggtgctcgatttagagtgctacgaagggaaaggggacccaaaaaaccacacccctccttgggagaatcccctagatcacagctcctcaccatggactggacctggagcatccttttcttggtggtagcagcaacaggtgcccactcccaggttcagctggtgcagtctggagtctgaggtgaagacgccgtggggcctcgagtgaaggtctccgtgacgaaggtcttcgtacggttaccctattccacctactttgcctctcagtcgtgggtcgcgacgaccggcccgtaggaacgaagggtcttaggaggtagggtaggtttcggggtttcccgtactaaccaaactaaccaaaacctagtccggacccgtaaggtaaccggttaccgacgggacacggaacgttaccaactactacgaaccaacgacgaacaaccacgtacccgaacggtaaccaaccgtacgaacctaacgaacggtacgggaacgtacggaacgaccgacgtaccgtaggtaacgttagttaaccggaccgtaaccgaccggtaacctagttacgttaacgtttacgtaggtacggtaccggttacggtttacccgttaccgttaccgaaccgttaaacgtacgtaaggttacgggtaaaggttaaaaccggggttaaaagggttttccggtacggtttcgggaccggggtaacccggtaaccgggttaacccggttacggttaacccgtacccggttcctacccggtaacccgg

SEQ ID NO: 288315 - DNA, 844 bp, Homo sapiens
  misc_feature: GYAE6OF01A1U14.39.29.C07.1.454.CMB.1.raw
  modified_base (259)..(259): a, c, t, g, unknown or other
  misc_feature (259)..(259): n is a, c, g, or t
tcagtcgcactagtcacgaccggtgctcgatttagagtgctacgaagggaaaggggacccgaaaaaccacacccctccttgggagaatccctagatcacagctcctcaccatggactggacctggagcatccttttcttggtggtagcagcaacaggtcgcccactcccaggttcagctggtgcagtctggagctggaggtgaagacgccgtcggggctcgagtggaaggtctctgacaaggtcttcgtcggttacccnttaccaccctcgttttgccttctcacgtcgtcgggtcgcgaccgacgtccccgtaggaaccgagggtcgttacggtaggtggtacgttcggggttccctacgtaaccgaactaaccaaaccgagttaccgacccgaaggtaccggttaccggaacgggacgaacggtacgtaaccgaaccctaacgtaccggaaacccaacgacaaaccgaaccctaacggtaccgtaaaccgggaacctaaccggacctaacccgtaaccgtaagtaccggtaacccgaaggtaaccggaccgtacgttacggaaccgtacgtccggtaacgacccgtaaccggtacccgggtacccggtttagttaaccgtttacggaccgttacgggtaaaccggaggtaaaccgggtaacggggttaaccgggtttaagtttaaacggttttccggtaaccggtttaccggttaccccggtttaacttaccgggtaccggttaacccggggtttcggggtaaaccccgggtacggggtttaaaccccgtcggttaaacccggtcccgttaaccggttccctaccggtacccgtaaccccgg

SEQ ID NO: 288316 - DNA, 919 bp, Homo sapiens
  misc_feature: GYAE6OF01COVMV.39.29.C07.1.454.CMB.1.raw
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtcgcccactcccaggttcagctggtgcagtctggagctggaggtgaagccgccgtggggcctcgagtgaaggtcctcctgacgaaggtcttcgtcggttaccattccacctacctttgctctcacgtcgtgggtcgacggtacgaccggtcccccgtagggaaccgtaaaggggtccgtttagggaaggttcgggtaacggtttccgggggttttaccccgttaccgttaaacccgaaacccgtaaaccgaaaaacccctagttaccccggaaccccctaaacggtaaaccggttttaccccggaaggggtaccgaaacggtaaccggttacccaaacccgtaacgttacccgggaaacccctaaaccggaaaccggaacctaaacccgtaaccgttaacccccggaaaaccgggaaaccccgtaaaacgaacccgggtaacccctttaaaccgaacgtttaaccggggaaaccgttacggaaccggtacgaacccggtaccgttagggtaacgttaacggtttaaccggaaccgaacccggtaaccgtaccgtaagtttaacggtttacgttaacgttagggtacggtaaccgttacgggttccctttaccgttacccgtaacccgtaaacgttaacggtaacggttacggtaacggtaaaacgggtttaaaacgggtttcgtaacggtttccgggaccgggtacccgaacgggttaccccgtacggttaccgtaacccgttcccgtaccgttaaccccgg

SEQ ID NO: 288317 - DNA, 648 bp, Homo sapiens
  misc_feature: GYAE6OF01CJ2JG.39.29.C07.1.454.CMB.1.raw
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgccgtggggcctcagtgaaggtcctcctgcaaggcttcgtggttacccattcaccaccttttgctctcagtctgggtgcgacacggcccctggacagggctgaggtggatgggttcctctacaacaacaacatcgacccagaacgttacgaggcaggtacgtccacatacgaccacagaccacatccgacgacacgagccacagtacgaactagacgcgacgcgtagagtatttagacgtaacgaccggtaccagttacgttaacgttacgtacggtaggtccgtagggttcttaccgttaccgtacccgtaaacgtccggtagttacgggtaacggtaaacgggttaaaaacggggtttcgtacggttaacggtccggggtaacccggtaaccgggtaacccggttacgggttaccctaccggttcccgtacccggttaccg

SEQ ID NO: 288318 - DNA, 815 bp, Homo sapiens
  misc_feature: GYAE6OF01ACE1O.39.29.C07.1.454.CMB.1.raw
tcagtcgcactagtcacgaccggtgctcgatttagagtgctacgaagggaaaggggacccaaaaaccacacccctccttgggagaatcccctagatcacagctcctcaccatggactggacctggagcattccttttcttggtggtagcagcaacgaggtcgcccacctcccaggttcagtcgtggtgcagtcgtggagctggaggtagaacgaccggccgtcggggcctcgaggtggaacggttcctcctggccgtaaggtcttcgtacggttaaccctattccaccctaccgtttgcctctcgagtcgtgggtcgaccgacgaccggtccccgtggaccgaggtcttggaggtggtacgttcgggttccgtacgtaaccaacgaaccgaaaccgtacgtccgacccgtaggtacgttccgagggcagaccgtaccaaccgacgtaccgaaccgacgaacgaacctacaacgtaccgaccggaaccacgacgtacctacgtacgtacgacgtacgacgtacgtacgtcgtacgtagtacgttacgtaccacgggggggggggggggggggggggggacctacgtacgtacgttacgttacgtacgtacggtacggtaccgttaccgttaccgttaccgtaccgtaaccggtacggtacggttacggttaacgggttaaaccgggtttaaacggggtttaccgggttaacccggttacccgggttacccggggtaacccgggtaacccgggttaaccccgggttacccgggttaacccggttaaccccggttacccgttacccggttaaccccgg

SEQ ID NO: 288319 - DNA, 730 bp, Homo sapiens
  misc_feature: GYAE6OF01E49UQ.39.29.C07.1.454.CMB.1.raw
tcagtcgcactagtcacgaccggtgctcgatttagagtgctacgaagggaaaggggacccaaaaaaccacacccctccttgggagaatcccctagatcacagctcctcaccatggactggacctggagcatccttttcttggtggtagcagcaacaggtgccactcccaggttcagctggtgcagtctggagctgaggtgaagacgccgtggggcctcagtgaaggtctctgcaggcttcgtggttacccattcacctactttgctctcagcgtgggtcgcgacgacggccctggacgaaggggctttggaggtggacgttcggggtttcccgtactaaccaaacgaccaaaaccgacgtcgacccaaggtaacgttccgaagggccaagtacgtaccaccaagtcgaaccacaacgaccaacactccaacggaccacgacgacctaacaacgtacgaacgtacggagacgacgaccgtacggaagtacgttacggtaccgaccggaccggaccgtacgtacgttacgttacgtacggtacggtacgggtacggttccgttaccgttaccgtacccgtaaacgttacggtacggttacgggtaacggtaaacgggttaaaacggggtttacgggttaacggttcgggttaccggggaacccgggtaaccggggtaacccggaccgggttttttttttacccggacccggtttcccgttcccgttacccgg

SEQ ID NO: 288320 - DNA, 884 bp, Homo sapiens
  misc_feature: GYAE6OF01DLN5U.39.29.C07.1.454.CMB.1.raw
tcagtcgcactagtcacgaccggtgctcgatttagagtgctacgaagggaaagggacccaaaaaccacacccctccttgggagaatcccctagatcacagctcctcaccatggactggacctggagcattccttttcttggtggtagcagcaacaggtgcccactcccaggttcagctggtgcagtctggagctgaggtgaagacgccgtggggcctacgagtgaaggtctccgtgacgaagtcttcgtacggttacccattccacctacctttgctcctacgagtcgtggtcgaccgaccgaccgggtccctacgggaacgtaacgggtccgtttaggaggttagggtacggtttcgggggtttcccgttaccgttaaacccgaaaccgaaaccgtaaaacccgtaacgtaccggaaccccgtaaggttaaaccggttcccggagggaacctacggtacgttacccacgaagttaccgaaacccacgaaacgaacccgtacgtaccgtaaccgaacccgggaaacaaaccgtacccggtacccgtaaacgtaccgttaacgggtaaccgtacgggaaccgtaccggtaaccggtacccggttaaggtaaccgtttaacggttttacccgggaaaccgtaacccgggtaacccggtaaccgttaacgtttacggtttaacgtttaccggtttacgggttccggtaaccgggttaccggtttacccgtttaccgttacccggtaacccgttaaacggttaccggttaggttacggggtaagttaaaacgggttaaacggggtttaccgttacgggttccgggtaccgggtaacccggtaacgggtacccgttacggtacccggtacccttccgtacccgtacccg

SEQ ID NO: 288321 - DNA, 621 bp, Homo sapiens
  misc_feature: GYAE6OF01EU1Y2.39.29.C07.1.454.CMB.1.raw
  modified_base (260)..(260): a, c, t, g, unknown or other
  misc_feature (260)..(260): n is a, c, g, or t
  modified_base (278)..(278): a, c, t, g, unknown or other
  misc_feature (278)..(278): n is a, c, g, or t
  modified_base (316)..(316): a, c, t, g, unknown or other
  misc_feature (316)..(316): n is a, c, g, or t
  modified_base (349)..(349): a, c, t, g, unknown or other
  misc_feature (349)..(349): n is a, c, g, or t
  modified_base (352)..(352): a, c, t, g, unknown or other
  misc_feature (352)..(352): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (421)..(421): a, c, t, g, unknown or other
  misc_feature (421)..(421): n is a, c, g, or t
tcagtcgcactagtcacgaccggtgctcgattttagagtgctacgaagggaaaggggacccaaaaaaccacacccctccttgggagaatcccctagatcacagctcctcaccatggactggacctggagcatcctttttcttggtggtagcagcaacaggtgcccactcccaggttcagctggtgcagtctggagctgaggtgaagacgccgtggggcctcagtagaaggtctccgtgcgaagcttacgtcggttacccnttccacctactttgctcncagcgtgggtgcgacgacggccctggacgtaggcttgngtggagttcgggttccgtactacgaacacaacntcnccagacttcgaggcagcgacacagtcaccacagacacactccacgacanacgctactanacgaactgancgagcgtagtagactttaggaccgacgaccggctaagttcgttagttacgtgtcgtacgggtacgttcttccgtaccggaactaacgtgaagttcgggtaagttaaacgggttaaacggggtttacaccggtttcgggaacgggtaccggaacccgggtacccgtacggttaacccgtaccggtcccgtacccgtaccgg

SEQ ID NO: 288322 - DNA, 594 bp, Homo sapiens
  misc_feature: GYAE6OF01B6ZKO.39.29.C07.1.454.CMB.1.raw
  modified_base (276)..(276): a, c, t, g, unknown or other
  misc_feature (276)..(276): n is a, c, g, or t
  modified_base (324)..(324): a, c, t, g, unknown or other
  misc_feature (324)..(324): n is a, c, g, or t
  modified_base (349)..(349): a, c, t, g, unknown or other
  misc_feature (349)..(349): n is a, c, g, or t
tcagtcgcactagtcacgaccggtgctcgatttagagtgctacgaagggaaagggggacccaaaaaccacacccctccttgggagaatcccctagatcacagctcctcaccatggactggacctggagcatcctttcttggtggtagcagcaacaggtgcccactcccaggttcagctggtgcagtctggagctgaggtgaagacgctggggcctcagtgaaggtctcctgcaaggcttctggttacccattcaccacctttgctctcagctgggncgacaggccctaggacaagggcttggagtggatgggatggatcagcgnttacaagtggtcaacaactaaactntcgactacgacgaacctccgaagggcagactacaccatcgaccacagacacactaccacgacgccgtacgacctacgacgtcggaacctcgaacggacgaccgtgacgactcgtacgacgacgtacggcgttagtacgttacgtgtacgacgaggtagtacggtacggggtaaattacggttttcgaaccgttcggttaacccgttacgttacggtaaccttacggtggggtcccggtaacgggg

SEQ ID NO: 288323 - DNA, 816 bp, Homo sapiens
  misc_feature: GYAE6OF01DKGD4.39.29.C07.1.454.CMB.1.raw
tcagtcgcactagtcacgaccggtgctcgatttagagtgctacgaagggaaagggacccaaaaaccacaccctccttgggagaatcccctagatcacagctcctcaccatggactggacctggagctattccttttcgttgggtggtaggcagcaacgaggtcgcccacctccaggttcagctggtgcagtctgggacgcgtggaggtagaaacgccggtccggtcggggccctcgtaggtcggaacggtcctccgtggacgtaacggtcctttcgtacggttaaccctacttaccaccttaccgttttgccttcctacgacggtcggttcggggtcgaccggtaccggaccggccccgttggggaaaccgtaaggggttcgtttagggacgggtttacgggtacggtttccggggttacccgtaccttaaaccgaaaacccgaacctaaaacccgtgtaccccgggaaccccgtaagggtaacgttacccgggacgggaccgaacggtaactacccgaactaacgacggaaccccaaacgacgaacccgaactacccgtaacccggaaccgaacaacccgtacgaaccttacgacgtacggaacgtacggagcgacgtcgtaggacgttacgttacggaacgacgacgtactagtacgttagtcgtgtcggtacgtccgttctacgttaccgaactaacggtgtacgtacggtaacggtaaaggttaaacggggttataccggttaccgggtacggggaacccggttaaccgggtacccggttacgttaccccgaccgttccgttcccgtaccgg

SEQ ID NO: 288324 - DNA, 656 bp, Homo sapiens
  misc_feature: GYAE6OF01BP73F.39.29.C07.1.454.CMB.1.raw
  modified_base (320)..(320): a, c, t, g, unknown or other
  misc_feature (320)..(320): n is a, c, g, or t
  modified_base (332)..(332): a, c, t, g, unknown or other
  misc_feature (332)..(332): n is a, c, g, or t
  modified_base (365)..(365): a, c, t, g, unknown or other
  misc_feature (365)..(365): n is a, c, g, or t
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgccgtggggcctcgagtgaaggtctcctgcaaggcttctggttacccattcacctacttgctctcagtctgggtgcgacacggccctggacaagggcttgagtggatgggtcctntacaacacaacntcgccagacgtcgaggcagatcacatcgaccanagacacataccacggacacacgacctacacgtaggaactagaacgacgacgacctaggaaggtaatttacggaaccgtaaccgaaccggaccgtaagttacggttaacgttaacgtggtacggtacggtacgggttccctttacgttaccgaaccgtaaacgtcggtaagttacgggttaacggtaaacggttaaaaagggggtttacgtaacggtttccgggtacgggggtaacccgtaacggggttaacccgtacgggttacccgacccggttccgtacccgtacccgg

SEQ ID NO: 288325 - DNA, 765 bp, Homo sapiens
  misc_feature: GYAE6OF01DZRH5.39.29.C07.1.454.CMB.1.raw
  modified_base (187)..(187): a, c, t, g, unknown or other
  misc_feature (187)..(187): n is a, c, g, or t
  modified_base (660)..(660): a, c, t, g, unknown or other
  misc_feature (660)..(660): n is a, c, g, or t
tcagtcgcactagtcacgaccggtgctcgatttagagtgctacgaagggaaagggacccaaaaaaccacacccctccgttgggagaatcccctagatcacagctcctcaccatggactggacctggagcattccttttcgttggtgtagcagcaacaggtcgccctactcccaggttcacgctggtncagtctggagctgaggtgagaccgccgtgggcctacgagtagaaggttctccgagcgaacgtcttcgtacggtacctacgttccaccttacttcgacttctagacggtcgtgggtcgaccgacgtaccggacccgtaggacgtagggtcgtaggacggtggtacggttcggttaccgactaacaacaaccaacgtgtacccgaacgtacgtaacgtccggacggtacgaacgttaccgaacctaccgtagtacccgaaaccgtactaacgaacccggacctaccggtacccgaccggaaacaccggtaacccgtagtaacccgttaggtaaaccggacgttacggaaaccgtccgtaacggtccggtaaggtaacggtttacgtaaccggaacccgtaacggtacccgtagttaacgttacgttacgttacggtccgttacggaacgtttcggttacctacgttaccaaacgngtaacttaggggtacgtaaggggttaaaccgtttaagggcgtttacggtcggaaccgggtcccgttaaacgggcccttagtacccgtaccccttgacctacccgg

SEQ ID NO: 288326 - DNA, 855 bp, Homo sapiens
  misc_feature: GYAE6OF01BL8HO.39.29.C07.1.454.CMB.1.raw
  modified_base (732)..(732): a, c, t, g, unknown or other
  misc_feature (732)..(732): n is a, c, g, or t
  modified_base (811)..(811): a, c, t, g, unknown or other
  misc_feature (811)..(811): n is a, c, g, or t
  modified_base (848)..(848): a, c, t, g, unknown or other
  misc_feature (848)..(848): n is a, c, g, or t
tcagtcgcactagtcacgaccggtgctcgatttagagtgctacgaagggaaaggggacccaaaaaccacacccctccttgggagaatcccctagatcacagctcctcaccatggactggacctggagcattccttttcgttgggtggtagcagcaacgaggtcgcccactcccgaggttcagtcgtggtgcgaggtctgggagtcgtggagggtagaaggaccggccggtcggggcctacggaggttacggaacggtcctccgtagacgtaacgggttcttacggttaccggttaccctacgttaccctaccgttaccgtttcggccttcctcggtaggttccgtaggggttacgaccggtaaccggtacccggtaccccggtagggtaacggaaccggggttcggttacggtaggggtaacgggtacgggtttccgggggtttacccgtaaccgtaaaaccccgtaaactaaacccggaaaaccgtaccggtaacccgtaaaccggtaacggtaaaacggttacgggaaccggagtaacggacgttaacccgaccgtacaaaccggtaaccaaacgtaacgacctaaacgtaccgtaacccgaaaccggtaacaaccgaacttaccgaactacgggaaacgtcggtaacagggtaacctacgaaccgtaagggtaagttacccggttacgggaacccgaacgttacccggacttaaagggtacttttaacncggggttaacgtcgtacgggttaactcgttaccgttacgaacgtacttagggacttaggtaaacggtaaggttacggtntacggttacggcgtacggacgtcgacgtctacgtcgnggtaccc

SEQ ID NO: 288327 - DNA, 739 bp, Homo sapiens
  misc_feature: GYAE6OF01AKFKN.39.29.C07.1.454.CMB.1.raw
tcagtcgcactagtcacgaccggtgctcgatttagagtgctacgaagggaaaggggacccaaaaaccacacccctccttgggagaatcccctagatcacagctcctcaccatggactggacctggagcattccttttcttggtggtagcagcaacaggtgcccactcccgaggttcagctggtgcagtctggagctggaggtgaacgacgccgtggggcctcgaggtggaacggtcctccgtgcgaaggtcttcgtacggttaccctattccaccctacctttgcctctcgagtcgtgggtcgccgacgaccggccccgtaggaccgtaagggtcttagggaggtggtagttcggggttccctacgtaaccaacaaccaaacctacgtaccgaccccgtaaaggtaaccgttaccgagggaccaaggacgtaccacgtactaccgaccacgaacgaccactaccgaccggaacgaccaacgacgtacctaacgacgtacgaacgtgacgacgacgtcctaggacgtacgttacgaccgaccgaccggtactacgttacgttacgttacgtaggtacggtaccggttacggttccttaccgtaccgtaaccgtaacgttaggtacggttacgggtaaacggtaaacgggttaaacggggttacgtaaccggttacgggtaccgggaaccggtaacccgggtacccggttacggtacccggcccgttccgtcccgtacccg

SEQ ID NO: 288328 - DNA, 751 bp, Homo sapiens
  misc_feature: GYAE6OF01DZPVB.39.29.C07.1.454.CMB.1.raw
  modified_base (127)..(127): a, c, t, g, unknown or other
  misc_feature (127)..(127): n is a, c, g, or t
  modified_base (508)..(508): a, c, t, g, unknown or other
  misc_feature (508)..(508): n is a, c, g, or t
tcagtcgcactagtcacgaccggtgctcgatttagagtgctacgaagggaaaggggacccaaaaaccacacccctccttgggagaatcccctagatcacagctcctcaccatggactggacctggancactccttttcttggtggtagcagcaacgaggtcgcccactcccaggttcagctggtgcaggtctgggagtctggaggtgaacgacgccgtggggcctcgaggtaggaaggttcctcctggacaaggtcttactcggttacccagttcctacctacctttcgccttacctcgacgtcgtgggtcgaccgaccgtaccggccccgtaggaccgaaggggtccttggtacggtggtacggttcgggtttccgtaactaaccaaaccgaaccgaaactacgtacggaccgtaagtaaacgtccggtagggacaacggtacaccgtactacgtaccgacgtaaccacgtaaccactacgtaccgaaccgacacacgaccctaacncggtaacgtacgtacggactccgacgtcgtacgtaacggtcttaccggaacggaccgtacgacggttacttacggtacttacggtgtacgtacggttacggttcctttcgtacccgtacgtaacgttggtacggttaggtaaccggttaaaacgggttaaacgggtttcgttaacggttcgggaacccgggtacccggaacgggttacccgtacgggtaccctaccggttccctccgtaccgg

SEQ ID NO: 288329 - DNA, 980 bp, Homo sapiens
  misc_feature: GYAE6OF01DJEF5.39.29.C07.1.454.CMB.1.raw
tcagtcgcactagtcacgaccggtgctcgatttagagtgctacgaagggaaagggacccaaaaaccacacccctccttgggagaatcccctagatcacagctcctcaccatggactggacctggacgctattccttttcgtgggtggtagcagcaacgaggtcgcccactccgaggtcagtcgtggtcgctaggttcgtgggacgtcgtagggtaagggtacgaaacgcccggtccggttacggggccttcggtaaggtacggtacggttcctaccgtacggacgtaacggttccgttaccggttaccggttaaccctacgttacccgaacccctttacgttttcggcctttaccgaccgtgggtccggttcggggtacgaccggtaaccggtccggtaccccggttaagggaacccggtaagggtttccgtttagggtacggttacgggtttaacggtttaccggggttacccgttaaacctaaacccgtaaaccggaaaacccgttaaacccgtcggtaaaccgggtaaccccgttaaacggggtaaaccggtttcccgggaaacggggactaaacgggtaaaccgttacccgaacctaccgtaacgggtaaccccaaacgggtacccaaaccgtacaaccgggtaaacccgaacggaaccgaccgtaccgaacggtttaaccaaggtacgtaaccgagacgacgtaaccgtggtaaggtacttaggtaccgaaccggtaaccgtaccggtaacgtttaagtacgtttaaccggttgttacgggaccggtaacggggtttccttaacccggtttaccaaaccggttaaactacgggttaaccgggtagttttaaaccgggggaaaacgttaaaacggggtttaacgggtccgttaacccggtttcccgggggaggtaaccccggggtaaccccggtttcggaccgttaccctttacgggtcccctaaacgggtccccg

SEQ ID NO: 288330 - DNA, 758 bp, Homo sapiens
  misc_feature: GYAE6OF01CA9QV.39.29.C07.1.454.CMB.1.raw
  modified_base (213)..(213): a, c, t, g, unknown or other
  misc_feature (213)..(213): n is a, c, g, or t
  modified_base (333)..(333): a, c, t, g, unknown or other
  misc_feature (333)..(333): n is a, c, g, or t
  modified_base (474)..(474): a, c, t, g, unknown or other
  misc_feature (474)..(474): n is a, c, g, or t
  modified_base (492)..(492): a, c, t, g, unknown or other
  misc_feature (492)..(492): n is a, c, g, or t
  modified_base (608)..(608): a, c, t, g, unknown or other
  misc_feature (608)..(608): n is a, c, g, or t
tcagtcgcactagtcacgaccggtgctcgatttagagtgctacgaagggaaaggggacccaaaaaccacacccctccgttgggagaatcccctagatcacagctcctcaccatggactggacctggagcacttccttttcgttgggtcggtagcagcaaacgtaggtccgcccacctcccgtaggtttcagtcgtggttgcagtcgtggacgngtgagggtagacggaccgccggtggggacctcgtaggtaggtaacggttccttccgtagacgtacggttcgttccgttaccggttacctacgttaccgaacccttccgtttcgaccttcncgtaggtcggttacgggtcgaccgtacgggacccgtaccggtacgggagtaccgggttcgttagggacggtggttacggttcggttaccctacgtaacgaacctaacgaacctcgaccgtaaccgtacggtacggtaccgnggacgagtacacgtaacncgtacgaccaagactacactaccgacgtaccgcgaactaccgaactacgacggacgtaacgcgacgacgtacggagtacgtagttaccgtacgaccgaccgtacgcgttaaggttnttactaacggttcgacgtacgtcgttcctaacgtccctaagtcggtagttaacggtagggaaagttaacggggttaaggtttcgaacggttcgggaaccggggtaccacccgggttccgtagtaccccgtcccgtccgttacgtacccgg

SEQ ID NO: 288331 - DNA, 690 bp, Homo sapiens
  misc_feature: GYAE6OF01BCRO0.39.29.C07.1.454.CMB.1.raw
  modified_base (180)..(180): a, c, t, g, unknown or other
  misc_feature (180)..(180): n is a, c, g, or t
  modified_base (192)..(192): a, c, t, g, unknown or other
  misc_feature (192)..(192): n is a, c, g, or t
  modified_base (560)..(560): a, c, t, g, unknown or other
  misc_feature (560)..(560): n is a, c, g, or t
tcagtcgcactagtcacgaccggtgctcgatttagagtgctacgaagggaaagggacccaaaaaccacaccctccttgggagaatccctagatcacagctcctcaccatggactggacctggagcattcctttcttggtgtagcagcaacgaggtcgccactcccaggttcagctggtcncgtagtctaggngtctaggaggtagagaccgcgtcgggctacgagtacgagttcctctgacgtacgtcttacgtacgtacctgtccactacgttgacctcgtacgacgtcggttcgggcaccggtaccgaccggtacccgtaggaaccggtacggttcgtaggtaacggtggttacggtttcgggtaacctacctaaacgaacctaaaccggtaaccacgtaccgaaccgtaacggtaccgttacggacggactaacggtactaccgaacgtcgaccgaacaacaacgccaactacgaccggaacaacgtcaaccgtactacggaacttaggactacggaataccgacgtaggtacgtagtacgttacgacgtaaccggngtactagtactgtactcggtcgtgtacgttccgtataccgtactagtagtagtaacgaacggttaaggttacgtccgttaagtccggacgtaccgaacggttcccacgacccttacgccgtacgtacccg

SEQ ID NO: 288332 - DNA, 530 bp, Homo sapiens
  misc_feature: GYAE6OF02HM9SR.39.29.C07.1.454.CMB.1.raw
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctggttacccattcaccacctttgctctcagctgggtgcgacaggcccctggacaagggcttgagtggatgggttccgctacacacaaaccatgcccagaagttccagggcagagtcaccatgaccacagacacatccacggacacagcctacatggaactgagcagcctagagattgacgacacggccgtgtattactgtgcgagagagtacgggaaatagtttagactggtacccttgtttcgacttacgtgggccagggaccctggtccaccgtctcctcacgtccc

SEQ ID NO: 288333 - DNA, 553 bp, Homo sapiens
  misc_feature: GYAE6OF02JZC1U.39.29.C07.1.454.CMB.1.raw
  modified_base (501)..(501): a, c, t, g, unknown or other
  misc_feature (501)..(501): n is a, c, g, or t
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctggttacccattcaccacctttgctctcagctgggtgcgacaggcccctggacaagggcttggagtggatgggttccgtctacgaacacgaaaccatgcccagaagttccagggcagagtcacatgacacagacacatccaacggacacgagacctacatagaactgagcagcctagagtacttagacgacgacggcagtgtattactgtgacgtggtctcttcgacctaaactgatggtacgaacgtaaaaggggtttnacgttacgtggggtacctacgggacctggtaccgaccggtcctaccgtaccg

SEQ ID NO: 288334 - DNA, 532 bp, Homo sapiens
  misc_feature: GYAE6OF02JE9XP.39.29.C07.1.454.CMB.1.raw
  modified_base (490)..(490): a, c, t, g, unknown or other
  misc_feature (490)..(490): n is a, c, g, or t
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctggttacccattcaccacctttgctctcagctgggtgcgacaggcccctggacaagggcttgagtggatgggttccgtctacaacacaaaccatgcccagaagttccagggcagagtcaccatgaccacagacacatccacggacacagcctacatggaactgagcagcctgagtattgacgacacggccatgtattactgtgcgaggtctcttcgaccaaactgatggtagaacgtaaaaggggtttnacgttcgtggggccacgggaccctggtccaccggtctccgtc

SEQ ID NO: 288335 - DNA, 550 bp, Homo sapiens
  misc_feature: GYAE6OF02JDX9O.39.29.C07.1.454.CMB.1.raw
  modified_base (320)..(320): a, c, t, g, unknown or other
  misc_feature (320)..(320): n is a, c, g, or t
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctggttacccattcaccacctttgctctcagctgggtgcgacaggcccctggacaagggcttgagtggatgggttccgtntacaacacaaacatgcccagaattccaggcagagtcacatgaccacagacacatcccaggacacacgcctacatggaactgagcagcctgagatttgacgacacggccatgtacttacgtgtcgcgaggtcttccgttcgacctaacgtgagtggtagaacgtaaaaggggtttgacttcggtggggaccgacgggtaacccgtggtaccgaccgttccgtaccgtaccg

SEQ ID NO: 288336 - DNA, 593 bp, Homo sapiens
  misc_feature: GYAE6OF02GROYP.39.29.C07.1.454.CMB.1.raw
tcagtcgcactagtcacgaccggtgctcgatttagagtgctacgaagggaaaggggacccggaaaaaccacacccctccttgggaagaatcccctagatcacacgctcctcacccatggactggacctcggacgccatccttttcttggtggtagcagcgaacaggtgcccactcccaggttcagctggtgcagtctggagctgaggtgaagacgcctggggcctcagtgaaggtctcctgcaaggcttctggttacccattcaccacctttgctctcagctgggtgcgacaggcccctggacaagggcttgagtggatgggttccgtctacaacacaaaccatgcccagaagttccagggcagagtcacatgacacagacacatccacggacacagcctacatcggaactgagcagcctgagtagtttgacgacacggaccatacgtattacgtgtgacgtagtcgttcttcgacctaacgtgagttagggtagtaaccggtaaaaggggtttacggtaaccgtttcggtacggggtaccgtaaccggggtaccccgtacggttacccgacccggttcctacccgtacccgg

SEQ ID NO: 288337 - DNA, 541 bp, Homo sapiens
  misc_feature: GYAE6OF02F0GC1.39.29.C07.1.454.CMB.1.raw
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctggttacccattcaccacctttgctctcagctgggtgcgacaggcccctggacaagggcttgagtggatgggttccgtctacaacacaaaccatgcccagaagttccagggcagagtcaccatgaccacagacacatccacggacacagcctacatgaactgagcagcctgagattgacgacacggccatgtattactgtgcgaggtctctcgccaaactgatggtagaacgtaaaaggggtttgtacgttcgtagggaccgtacgggaacccgtgggtaccgtaccgtcctccgtaccg

SEQ ID NO: 288338 - DNA, 585 bp, Homo sapiens
  misc_feature: GYAE6OF02GXSKL.39.29.C07.1.454.CMB.1.raw
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
  modified_base (373)..(373): a, c, t, g, unknown or other
  misc_feature (373)..(373): n is a, c, g, or t
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctggttacccattccaccacctttgctctcagctgggtncgacncggcccctggacaagggcttgagtggatgggttcctctacaacacaaacatcgcccagaacgttccagggcagagtcacatacgaccanacgacacactccgacggacacagacctacatacgaactgagcagcctgagtattcgacgacgacgctatgtattacgtgtcgacgtggtctccgttacgacctaaacgtgtacgtggtacgtaacggtaaaacggggtttagtacgttacggtacggggtaccgtaacgggtacccgttacgggtaccgtacccggtaccgttcccgtaccg

SEQ ID NO: 288339 - DNA, 600 bp, Homo sapiens
  misc_feature: GYAE6OF02GL7FQ.39.29.C07.1.454.CMB.1.raw
  modified_base (338)..(338): a, c, t, g, unknown or other
  misc_feature (338)..(338): n is a, c, g, or t
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctcggttacccattcaccacctttgctctcagtctgggtgcgacgacggcccctggacgaagggcttgagtggatgggttcctctacaacacaaaccntcgcccagtaacgttccgagggcagacgtcaaccatcgaccaacagaaccacactacccgaacgacaacgacgacctacacgtacggaactagacgacacgaccgtagacgtagttaggaccgaacgacgacctatcgtaattacgtgtacgcgtagtccttctcgactaacgtgagttgtacgaacggttaaagggttcgtacgttcggacgggtaccggacgggtaacccgtcggtaccgtacccgttcgtaccctaccg

SEQ ID NO: 288340 - DNA, 568 bp, Homo sapiens
  misc_feature: GYAE6OF02FRE0R.39.29.C07.1.454.CMB.1.raw
  modified_base (320)..(320): a, c, t, g, unknown or other
  misc_feature (320)..(320): n is a, c, g, or t
  modified_base (334)..(334): a, c, t, g, unknown or other
  misc_feature (334)..(334): n is a, c, g, or t
tcagtcgcactagtcacgaccggtgctcgatttagagtgctacgaagggaaaggggacccaaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctggttacccattcaccacctttgctctcagctgggtgcgacaggcccctggacagggcttgagtggatggggttcctntacaacacaaaccntcgcccagaagttccagggcagagtcaccatgacacagacacactccacggacacagcctaacataggaactgacgcagcctgagtagtttagaccgacgacggcatgtattacgtagtcgcgaggtcttcgttccgacctaaactgagtggtacggtaacgtaaaaggggttcgtaacgttacggtacgggaccgtaacgggtacccgtggtaccgtaccgtccgtcctaccg

SEQ ID NO: 288341 - DNA, 552 bp, Homo sapiens
  misc_feature: GYAE6OF02FX10M.39.29.C07.1.454.CMB.1.raw
  modified_base (279)..(279): a, c, t, g, unknown or other
  misc_feature (279)..(279): n is a, c, g, or t
  modified_base (398)..(398): a, c, t, g, unknown or other
  misc_feature (398)..(398): n is a, c, g, or t
  modified_base (502)..(502): a, c, t, g, unknown or other
  misc_feature (502)..(502): n is a, c, g, or t
  modified_base (538)..(538): a, c, t, g, unknown or other
  misc_feature (538)..(538): n is a, c, g, or t
tcagtcgcactagtcacgaccggtgctcgatttagagtgctacgaagggaaagggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctggttacccattcaccacctttgctctcagctgggtncgacaggcccctggacaagggcttagagtggagtcgggttccgtctacaacacaaaccatcgacccagaagttccagggcagagtcacatcgaccacagacacataccacggacaccanacctacataggaactgagacacgcctagagtagttgacgacgacggccatagtacttactgtgcgagtctctccgactaactgatggtagaacgtaaagggttntaccgtcgtacgggcgtacgggtaccgtacggtacnccggtactcctacg

SEQ ID NO: 288342 - DNA, 659 bp, Homo sapiens
  misc_feature: GYAE6OF02JVA3H.39.29.C07.1.454.CMB.1.raw
  modified_base (397)..(397): a, c, t, g, unknown or other
  misc_feature (397)..(397): n is a, c, g, or t
tcagtcgcactagtcacgaccggtgctcgatttagagtgctacgaagggaaaggggacccaaaaacccaaacccctccttgggagaatcccctagatcacagctcctcaccatggactggacctggagcatccttttcttggtggtagcagcaacaggtgcccactccaggttcagctggtgcagtctggagctgaggtgaagacgccgtggggcctcgagtgaaggtctcctgcgaaggtctcgtcggttacccattccacctacctttgcttctcagcgtgggtgcgacgacggcccctaggggaacaaggggtcttaggagtggagtcgggttccgtactacaacgacaaacagtcgaccagaacgttccgagggcagagtcacagtagaccanagacacactccgaacggaccaacacgaccctaagtacgtaggaaactcggaacgacgaacgtcctagaagtagttacgaaccggtaacgaccgggtaccaagttacgtaagttacgttgacgacggtacggttcctacgtttaccgactaaacgtcgaagtagggtacgtaacggtaaaaggggtttcgtacgttacggttaccgggaaccgtacgggaaccccgtgggttaccctaccggtaccgtacctacggtaacccg

SEQ ID NO: 288343 - DNA, 654 bp, Homo sapiens
  misc_feature: GYAE6OF02HYXH8.39.29.C07.1.454.CMB.1.raw
  modified_base (319)..(319): a, c, t, g, unknown or other
  misc_feature (319)..(319): n is a, c, g, or t
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgccactcccaggttcagctggtgcagtctggagctgaggtgaagacgcctggggcctcgagtgaaggtctcctgcaaggcttctggtaccattcacacctttgctctcagctgggtgcgacacggcccctggacaagggtcttgagtggattcgggttccncgtacaacacaaaccatcgacccagaacgttccgagggcaggagtcaaccatacgaccacacgacacactaccacggacacacgcctacactacggaactgagacacgaccgtgacgtatttacggacgagaccggactagtacgttacttacgttgtacggacggtacggtccgttcgtttccgaacctaaacgttcgagttacgggttaacggtaaacgggtaaaaacgggggttttcggtaacggttaccggtaccgggggtacccggtaaccggggttaaccccggttgggttaaccccgtaccggtttaccccgtacccgttaacccggg

SEQ ID NO: 288344 - DNA, 577 bp, Homo sapiens
  misc_feature: GYAE6OF02JG8BC.39.29.C07.1.454.CMB.1.raw
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctggttacccattcaccacctttgctctcagctgggtgcgacaggcccctggacaagggcttgagtggatgggttcctctacaacaccaaaccatcgcccagtaacgttccagggcagagtcaccatcgaccacagacacactccgacggaccacacgcctacagtacggaactgacgcagcctagacgtatttgaacgacgacggacctatagttattacgtgtagcgtacggttcttcttcgaccaaactgagttggtagaacggttaaaagggtttcgaacgttcgtacggggaccgtaacgggacccgtcggtaccgaccgttcgtccctacg

SEQ ID NO: 288345 - DNA, 672 bp, Homo sapiens
  misc_feature: GYAE6OF02J2JLK.39.29.C07.1.454.CMB.1.raw
  modified_base (281)..(281): a, c, t, g, unknown or other
  misc_feature (281)..(281): n is a, c, g, or t
  modified_base (320)..(320): a, c, t, g, unknown or other
  misc_feature (320)..(320): n is a, c, g, or t
  modified_base (334)..(334): a, c, t, g, unknown or other
  misc_feature (334)..(334): n is a, c, g, or t
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttcgtggttacccattccacctacctttgctctcagctgggtncgacacggcccctggacaagggcttgagtggatggtccntacaacacaaaccntcgcccagtaacgtccgagggcaggacgtccacatcgaacccacacgactacactcccgaacgaccacacgacctacagtacggaaactggaacgccgagtaccgtagacgtaacgtttacggaccggtaaccgaccggccctaagttacgttaacgttaccgtacgggtacgacgggtacggttaccttccgttaccggaaccctaaacgttggtagttacgggtacgtaaaccgggttaaaaggggtttcgaacggtttacggtaccgggggtaaccgtaacggggttaaccccgttagggttacccggtacccgttcccgtacccgttaacccgg

SEQ ID NO: 288346 - DNA, 798 bp, Homo sapiens
  misc_feature: GYAE6OF02H3DTJ.39.29.C07.1.454.CMB.1.raw
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtccgcccactcccaggttcagctggtgcagtctggagctggaggtgaagacgccgtggggcctcgagtgaacggtctccgtgacgaaggtccttcgtacggttaaccctattccgacctacctttgctctcgagtcgtgggtcgcgacgacggcccctaggacgaagggtcttaggaggttcggtaggtttcggggttacccgtacgttaaccaaaccaaccgaaacctagtccgacccgtaaggtaaccgttccggaacgggtaccgaaggtaccgtaccaaccgtagtacgaacccgaacgacgaacaacgtacgtaccgaaccggaacaccgaaccgacctaaccgtagtaacggtaacgtacggacgacgacgtcgtaaggtaacggtttaacgttaacgggaaccgaaccggaacccggtacgtaagttacggtttaacgttacggttcggtaccggtacgggttacgttaccgttaccgtttaaccgaacccgttaaacgttggtaacgttagggtaacggtaaaaccgggtttaaaaggggtttccgttaaccgggttaccgggtaccggggtaacccggtaaccgggttacccggttccggtacccgtaacccggttcccgtaccgtacccgg

SEQ ID NO: 288347 - DNA, 697 bp, Homo sapiens
  misc_feature: GYAE6OF02FY9O1.39.29.C07.1.454.CMB.1.raw
  modified_base (320)..(320): a, c, t, g, unknown or other
  misc_feature (320)..(320): n is a, c, g, or t
  modified_base (333)..(333): a, c, t, g, unknown or other
  misc_feature (333)..(333): n is a, c, g, or t
tcagtcgcactagtcacgaccggtgctcgatttagagtgctacgaagggaaagggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctggttacccattcaccacctttgctctcagctgggtgcgacacggcccctggacaagggcttgagtggatgggttccnctacaacacaacntcgcccagtaacgttccgagggcagacgtcaaccatacggacccaacgacgaaccacactacccgaacggaccaacgacgaccctacacgtacggaactgacgacacggccgtaggacgtactttacggaccgacgacccggaccgtatacgttaacgtttacgtggtacggtaccggttacggttaccttacccgttaccggaacccgttaaacgtcggtaaggttacgggttaacggtaaaccgggtttaaaaagggggtttaccggttaaccggtttacgggtaccgggggtacccggtaaccgggggtaacccccggttaggggttacccgtacccggtttcccgtaccccgttacccgg

SEQ ID NO: 288348 - DNA, 559 bp, Homo sapiens
  misc_feature: GYAE6OF02FZI7P.39.29.C07.1.454.CMB.1.raw
  modified_base (277)..(277): a, c, t, g, unknown or other
  misc_feature (277)..(277): n is a, c, g, or t
  modified_base (320)..(320): a, c, t, g, unknown or other
  misc_feature (320)..(320): n is a, c, g, or t
  modified_base (335)..(335): a, c, t, g, unknown or other
  misc_feature (335)..(335): n is a, c, g, or t
  modified_base (366)..(366): a, c, t, g, unknown or other
  misc_feature (366)..(366): n is a, c, g, or t
  modified_base (447)..(447): a, c, t, g, unknown or other
  misc_feature (447)..(447): n is a, c, g, or t
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctgttacccattcaccacctttgctctcagctgggtncgacacggcccctggacagggcttggagtggatcgggttcctntaacaacacaaaccntcgcccagtacgttccgagggcagagtcacntacgaccacagaccacactaccacggacacacgaccacatagaactgagcacgcctagagtattacgacgacgacgcagtntagttactgtgcgtgtcttctacactaactcgtatcggtagaacggtaaagggttctaacgttcggtcggaccgtaacggtaccgtcggtaccgtaccggtctccgtaccgg

SEQ ID NO: 288349 - DNA, 639 bp, Homo sapiens
  misc_feature: GYAE6OF02GKXP4.39.29.C07.1.454.CMB.1.raw
  modified_base (351)..(351): a, c, t, g, unknown or other
  misc_feature (351)..(351): n is a, c, g, or t
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacacggcccctggacaagggcttgagtggatgggatggatcgagcgacttacagtggtacacacaactangacacgacaacctcgaggcagacgtcacatacgaccacagacacactaccacgacgacacggacctaacagtacggacccgtaggaacggacgccgtaggacgtactccgtaggaaccgaccgaccggtacccggttagttaaccgtttacgtggtacggacggaaggtacggtacggtaacgggggtaaatttcggttttaacggtaccgtttaccgggttaccctttacgtttacggaaccgttacgggtccggggtaacccggtacggggtaaccccttccgggg

SEQ ID NO: 288350 - DNA, 775 bp, Homo sapiens
  misc_feature: GYAE6OF02JUX0M.39.29.C07.1.454.CMB.1.raw
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaacgaccgccgtggggcctcagtgaaggtcctctgcaaggctttacgtggttaccccattccacctaccgtttgcctctacgacgccgtgggtcgccgacgacggcccctggtaccgacgggctttggaggttcggagttcgggttccgacgttaaccaaacctaccgaaaaccgtcgttacgaccccaaggttaaccgttcccgaaggggtccaaggtacggttaccaaccgtacgtcggaaccctacgagtaaccacgtaacgtacccaacgggactaaccgacgaccctaagacgttacggaactacggacgcgaaggtcctaggagttacgtttcggaaccgtaccggaccggacgtacgttaggttaacttaccggttaggtaccggttacggaacggtttcccgttacccgtttaccggtaactaaaccgttcgtaacggttcggtaacggtaaaaccgggttaaaggggttttctaaacccggttacggttaacccgggggacccgtaacggggggtacccccgttagggttacccgtaacccggttccccgttaaccgttacccggg

SEQ ID NO: 288351 - DNA, 706 bp, Homo sapiens
  misc_feature: GYAE6OF02GOZAK.39.29.C07.1.454.CMB.1.raw
  modified_base (148)..(148): a, c, t, g, unknown or other
  misc_feature (148)..(148): n is a, c, g, or t
  modified_base (292)..(292): a, c, t, g, unknown or other
  misc_feature (292)..(292): n is a, c, g, or t
  modified_base (359)..(359): a, c, t, g, unknown or other
  misc_feature (359)..(359): n is a, c, g, or t
tcagtcgcactagtcacgaccggtgctcgatttagagtgctacgaagggaaaggggacccaaaaaaccacacccctccttgggagaatcccctagatcacagctcctcaccatggactggacctggagcatccttttcttggtggtancagcaacaggtgcccactcccaggttcagctggtgcagtctggagctgaggtgaagacgccgtggggcctcagtgaaggttctcctgcaaggtcttctcggttacccattccacctacctttgccttactcacgtcttgggtcncgacgtacggcccctggacgaagggtcttgaggtggagtcgggttccgtctaacaacgaaccaactntcgacccgaagtacgtccgaagggctaagacgtccacacgtacgaacctaacacgaaccacgtaactaccgaaaccggaccaacacggtaccctaacgtacgtaaccggggtaaactcggaacgtccgaacgtccgtacgtaaggttacgtttacgaaacgtacccgaaccggcttaatacggttaacttcgtgtcggtacgtacggttccttaccgtacctaaccgtaaactggtaagttacgggtacggtaaacgggttaaaacggtttggaacccgttagggtaccgggtaacccggtaacgggtacccggttgtaaccccggtccgttaccctcctaacccgg

SEQ ID NO: 288352 - DNA, 648 bp, Homo sapiens
  misc_feature: GYAE6OF02HCMQG.39.29.C07.1.454.CMB.1.raw
  modified_base (375)..(375): a, c, t, g, unknown or other
  misc_feature (375)..(375): n is a, c, g, or t
  modified_base (460)..(460): a, c, t, g, unknown or other
  misc_feature (460)..(460): n is a, c, g, or t
  modified_base (475)..(475): a, c, t, g, unknown or other
  misc_feature (475)..(475): n is a, c, g, or t
  modified_base (484)..(484): a, c, t, g, unknown or other
  misc_feature (484)..(484): n is a, c, g, or t
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgccgtggggcctcgagtgaacggtctccgtgcgaaggtctttcgtacggttacccctattccaccctaccttttgccttctcgagtccgtgggtagcgacgacggtccccaggaccgtaagggccttaggaggtggacgttcgggttccgtctaacaacaaccgaaaccngtcgacccgagtaacgttacgagggtcaagtacgtacactagcaaccgacagtaacacgactcccgaacgtcaacgacgacctanagtacgaactggacncacgcgtanagtgttacgacgacgacgctatgtacttacgcggtgtaccgacggttcttaccgtcgtaacaacgtgtacgtacgggttacaaaccgggtttaaagggttctaccggttcggaccggggtacaaccgggtcgttaccggaccgtcccggttacctctacccggg

SEQ ID NO: 288353 - DNA, 679 bp, Homo sapiens
  misc_feature: GYAE6OF02F6UVZ.39.29.C07.1.454.CMB.1.raw
  modified_base (610)..(610): a, c, t, g, unknown or other
  misc_feature (610)..(610): n is a, c, g, or t
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctggagctggaggtgaagacgccgtggggccctcgaggtgaaggtcctccgtggacaaggtcttacgtcggttacccattccacctacctttgctctacagtcgtgggtcgccgtacaccggcccctaggacgaagggtcttaggaggtggagttcgggttccgtactaacgaaccaacgaaaccagtcgaccagtaacgttccgaagggcagacgtcacgtatcgaaccagacgaacacagtacccgaacggaccacgacgtaccctaacgtacgtaacggaacgtgaacgtaccgacgaccgtagtacgtacgttacggacgtaccgacgtaccagttacgtacgttacgtggtacgacgtacgtccttacgtaccgacgtaacgtagtagttacgggaaggtaaacgttaaacggggtttntaaccggttacggaccgggtaaccgtacgggtaccgtacggtcctacccggttaccgtaccgtacccgg

SEQ ID NO: 288354 - DNA, 580 bp, Homo sapiens
  misc_feature: GYAE6OF02JB7SN.39.29.C07.1.454.CMB.1.raw
  modified_base (282)..(282): a, c, t, g, unknown or other
  misc_feature (282)..(282): n is a, c, g, or t
tcagtcgcactagtcacgaccggtgctcgatttagagtgctacgaagggaaaggggacccaaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgccgtggggcctcgagtgaaggtctcctgcaaggcttctcggttacccattcaccacctttgctctcagctgggtncgacacggcccctggacagggcttggagtggatgggttcctctacaacacaaaccatcgcccagacgttcagggcagagtcacatcgacacagacacatccgacggacacacgcctacatgaactgagcacgcctagagtagtttacgacgacgaccggactagtacgttattacgtgttacgcggtacgttccttcgttccgacctaaacgtgagtggtagaacggtaaaaggggtttgtaacgttcgtcgggtaccgtacgggtacccgttggtccgtaccgttccgtccgtaccg

SEQ ID NO: 288355 - DNA, 715 bp, Homo sapiens
  misc_feature: GYAE6OF02IKU5Q.39.29.C07.1.454.CMB.1.raw
  modified_base (285)..(285): a, c, t, g, unknown or other
  misc_feature (285)..(285): n is a, c, g, or t
  modified_base (481)..(481): a, c, t, g, unknown or other
  misc_feature (481)..(481): n is a, c, g, or t
  modified_base (512)..(512): a, c, t, g, unknown or other
  misc_feature (512)..(512): n is a, c, g, or t
  modified_base (620)..(620): a, c, t, g, unknown or other
  misc_feature (620)..(620): n is a, c, g, or t
tcagtcgcactagtcacgaccggtgctcgatttagagtgctacgaagggaaaggggacccaaaaaccacacccctccttgggagaatcccctagatcacagctcctcaccatggactggacctggagcattccttttcttggtggtagcagcaacaggtcgcccactcccaggttccagctggtgcagtctggagctgaggtgaagcgcgtgggcctcgagtgagtctccgtgacgaggtcttcgtcggtacctatcactacctttgctctcgagtcgtgggtcncgtaccgcggtccccgtaggacgtaacgggtcttacgggaacggttggacgtttccggggttacctaacgtaaaccaaaccgtaaccaaaaactcggtccggaccctaaagggttaccgttacgccgggtactaacggacttaccgaactagtaccgaaacccgaagtaccgaacactacccgtaacgaccggaanacgacgaactaagacgtaggaaactggacgngacgtcctaaggaccgtaagttaccggacctaacgaccggtacctaggtaccttaagttaacccgtgtccggaacgttaccggttccttacgttaccgaacgtaacgngttacgtaggtaacggtaaaccggttaaggttcgtaacgttggaaccggttacgaaccggttacgttccggaccgttccgtacccgtcgtaaccg

SEQ ID NO: 288356 - DNA, 634 bp, Homo sapiens
  misc_feature: GYAE6OF02IM2R4.39.29.C07.1.454.CMB.1.raw
  modified_base (343)..(343): a, c, t, g, unknown or other
  misc_feature (343)..(343): n is a, c, g, or t
  modified_base (375)..(375): a, c, t, g, unknown or other
  misc_feature (375)..(375): n is a, c, g, or t
  modified_base (390)..(390): a, c, t, g, unknown or other
  misc_feature (390)..(390): n is a, c, g, or t
  modified_base (435)..(435): a, c, t, g, unknown or other
  misc_feature (435)..(435): n is a, c, g, or t
  modified_base (490)..(490): a, c, t, g, unknown or other
  misc_feature (490)..(490): n is a, c, g, or t
  modified_base (525)..(525): a, c, t, g, unknown or other
  misc_feature (525)..(525): n is a, c, g, or t
tcagtcgcactagtcacgaccggtgctcgatttagagtgctacgaagggaaagggggacccaaaaaccacacccctccttgggagaatcccctagatcacagctcctcaccatggactggacctggagcatccttttcttggtggtagcagcaacaggtcgcccactcccaggttcagcgtggtgcagtcgtggagcgtgaggtgaagacgcctggggcctcgagtgaaggtctctgacagtcttctcgtacccatcacctacttcgctctcagtcgtgggcgcgacgcggcccctaggacgagggtactggtagtgtagttcggttcgtactacacacaacntcgaccagtaacgtcgaggcaggactacacancgacacgagacaacnctaccgacgaccacgacgactacgacgtacggaacgtcgacgacncgacctaggtacctacgttaaggaccgacgtacgacgtacgtagttaatttacgnggtacgagttacgtcttaccgtacggaccttaagngtaacggttggtaacggtaacggttaaagggttcctaacgggttccggtacggggaccggtaaccgggtaccgttccggtaccggttaccgttaccgtaccgttcccgg

SEQ ID NO: 288357 - DNA, 727 bp, Homo sapiens
  misc_feature: GYAE6OF02HJ1EU.39.29.C07.1.454.CMB.1.raw
  modified_base (192)..(192): a, c, t, g, unknown or other
  misc_feature (192)..(192): n is a, c, g, or t
  modified_base (276)..(276): a, c, t, g, unknown or other
  misc_feature (276)..(276): n is a, c, g, or t
  modified_base (409)..(409): a, c, t, g, unknown or other
  misc_feature (409)..(409): n is a, c, g, or t
tcagtcgcactagtcacgaccggtgctcgatttagagtgctacgaagggaaaggggacccaaaaaccacacccctccttgggagaatcccctagatcacagctcctcaccatggactggacctggagcatccttttcttggtggtagcagcaacaggtgcccactcccaggttcagctggtgcagtctgganctgaggtgaagacgctggggcctcagtgaaggtctcctgcaaggcttcgtcggttacccattccacctacctttgctctcggtntgggtgcgacgacggccccgtggaacgtaagggtcttaggtacgtgggtacgtcgggttccgtactaccaacaaccaaaccatacgacccgtaagaacgttccgaggacaggtataccactactacgaaccanacgaactaacacgtaccgaacgggacaacgacgtacctaacagtacgaaaccgtgaacgcctacgtaccagtaagtacgtttacgaacaccggaccggtccaaggtttctaaactttacgtacgggttcgaccggtcggttaccttcgttaaccgtacctaaaccgtggttacgttaggggtaaccgttaaagggttaaaacgggggtttagtacccggtttaacgggttacccgggggaacccgttaacggggtaaccccggttaacgggtacccggttaacccggtacccgtttaccccgttacgtaacccccggg

SEQ ID NO: 288358 - DNA, 803 bp, Homo sapiens
  misc_feature: GYAE6OF02FOTF0.39.29.C07.1.454.CMB.1.raw
tcagtcgcactagtcacgaccggtgctcgatttagagtgctacgaagggaaaggggacccaaaaaaccacacccctccttgggagaatcccctagatcacagctcctcaccatggactggacctggagcatccttttcttggtgtagcagcaacaggtgcccactcccaggttcagctggtgcagtctggagctgaggtgaagacgccgtggggcctcagtgaaggtctcctgcaaggtcttctcggttacccattccacctacctttgctctcagtcgtgggtgcgacacggccccgtaggacgaagggtccttggacggtgggtacgttcgggggtttaccctacgttaaccgaaaccgtaaaccaaaacccagttacgaccccgaaacggtaaaccggtttacccggaacggggtaccgtaggaaacgttcccgaaacgaacgttaaccgaacccgaaacctaacggaaccaacgaaccgtaaccccggaaccggtaaccaacccgaacgtaccctaaactaacgttaacgggtaaacctaggaaccgacgtacggtaccgttaagtaacgtaacgtttacgaaccggtaaccgaaccgggtcctaagttcgttaagttaaccgttcggtacggtaaccggttaggttccctttaccggttaaccgtaacccgtaaacgttgtaacggttaggtaacggtaaaggttaaaacggggttcgtaccggttaccggtaccggggtaaccgtaccggggtacccgttacgggtacccggtaccgttacctcccgttaaccccgg

SEQ ID NO: 288359 - DNA, 755 bp, Homo sapiens
  misc_feature: GYAE6OF02JNLUD.39.29.C07.1.454.CMB.1.raw
  modified_base (381)..(381): a, c, t, g, unknown or other
  misc_feature (381)..(381): n is a, c, g, or t
  modified_base (498)..(498): a, c, t, g, unknown or other
  misc_feature (498)..(498): n is a, c, g, or t
tcagtcgcactagtcacgaccggtgctcgatttagagtgctacgaagggaaagggggacccaaaaaccacacccctccttgggagaatcccctagatcacagctcctcaccatggactggacctggagcatccttttcttggtggtagcagcaacaggtgcccactcccaggttccagctggtgcagtctggagctgaggtgaaggacgcctcggggacctcgaggtagaacggttctcctggacaacgggtcttcgttcggttaccccattccacctacctttgcttactcaggtcgtgggtgcgacgacgggccccctaggaacgacggtcgttgaggtggagttcgggttcccgtacgtaacaacctaacaaaccgtntaccgcccgaagtaacggttaccgaggtacgacgacgttacccagtacgtaccgaacctacgacgactaattactacccgacggaacacgacgacctacgatacggactagacgtcnggacctagagttacgtcggtaccgtaaccggccgaccgtacgtcgttaaactttacgtacggtacggtacggacggtttccgttaccgtttaccggaaccctaaaacggttcgtaaggttacccggtaagggttaaaaccgttaaaacggggggtttcgttaccggttaacgggttccgggggaaaccgttaaccgggggtaacccccgttgggttaaccccggttaccccggtttaccggtttacccgtaacccgg

SEQ ID NO: 288360 - DNA, 700 bp, Homo sapiens
  misc_feature: GYAE6OF02IKAVZ.39.29.C07.1.454.CMB.1.raw
  modified_base (183)..(183): a, c, t, g, unknown or other
  misc_feature (183)..(183): n is a, c, g, or t
  modified_base (288)..(288): a, c, t, g, unknown or other
  misc_feature (288)..(288): n is a, c, g, or t
  modified_base (319)..(319): a, c, t, g, unknown or other
  misc_feature (319)..(319): n is a, c, g, or t
  modified_base (336)..(336): a, c, t, g, unknown or other
  misc_feature (336)..(336): n is a, c, g, or t
  modified_base (351)..(351): a, c, t, g, unknown or other
  misc_feature (351)..(351): n is a, c, g, or t
tcagtcgcactagtcacgaccggtgctcgatttagagtgctacgaagggaaaggggacccaaaaaaccacacccctccttgggagaatcccctagatcacagctcctcaccatggactggacctggagcatccttttcttggtggtagcagcaacaggtgcccactcccaggttcagctggtncagtctggagctgaggtgaagacgcgtggggcctcgagtgaaggtctccgtgacaggtccttgtcggttaccattccacctacctttgcttctcagtcgtgggtncgacgcggcccctggacgaagggtcttaggngtggagtcgggttaccnctaacaacacaaccntacgccaagtacgttcgacggtcaggtacgtcaaccgtagtaccgacctaacgacgaacctacgactccgaacggaccaccgtacggaccttaagaacggtcgaactacggacgttaccgacgtcgtaaggtagttaaccgtttacggaaccggaacccggtaccgtaacctaggttacgttaaccttacggttaggtcggtaccgtacgggttccgtacccgttacccgaaactaaccgtagtacggtacggttaagtaaaccgggttaaaggtttccaacggtttacggaccgggacccgtaacgggtacccgttaggtacccgtacccgttcctacccgtacccgg

SEQ ID NO: 288361 - DNA, 703 bp, Homo sapiens
  misc_feature: GYAE6OF02IQ440.39.29.C07.1.454.CMB.1.raw
  modified_base (196)..(196): a, c, t, g, unknown or other
  misc_feature (196)..(196): n is a, c, g, or t
  modified_base (474)..(474): a, c, t, g, unknown or other
  misc_feature (474)..(474): n is a, c, g, or t
tcagtcgcactagtcacgaccggtgctcgatttagagtgctacgaagggaaaggggacccaaaaaaccacacccctccttgggagaatcccctagatcacagctcctcaccatggactggacctggagcattcctttttcttggtggtagcagcaacaggtgcccactccctaggttcagctggtgcagtctaggngtctggaggtgaacgacgccgtgggcctcgagtagagtctccgtgacgagtcttcgtcgttacctattcacctacgtttcgctctcgacgcgtgggcgcgaccgacggccccgtaggacggtaagggtcttggaggttacggtaggttccgggttaccggttactaacctaaaccgaaccaaccgacgacggtacccgaagtaacggttacggaacgggtagagtaccaacctagaccgaccgacgaacacaacacgccgaacgacaacacgtaccanacgtacgaactcggaacgacgacgtcgaggtagtacgtttcgaacgacgtaccggtacctaagttcgttactttacggtgttacggtacggtcgttaccgttaccgttaaccgtacgtaaacgttgaacggtagggttacggtaaacggttaaagggtttacgtaccgttacgggacggtaaccgacggttaccgtcggtacccttccggtacctaccgtacaccccgg

SEQ ID NO: 288362 - DNA, 918 bp, Homo sapiens
  misc_feature: GYAE6OF02F34M1.39.29.C07.1.454.CMB.1.raw
tcagtcgcactagtcacgaccggtgctcgatttagagtgctacgaagggaaaggggacccaaaaaaccacacccctccttgggagaatcccctagatcacagctcctcaccgatggactggacctggagcatccttttcttggtggtagcagcaacgaggtcgcccactcccaggttcacgtcgtggtgcgtagtctagggacgtcgtggtaggtgaagccgtccggtcggggcctcgagtaggaacggttcctaccgtggacgaacggtcttcgtacggttaccattaccgaccctacgtttcgtcctctacgtacggtcgttagggtcgaccggtaaccgtaccgggtaccccgtaggggtaaccgtaagggtcccggttttaggacggggtacgggttacggttcggggtttaccccgtaacgttaaacccgaaaccgtaaaaccgtaaacccgtacgtacccggaacccccgtaaagggttaaaccccggttacccggaaaggggtaccctaacggttaaccgtacccgtaaaccgttaccgtaaaccggaaccccgaacgttaaaccggaaacctaccgttaaccccggtaccggaaacggtaaccctaacggtaccgttaccccgtaacggttaacggttaacggaaccgtcgggaaccgtaccgtaaccggttccgtaaaggttaccgttgggttaaccgaccggaacccgtaccggtaactacggtttacgtaacgttacgtagggtccgtacgggttaccgtaccttaccggtaaccgtaaaccgttacggacttacgggttacggaacggttaaaacgggtttaacgggttacgtaccgggttaacggtcggggtaaccgtaccggttacccgtaccggttccggtaaccgtttcccgaccgtacccg

SEQ ID NO: 288363 - DNA, 823 bp, Homo sapiens
  misc_feature: GYAE6OF02JSF3Q.39.29.C07.1.454.CMB.1.raw
tcagtcgcactagtcacgaccggtgctcgatttagagtgctacgaagggaaaggggacccaaaaaccgacacccctccttgggagaatccctagatcacagctcctcaccatggactggacctggagcagtcctttcttggtcggtagtcagtccaacaggtgcccactcccaggttcacgcgtggtgcaggtctaggcgcgtagacggttcgaagtaccgccgtggggtccctgacggttacggaacggttctccgtggacgtaacggtcttcgttacggttacccctagttaccacctacgttttcgaccgttctacgtacggcgtcgggtacgcgaccgtaacggtccccgtaggaccggtaggtccgtggacggttcggacggttcgggtcctagtacaaccgaacctaaccgtagtcaacccgtagtaaccggttcgacgggtcgtaacgtacggttccaaacgtcgtacgaaccctacgacgtaacaacgtaccgacaaccggtacaccgtaccgtactaacgtagtacgaaaccgtgtaaccggtacgtaacgttccggtaagtaacccgttggttaccgaaccgtaacggtacccgttaccgaaattccgggtaaatcccggtttggtaaccgggtacgtaccgggtttaaccttccggtaaaccctaacggttaacgtcgggtttaacgtacgggtaaccggtaacgggttttaaacgggtacccgtttacggttaacccgggcggggtaaacccgttaaccgggttaccggttcccggttaaaccccgtcgggttcccgttaccccggtaagg

SEQ ID NO: 288364 - DNA, 772 bp, Homo sapiens
  misc_feature: GYAE6OF02HCF3O.39.29.C07.1.454.CMB.1.raw
  modified_base (508)..(508): a, c, t, g, unknown or other
  misc_feature (508)..(508): n is a, c, g, or t
tcagtcgcactagtcacgaccggtgctcgatttagagtgctacgaagggaaagggacccaaaaaccacacccctccttgggagaatcccctagatcacgagctcctcaccatggactggacctggagcattccttttcgttggtggtagcagccaaagaggtcgccccaactcccgaggttcacgtcgtggtgcagtcgtggagtctaggaggtagaaacgccggtccggtggggtacctacgaaggttagaaccggtctccgtggacgtaacggtcttacgtcggttaaccctgttacccgaacctaccgtttcgccttctcgtagtcgtgggtacgtcgaccgtacggccccgttaggaacgtaacgggtgttacggaggtaggtaccgttaccggggtaccctacgttaaaccgaaacgtaaaacccgtaacccgttagacccggaccgtaacggttaaccggtaccgggaagggtaaccaacggtacgtaacccgtaaccgtanaaccggtacccaacggaaacgtacccgaactaaccgtacccgaaagggtaccacgaccgtaacccaacttaacggtaacgaaccggtagacgagtaacgctacggaagttacgttaacgaaccgtacgccgtactagtaccgtagtaacgttgcccggtagtacgtccgttacgcggtaaccttaagcgaagtcgggtaaacgaacggttaaggttacgtacgtacggccgacgtaacgccgtgtaccgacgtcctacgtaccg

SEQ ID NO: 288365 - DNA, 166 bp, Homo sapiens
  misc_feature: GYAE6OF01CIXTO.1.14.B03.1.454.CMB.1.raw
  modified_base (166)..(166): a, c, t, g, unknown or other
  misc_feature (166)..(166): n is a, c, g, or t
tcagacgagtgcgtcacgaccggtgctcgatttagtgtgagtagttcgcggggtgttcggcggagggaccaaactgaccgtcctaggtcagcccaaggctgcccctcggtcactctgttcccacctcctctactgctagtctgagcgggctggcaaggcgcatagn

SEQ ID NO: 288366 - DNA, 168 bp, Homo sapiens
  misc_feature: GYAE6OF01ACRZ1.1.14.B03.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtgtgagtagttcgcgggggtgttcggcggagggaccaaactgaccgtcctaggtcagcccaaggctgcccctcggtcactctgttcccaccctcctctactgctagtctgagcgggctggcaaggcgcatagn

SEQ ID NO: 288367 - DNA, 167 bp, Homo sapiens
  misc_feature: GYAE6OF01BMZIS.1.14.B03.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtgtgagtagttcgcggggtgttcggcggagggaccaaactgaccgtcctaggtcagcccaaggctgcccctcggtcactctgttcccaccctcctctactgctagtctgagcgggctggcaaggcgcatagn

SEQ ID NO: 288368 - DNA, 209 bp, Homo sapiens
  misc_feature: GYAE6OF01A0OZZ.1.14.B03.1.454.CMB.1.raw
  modified_base (162)..(209): a, c, t, g, unknown or other
  misc_feature (162)..(209): n is a, c, g, or t
tcagacgagtgcgtcacgaccggtgctcgatttagtgtgagtagttcgcgggtgttcggcggaggaccaactgaccgtcctaggtcagcccaaggctgcccctggtcactctgttcccacctcctctactgctagtctgagcgggctggcaaggcgcatagnnnnnnnnnnnnnnnnnnnnnnnnnnnnnnnnnnnnnnnnnnnnnnnn

SEQ ID NO: 288369 - DNA, 175 bp, Homo sapiens
  misc_feature: GYAE6OF01B9K95.1.14.B03.1.454.CMB.1.raw
  modified_base (167)..(175): a, c, t, g, unknown or other
  misc_feature (167)..(175): n is a, c, g, or t
tcagacgagtgcgtcacgaccggtgctcgatttagtgtgagtagttcgcgggggtgttcggcggagggaccaaactgaccgtcctaggtcagcccaaggctgcccctcggtcactctgttcccacctcctctactgctagtctgagcgggctggcaaggcgcatagnnnnnnnnn

SEQ ID NO: 288370 - DNA, 168 bp, Homo sapiens
  misc_feature: GYAE6OF01C485C.1.14.B03.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtgtgagtagttcgcgggggtgttcggcggagggaccaaactgaccgtcctaggtcagcccaaggctgcccctcggtcactctgttcccgccctcctctactgctagtctgagcgggctggcaaggcgcatagn

SEQ ID NO: 288371 - DNA, 167 bp, Homo sapiens
  misc_feature: GYAE6OF01EIH4N.1.14.B03.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtgtgagtagttcgcgggggtgttcggcggagggaccaaactgaccgtcctaggtcagcccaaggctgcccctcggtcactctgttcccgcctcctctactgctagtctgagcgggctggcaaggcgcatagn

SEQ ID NO: 288372 - DNA, 202 bp, Homo sapiens
  misc_feature: GYAE6OF01EESWO.1.14.B03.1.454.CMB.1.raw
  modified_base (167)..(202): a, c, t, g, unknown or other
  misc_feature (167)..(202): n is a, c, g, or t
tcagacgagtgcgtcacgaccggtgctcgatttagtgtgagtagttcgcgggggtgttcggcggagggaccaaactgaccgtcctaggtcagcccaaggctgcccctcggtcactctgttcccacctcctctactgctagtctgagcgggctggcaaggcgcatagnnnnnnnnnnnnnnnnnnnnnnnnnnnnnnnnnnnn

SEQ ID NO: 288373 - DNA, 168 bp, Homo sapiens
  misc_feature: GYAE6OF01A7RB5.1.14.B03.1.454.CMB.1.raw
  modified_base (168)..(168): a, c, t, g, unknown or other
  misc_feature (168)..(168): n is a, c, g, or t
tcagacgagtgcgtcacgaccggtgctcgatttagtgtgagtagttcggcgggggtgttcggcggaggaccaaactgaccgtcctaggtcagcccaaggctgcccctcggtcactctgttcccaccctcctctactgctagtctgagcgggctggcaaggcgcatagn

SEQ ID NO: 288374 - DNA, 168 bp, Homo sapiens; identical to SEQ ID NO: 288366
  misc_feature: GYAE6OF01DOJLV.1.14.B03.1.454.CMB.1.raw
  modified_base (168)..(168): a, c, t, g, unknown or other
  misc_feature (168)..(168): n is a, c, g, or t

SEQ ID NO: 288375 - DNA, 184 bp, Homo sapiens
  misc_feature: GYAE6OF01D2EGC.1.14.B03.1.454.CMB.1.raw
  modified_base (168)..(184): a, c, t, g, unknown or other
  misc_feature (168)..(184): n is a, c, g, or t
tcagacgagtgcgtcacgaccggtgctcgatttagtgtgagtagttcgcgggggtgttcggcggaggaccaaactgaccgtcctaggtcagcccaaggcctgcccctcggtcactctgttcccgccctcctctactgctagtctgagcgggctggcaaggcgcatagnnnnnnnnnnnnnnnnn

SEQ ID NO: 288376 - DNA, 167 bp, Homo sapiens; identical to SEQ ID NO: 288367
  misc_feature: GYAE6OF01D8259.1.14.B03.1.454.CMB.1.raw
  modified_base (167)..(167): a, c, t, g, unknown or other
  misc_feature (167)..(167): n is a, c, g, or t

SEQ ID NO: 288377 - DNA, 167 bp, Homo sapiens
  misc_feature: GYAE6OF01C3ISC.1.14.B03.1.454.CMB.1.raw
  modified_base (167)..(167): a, c, t, g, unknown or other
  misc_feature (167)..(167): n is a, c, g, or t
tcagacgagtgcgtcacgaccggtgctcgatttagtgtgagtagttcgcgggggtgttcggcggagggaccaaactgaccgtcctaggtcagcccaaggctgcccctcggtcactctgttcccacctcctctactgctagtctgagcgggctggcaaggcgcatagn

SEQ ID NO: 288378 - DNA, 170 bp, Homo sapiens
  misc_feature: GYAE6OF01BAMZX.1.14.B03.1.454.CMB.1.raw
  modified_base (168)..(170): a, c, t, g, unknown or other
  misc_feature (168)..(170): n is a, c, g, or t
tcagacgagtgcgtcacgaccggtgctcgatttagtgtgagtagttcgcgggggtgttcggcggagggaccaaactgaccgtcctaggtcagcccaaggctgcccctcggtcactctgttcccgccctcctctactgctagtctgagcgggctggcaaggcgcatagnnn

SEQ ID NO: 288379 - DNA, 169 bp, Homo sapiens
  misc_feature: GYAE6OF01BUVVZ.1.14.B03.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtgtgagtagttcgcggggggtgttcggcggagggaccaaactgaccgtcctaggtcagcccaaggctgcccctcggtcactctgttcccaccctcctctactgctagtctgagcgggctggcaaggcgcatagn

SEQ ID NO: 288380 - DNA, 192 bp, Homo sapiens
  misc_feature: GYAE6OF01EIC48.1.14.B03.1.454.CMB.1.raw
  modified_base (171)..(171): a, c, t, g, unknown or other
  misc_feature (171)..(171): n is a, c, g, or t
  modified_base (173)..(192): a, c, t, g, unknown or other
  misc_feature (173)..(192): n is a, c, g, or t
tcagacgagtgcgtcacgaccggtgctcgatttagtgtgagtagttcgcggggggtgttcggcggtagggaccaaactgaccgtcctaggtcagcccaaggctgccccctcggtcactctgttcccaccctcctctactgctagtctgagcgggctggcaaggcgcatagncnnnnnnnnnnnnnnnnnnnn

SEQ ID NO: 288381 - DNA, 168 bp, Homo sapiens; identical to SEQ ID NO: 288366
  misc_feature: GYAE6OF01CBKCF.1.14.B03.1.454.CMB.1.raw
  modified_base (168)..(168): a, c, t, g, unknown or other
  misc_feature (168)..(168): n is a, c, g, or t

SEQ ID NO: 288382 - DNA, 168 bp, Homo sapiens; identical to SEQ ID NO: 288370
  misc_feature: GYAE6OF01DQA1I.1.14.B03.1.454.CMB.1.raw
  modified_base (168)..(168): a, c, t, g, unknown or other
  misc_feature (168)..(168): n is a, c, g, or t

SEQ ID NO: 288383 - DNA, 171 bp, Homo sapiens
  misc_feature: GYAE6OF01DYW1U.1.14.B03.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtgtgagtagttcgcggggggtgttcggcggagggaccaaactgaccgtcctaggtcagcccaaggctgccccctcggtcactctgttcccaccctcctccgagcgacgactgagcgggctggcaaggcgcatagnn

SEQ ID NO: 288384 - DNA, 217 bp, Homo sapiens
  misc_feature: GYAE6OF01C6MO7.1.14.B03.1.454.CMB.1.raw
  modified_base (56)..(56): a, c, t, g, unknown or other
  misc_feature (56)..(56): n is a, c, g, or t
  modified_base (159)..(159): a, c, t, g, unknown or other
  misc_feature (159)..(159): n is a, c, g, or t
  modified_base (165)..(217): a, c, t, g, unknown or other
  misc_feature (165)..(217): n is a, c, g, or t
tcagacgagtgcgtcacgaccggtgctcgatttagtgtgagtagttcgcgggggtnttcggcggaggaccaaactgaccgtcctaggtcagcccaaggctgcccctggtcactctgttcccacctcctctactgctagtctgagcgggctggcaaggcncatagnnnnnnnnnnnnnnnnnnnnnnnnnnnnnnnnnnnnnnnnnnnnnnnnnnnnn

SEQ ID NO: 288385 - DNA, 168 bp, Homo sapiens; identical to SEQ ID NO: 288370
  misc_feature: GYAE6OF01A6XTJ.1.14.B03.1.454.CMB.1.raw
  modified_base (168)..(168): a, c, t, g, unknown or other
  misc_feature (168)..(168): n is a, c, g, or t

SEQ ID NO: 288386 - DNA, 260 bp, Homo sapiens
  misc_feature: GYAE6OF01AFB7L.1.14.B03.1.454.CMB.1.raw
  modified_base (258)..(260): a, c, t, g, unknown or other
  misc_feature (258)..(260): n is a, c, g, or t
tcagacgagtgcgtcacgaccggtgctcgatttagtgtgagtagttcgcgggaagatgaagacagatttcactctcaccatcagcagcctacagtctgaagattttgcagtttattactgtcagcagtataataactggcctctcactttcggcggagggaccaaggtggagatcaaacgaactgtggctgcaccatctgtcttcatcttcccgccatctgaactcactcgtctgagcgggctggcaaggcgcatagnnn

SEQ ID NO: 288387 - DNA, 169 bp, Homo sapiens
  misc_feature: GYAE6OF01EQD2Z.1.14.B03.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtgtgagtagttcgcgggggtgttcggcggagggaccaaactgaccgtcctaggtcagcccaaggctgccccctcggtcactctgttcccgcctcctctactgctagtctgagcgggctggcaaggcgcatagnn

SEQ ID NO: 288388 - DNA, 170 bp, Homo sapiens; identical to SEQ ID NO: 288378
  misc_feature: GYAE6OF01CKYMA.1.14.B03.1.454.CMB.1.raw
  modified_base (168)..(170): a, c, t, g, unknown or other
  misc_feature (168)..(170): n is a, c, g, or t

SEQ ID NO: 288389 - DNA, 169 bp, Homo sapiens
  misc_feature: GYAE6OF01ES6TX.1.14.B03.1.454.CMB.1.raw
  modified_base (169)..(169): a, c, t, g, unknown or other
  misc_feature (169)..(169): n is a, c, g, or t
tcagacgagtgcgtcacgaccggtgctcgatttagtgtgagtagttcgcggggggtgttcggcggagggaccaaactgaccgtcctaggtcagcccaaggctgcccctcggtcactctgttcccgccctcctctactgctagtctgagcgggctggcaaggcgcatagn

SEQ ID NO: 288390 - DNA, 227 bp, Homo sapiens
  misc_feature: GYAE6OF01ARMRK.1.14.B03.1.454.CMB.1.raw
  modified_base (166)..(227): a, c, t, g, unknown or other
  misc_feature (166)..(227): n is a, c, g, or t
tcagacgagtgcgtcacgaccggtgctcgatttagtgtgagtagttcgcgggggtgttcggcggagggaccaaactgaccgtcctaggtcagcccaaggctgcccctggtcactctgttcccacctcctctactgctagtctgagcgggctggcaaggcgcatagnnnnnnnnnnnnnnnnnnnnnnnnnnnnnnnnnnnnnnnnnnnnnnnnnnnnnnnnnnnnnn

SEQ ID NO: 288391 - DNA, 169 bp, Homo sapiens
  misc_feature: GYAE6OF01C5AKQ.1.14.B03.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtgtgagtagttcgcggggggtgttcggcggagggaccaaactgaccgtcctaggtcagcccaaggctgcccctcggtcactctgttcccacctcctctactgctagtctgagcgggctggcaaggcgcatagnn

SEQ ID NO: 288392 - DNA, 171 bp, Homo sapiens
  misc_feature: GYAE6OF01CF7EE.1.14.B03.1.454.CMB.1.raw
  modified_base (169)..(171): a, c, t, g, unknown or other
  misc_feature (169)..(171): n is a, c, g, or t
tcagacgagtgcgtcacgaccggtgctcgatttagtgtgagtagttcgcggggggtgttcggcggagggaccaaactgaccgtcctaggtcagcccaaggctgcccctcggtcactctgttcccgccctcctctactgctagtctgagcgggctggcaaggcgcatagnnn

SEQ ID NO: 288393 - DNA, 169 bp, Homo sapiens; identical to SEQ ID NO: 288379
  misc_feature: GYAE6OF01C5CCH.1.14.B03.1.454.CMB.1.raw
  modified_base (169)..(169): a, c, t, g, unknown or other
  misc_feature (169)..(169): n is a, c, g, or t

SEQ ID NO: 288394 - DNA, 725 bp, Homo sapiens
  misc_feature: GYAE6OF01BDIDK.1.14.B03.1.454.CMB.1.raw
  modified_base (181)..(181): a, c, t, g, unknown or other
  misc_feature (181)..(181): n is a, c, g, or t
  modified_base (214)..(215): a, c, t, g, unknown or other
  misc_feature (214)..(215): n is a, c, g, or t
  modified_base (219)..(221): a, c, t, g, unknown or other
  misc_feature (219)..(221): n is a, c, g, or t
  modified_base (229)..(229): a, c, t, g, unknown or other
  misc_feature (229)..(229): n is a, c, g, or t
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
  modified_base (240)..(240): a, c, t, g, unknown or other
  misc_feature (240)..(240): n is a, c, g, or t
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
  modified_base (267)..(267): a, c, t, g, unknown or other
  misc_feature (267)..(267): n is a, c, g, or t
tcagacgagtgcgtcacgaccggtgctcgattttagtgtgagtagtttcggtcggggggggtgttaccggcgggacgggacccggaaacgttggacccgtcctaagggtccacgcccgaaggccctcgcccccctcggtactacttcgtcgttccccaccctcctcctactgctaggtccngaggccggctgggacgaaggtcgcagttcgcgnngtcnnnctcgtgcntntcagagncncgctctagnggcgtcnctgtcagtctntagcgatacactgtcgtagcaggacgacgtacgcgcgcgcgaccgacgacgaccgacgtacgtacgtactagttagtgtacgtacgtacgacgtacgtacgtacgtacggtaaccggtaccgtaccgtaccgtaccgtacggtacggacggtacggtacgtacggtacggtacggtacggtacgtacgtacgtaccgtaccgtaccgaccgtaccgaccgtaccgtaccgtaccgtacccgtaccgtacccgtaccgtaccgtaccgtacgtacgtacgttaccgtacgttacggttacgtacgtacgtacgtacgtaccgtacggtacgtaccgttaccgttaccgttaccgttaccgttaccgttaccgttaccgtaccggtacgtaccgtacgtacggtacggtacggtacggtaccgtaacgtacgtacggtacggtacgacgtacgtacgtcg

SEQ ID NO: 288395 - DNA, 174 bp, Homo sapiens
  misc_feature: GYAE6OF01CXN1D.1.14.B03.1.454.CMB.1.raw
  modified_base (168)..(174): a, c, t, g, unknown or other
  misc_feature (168)..(174): n is a, c, g, or t
tcagacgagtgcgtcacgaccggtgctcgatttagtgtgagtagttcgcgggggggtgttcggcggagggaccaaactgaccgtcctaggtcagcccaaggctgcccctggtcactctgttcccgcctcctctactgctagtctgagcgggctggcaaggcgcatagnnnnnnn

SEQ ID NO: 288396 - DNA, 170 bp, Homo sapiens
  misc_feature: GYAE6OF01EGMO5.1.14.B03.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtgtgagtagttcgcggggggtgttcggcggagggaccaaactgaccgtcctaggtcagcccaaggctgcccctcggtcactctgttcccgccctcctctactgctagtctgagcgggctggcaaggcgcatagnn

SEQ ID NO: 288397 - DNA, 213 bp, Homo sapiens
  misc_feature: GYAE6OF01B4QGE.1.14.B03.1.454.CMB.1.raw
  modified_base (57)..(57): a, c, t, g, unknown or other
  misc_feature (57)..(57): n is a, c, g, or t
  modified_base (162)..(162): a, c, t, g, unknown or other
  misc_feature (162)..(162): n is a, c, g, or t
  modified_base (167)..(213): a, c, t, g, unknown or other
  misc_feature (167)..(213): n is a, c, g, or t
tcagacgagtgcgtcacgaccggtgctcgatttagtgtgagtagttcgcggggggtnttcggcggagggaccaaactgaccgtcctaggtcagcccaaggctgcccctggtcactctgttcccgcctcctctactgcctagtctgagcgggctggcaaggcncatgnnnnnnnnnnnnnnnnnnnnnnnnnnnnnnnnnnnnnnnnnnnnnnn

SEQ ID NO: 288398 - DNA, 170 bp, Homo sapiens
  misc_feature: GYAE6OF01COQR0.1.14.B03.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtgtgagtagttcgcggggggtgttcggcggagggaccaaactgaccgtcctaggtcagcccaaggctgcccctcggtcactctgttcccaccctcctctactgctagtctgagcgggctggcaaggcgcatagnn

SEQ ID NO: 288399 - DNA, 189 bp, Homo sapiens
  misc_feature: GYAE6OF01BGWGU.1.14.B03.1.454.CMB.1.raw
  modified_base (173)..(189): a, c, t, g, unknown or other
  misc_feature (173)..(189): n is a, c, g, or t
tcagacgagtgcgtcacgaccggtgctcgatttagtgtgagtagttcgcgggggggtgttcggcggagggaccaaactgaccgtcctaggtcagcccaaggctgcccctcggtcactctgttcccgccctcctctactgctagtctgagcgggctcggcaagggcgcgatagnnnnnnnnnnnnnnnnn

SEQ ID NO: 288400 - DNA, 169 bp, Homo sapiens
  misc_feature: GYAE6OF01A3OQM.1.14.B03.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtgtgagtagttcgcgggggtgttcggcggagggaccaaactgaccgtcctaggtcagcccaaggctgcccctcggtcactctgttcccaccctcctctactgctagtctgagcgggctggcaaggcgcatagnn

SEQ ID NO: 288401 - DNA, 224 bp, Homo sapiens
  misc_feature: GYAE6OF01DVWTP.1.14.B03.1.454.CMB.1.raw
  modified_base (168)..(224): a, c, t, g, unknown or other
  misc_feature (168)..(224): n is a, c, g, or t
tcagacgagtgcgtcacgaccggtgctcgatttagtgtgagtagttcgcgggggggtgttcggcggagggaccaaactgaccgtcctaggtcagcccaaggctgcccctggtcactctgttcccacctcctctactgctagtctgagcgggctggcaaggcgcatagnnnnnnnnnnnnnnnnnnnnnnnnnnnnnnnnnnnnnnnnnnnnnnnnnnnnnnnnn

SEQ ID NO: 288402 - DNA, 170 bp, Homo sapiens
  misc_feature: GYAE6OF01C86R7.1.14.B03.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtgtgagtagttcgcggggggtgttcggcggagggaccaaactgaccgtcctaggtcagcccaaggctgccccctcggtcactctgttcccaccctcctctactgctagtctgagcgggctggcaaggcgcatagn

SEQ ID NO: 288403 - DNA, 170 bp, Homo sapiens; identical to SEQ ID NO: 288396
  misc_feature: GYAE6OF01BJ1IP.1.14.B03.1.454.CMB.1.raw
  modified_base (169)..(170): a, c, t, g, unknown or other
  misc_feature (169)..(170): n is a, c, g, or t

SEQ ID NO: 288404 - DNA, 174 bp, Homo sapiens
  misc_feature: GYAE6OF01DAAK2.1.14.B03.1.454.CMB.1.raw
  modified_base (170)..(174): a, c, t, g, unknown or other
  misc_feature (170)..(174): n is a, c, g, or t
tcagacgagtgcgtcacgaccggtgctcgatttagtgtgagtagttcgcgggggggtggttcggcggagggaccaaactgaccgtcctaggtcagcccaaggctgcccctcggtcactctgttcccacctcctctactgctagtctgagcgggctggcaaggcgcatagnnnnn

SEQ ID NO: 288405 - DNA, 170 bp, Homo sapiens; identical to SEQ ID NO: 288402
  misc_feature: GYAE6OF01D3DOF.1.14.B03.1.454.CMB.1.raw
  modified_base (170)..(170): a, c, t, g, unknown or other
  misc_feature (170)..(170): n is a, c, g, or t

SEQ ID NO: 288406 - DNA, 173 bp, Homo sapiens
  misc_feature: GYAE6OF01CZFWT.1.14.B03.1.454.CMB.1.raw
  modified_base (171)..(173): a, c, t, g, unknown or other
  misc_feature (171)..(173): n is a, c, g, or t
tcagacgagtgcgtcacgaccggtgctcgatttagtgtgagtagttcgcgggggggtgttcggcggagggaccaaactgaccgtcctaggtcagcccaaggctgccccctcggtcactctgttcccaccctcctctactgctagtctgagcgggctggcaaggcgcatagnnn

SEQ ID NO: 288407 - DNA, 169 bp, Homo sapiens; identical to SEQ ID NO: 288379
  misc_feature: GYAE6OF01CCMDZ.1.14.B03.1.454.CMB.1.raw
  modified_base (169)..(169): a, c, t, g, unknown or other
  misc_feature (169)..(169): n is a, c, g, or t

SEQ ID NO: 288408 - DNA, 171 bp, Homo sapiens
  misc_feature: GYAE6OF01CITVO.1.14.B03.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtgtgagtagttcgcgggggggtgttcggcggagggaccaaactgaccgtcctaggtcagcccaaggctgccccctcggtcactctgttcccgcctcctctactgctagtctgagcgggctggcaaggcgcatagnn

SEQ ID NO: 288409 - DNA, 169 bp, Homo sapiens; identical to SEQ ID NO: 288389
  misc_feature: GYAE6OF01DHS73.1.14.B03.1.454.CMB.1.raw
  modified_base (169)..(169): a, c, t, g, unknown or other
  misc_feature (169)..(169): n is a, c, g, or t

SEQ ID NO: 288410 - DNA, 257 bp, Homo sapiens
  misc_feature: GYAE6OF01DSZM1.1.14.B03.1.454.CMB.1.raw
  modified_base (172)..(176): a, c, t, g, unknown or other
  misc_feature (172)..(176): n is a, c, g, or t
  modified_base (178)..(257): a, c, t, g, unknown or other
  misc_feature (178)..(257): n is a, c, g, or t
tcagacgagtgcgtcacgaccggtgctcgatttagtgtgagtagttcgcgggggggtgttcgggcggagggaccaaactgaccgtcctaggtcacgcccaaggctagccccctggtcactctgttcccacctcctctactgctagtctggacgcgggctggcaggcgcatgnnnnngnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 288411 - DNA, 168 bp, Homo sapiens
  misc_feature: GYAE6OF01DD14J.1.14.B03.1.454.CMB.1.raw
  modified_base (166)..(168): a, c, t, g, unknown or other
  misc_feature (166)..(168): n is a, c, g, or t
tcagacgagtgcgtcacgaccggtgctcgatttagtgtgagtagttcgcgggggtgttcggcggaggaccaaactgaccgtcctaggtcagcccaaggctgcccctcggtcactctgttcccgcctcctctactgctagtctgagcgggctggcaaggcgcatagnnn

SEQ ID NO: 288412 - DNA, 171 bp, Homo sapiens
  misc_feature: GYAE6OF01EOO67.1.14.B03.1.454.CMB.1.raw
  modified_base (171)..(171): a, c, t, g, unknown or other
  misc_feature (171)..(171): n is a, c, g, or t
tcagacgagtgcgtcacgaccggtgctcgatttagtgtgagtagttcgcgggggggtgttcggcggagggaccaaactgaccgtcctaggtcagcccaaggctgccccctcggtcactctgttcccgccctcctctactgctagtctgagcgggctggcaaggcgcatagn

SEQ ID NO: 288413 - DNA, 209 bp, Homo sapiens
  misc_feature: GYAE6OF01ASKSC.1.14.B03.1.454.CMB.1.raw
  modified_base (58)..(58): a, c, t, g, unknown or other
  misc_feature (58)..(58): n is a, c, g, or t
  modified_base (168)..(209): a, c, t, g, unknown or other
  misc_feature (168)..(209): n is a, c, g, or t
tcagacgagtgcgtcacgaccggtgctcgatttagtgtgagtagttcgcgggggggtnttcggcggagggaccaaactgaccgtcctaggtcagcccaaggctgcccctggtcactctgttcccacctcctctactgctagtctgagcgggctggcaaggcgcatagnnnnnnnnnnnnnnnnnnnnnnnnnnnnnnnnnnnnnnnnnn

SEQ ID NO: 288414 - DNA, 262 bp, Homo sapiens
  misc_feature: GYAE6OF01EVRFD.1.14.B03.1.454.CMB.1.raw
  modified_base (258)..(262): a, c, t, g, unknown or other
  misc_feature (258)..(262): n is a, c, g, or t
tcagacgagtgcgtcacgaccggtgctcgatttagtgtgagtagttcgcgggaagatgaagacagatttcactctcaccatcagcagcctacagtctgaagattttgcagtttattactgtcagcagtataataactggcctctcactttcggcggagggaccaaggtggagatcaaacgaactgtggctgcaccatctgtcttcatcttcccgccatctgaacgcactcgtctgagcgggctggcaaggcgcatagnnnnn

SEQ ID NO: 288415 - DNA, 228 bp, Homo sapiens
  misc_feature: GYAE6OF01B7DZ4.1.14.B03.1.454.CMB.1.raw
  modified_base (182)..(228): a, c, t, g, unknown or other
  misc_feature (182)..(228): n is a, c, g, or t
tcagacgagtgcgtcacgaccggtgctcgatttagtgtgagtagttcgtcggggggttgggttcggcgggacgggaccgaaacgtgaccgtacctaggtcgagcccaaggcctgccccctcggtcactcctgttcccaccctccctctactgctagtctgagcgggctggcaaggcgcatgnnnnnnnnnnnnnnnnnnnnnnnnnnnnnnnnnnnnnnnnnnnnnnn

SEQ ID NO: 288416 - DNA, 172 bp, Homo sapiens
  misc_feature: GYAE6OF01AN6PZ.1.14.B03.1.454.CMB.1.raw
  modified_base (170)..(172): a, c, t, g, unknown or other
  misc_feature (170)..(172): n is a, c, g, or t
tcagacgagtgcgtcacgaccggtgctcgatttagtgtgagtagttcgcgggggggtgttcggcggagggaccaaactgaccgtcctaggtcagcccaaggctgccccctggtcactctgttcccaccttcctctactgctagtctgagcgggctggcaaggcgcatagnnn

SEQ ID NO: 288417 - DNA, 170 bp, Homo sapiens
  misc_feature: GYAE6OF01EVMPI.1.14.B03.1.454.CMB.1.raw
tcagacgagtgcgtcacgaccggtgctcgatttagtgtgagtagttcgcgggggggtgttcggcggagggaccaaactgaccgtcctaggtcagcccaaggctgccccctcggtcactctgttcccgccctcctctactgctagtctgagcgggctggcaaggcgcatag

SEQ ID NO: 288418 - DNA, 171 bp, Homo sapiens; identical to SEQ ID NO: 288412
  misc_feature: GYAE6OF01AZE7K.1.14.B03.1.454.CMB.1.raw
  modified_base (171)..(171): a, c, t, g, unknown or other
  misc_feature (171)..(171): n is a, c, g, or t

SEQ ID NO: 288419 - DNA, 242 bp, Homo sapiens
  misc_feature: GYAE6OF01AYRYG.1.14.B03.1.454.CMB.1.raw
  modified_base (169)..(242): a, c, t, g, unknown or other
  misc_feature (169)..(242): n is a, c, g, or t
tcagacgagtgcgtcacgaccggtgctcgatttagtgtgagtagttcgcgggggggtgttcggcggagggaccaaactgaccgtcctaggtcagcccaaggctgccccctggtcactctgttcccacctcctctactgctagtctgagcgggctggcaaggcgcatagnnnnnnnnnnnnnnnnnnnnnnnnnnnnnnnnnnnnnnnnnnnnnnnnnnnnnnnnnnnnnnnnnnnnnnnnnn

SEQ ID NO: 288420 - DNA, 260 bp, Homo sapiens
  misc_feature: GYAE6OF01AX2AK.1.14.B03.1.454.CMB.1.raw
  modified_base (249)..(249): a, c, t, g, unknown or other
  misc_feature (249)..(249): n is a, c, g, or t
  modified_base (255)..(260): a, c, t, g, unknown or other
  misc_feature (255)..(260): n is a, c, g, or t
tcagacgagtgcgtcacgaccggtgctcgatttagtgtgagtagttcgcgggaagatgaagacagatttcactctcaccatcagcagcctacagtctgaagattttgctagtttattactgtcagcagtataataactggcctctcactttcggcggagggaccaaggtgagatcaaacgactgtggctgcaccatctgtcttcatccttcccgcctctcacgcactcgtctgagcggctggcaaggcncatagnnnnnn

SEQ ID NO: 288421 - DNA, 170 bp, Homo sapiens
  misc_feature: GYAE6OF01DXBOO.1.14.B03.1.454.CMB.1.raw
  modified_base (169)..(170): a, c, t, g, unknown or other
  misc_feature (169)..(170): n is a, c, g, or t
tcagacgagtgcgtcacgaccggtgctcgatttagtgtgagtagttcgcgggggggtgttcggcggaggaccaaactgaccgtcctaggtcagcccaaggctgccccctggtcactctgttcccgccctcctctactgctagtctgagcgggctggcaaggcgcatagnn

SEQ ID NO: 288422 - DNA, 174 bp, Homo sapiens
  misc_feature: GYAE6OF01CC5B5.1.14.B03.1.454.CMB.1.raw
  modified_base (171)..(174): a, c, t, g, unknown or other
  misc_feature (171)..(174): n is a, c, g, or t
tcagacgagtgcgtcacgaccggtgctcgatttagtgtgagtagttcgcgggggggtgttcggcggagggaccaaactgaccgtcctaggtcagcccaaggctgccccctcggtcactctgttcccgccctcctctactgctagtctgagcgggctggcaaggcgcatagnnnn

SEQ ID NO: 288423 - DNA, 171 bp, Homo sapiens
  misc_feature: GYAE6OF01CHV3Q.1.14.B03.1.454.CMB.1.raw
  modified_base (169)..(171): a, c, t, g, unknown or other
  misc_feature (169)..(171): n is a, c, g, or t
tcagacgagtgcgtcacgaccggtgctcgatttagtgtgagtagttcgcgggggggtgttcggcggagggaccaaactgaccgtcctaggtcagcccaaggctgcccctcggtcactctgttcccgcctcctctactgctagtctgagcgggctggcaaggcgcatagnnn

SEQ ID NO: 288424 - DNA, 245 bp, Homo sapiens
  misc_feature: GYAE6OF01ANPCC.1.14.B03.1.454.CMB.1.raw
  modified_base (58)..(58): a, c, t, g, unknown or other
  misc_feature (58)..(58): n is a, c, g, or t
  modified_base (132)..(132): a, c, t, g, unknown or other
  misc_feature (132)..(132): n is a, c, g, or t
  modified_base (168)..(245): a, c, t, g, unknown or other
  misc_feature (168)..(245): n is a, c, g, or t
tcagacgagtgcgtcacgaccggtgctcgatttagtgtgagtagttcgcgggggggtnttcggcggagggaccaaactgaccgtcctaggtcagcccaaggctgcccctggtcactctgttcccgcctcctntactgctagtctgagcgggctggcaaggcgcatagnnnnnnnnnnnnnnnnnnnnnnnnnnnnnnnnnnnnnnnnnnnnnnnnnnnnnnnnnnnnnnnnnnnnnnnnnnnnnn

SEQ ID NO: 288425 - DNA, 178 bp, Homo sapiens
  misc_feature: GYAE6OF01D3O1H.1.14.B03.1.454.CMB.1.raw
  modified_base (173)..(178): a, c, t, g, unknown or other
  misc_feature (173)..(178): n is a, c, g, or t
tcagacgagtgcgtcacgaccggtgctcgatttagtgtgagtagttcggcgggggggtgttcggcggagggaccaaactgaccgtcctaggtcagcccaaggctcgcccctcggtcactctcgttcccaccctcctctactgctagtctgagcgggctggcaaggcgcatagnnnnnn

SEQ ID NO: 288426 - DNA, 174 bp, Homo sapiens
  misc_feature: GYAE6OF01BV17P.1.14.B03.1.454.CMB.1.raw
  modified_base (170)..(174): a, c, t, g, unknown or other
  misc_feature (170)..(174): n is a, c, g, or t
tcagacgagtgcgtcacgaccggtgctcgatttagtgtgagtagttcgcgggggggtgttcggcggagggaccaaactgaccgtcctaggtcagcccaaggctgccccctggtcactctgttcccacctcctctactgctagtctggagcgggctggcaaggcgcatagnnnnn

SEQ ID NO: 288427 - DNA, 181 bp, Homo sapiens
  misc_feature: GYAE6OF01DBVYZ.1.14.B03.1.454.CMB.1.raw
  modified_base (174)..(181): a, c, t, g, unknown or other
  misc_feature (174)..(181): n is a, c, g, or t
tcagacgagtgcgtcacgaccggtgctcgatttagtgtgagtagttcgcgggggggtgttcggcggaggaccaaactgaccgtcctaggtcagcccaaggctcgccccctcggtcactctcgttccccgccctcctctactgctagtctgagcgggctggcaaggcgcaatagnnnnnnnn

SEQ ID NO: 288428 - DNA, 183 bp, Homo sapiens
  misc_feature: GYAE6OF01CZ46E.1.14.B03.1.454.CMB.1.raw
  modified_base (58)..(58): a, c, t, g, unknown or other
  misc_feature (58)..(58): n is a, c, g, or t
  modified_base (166)..(166): a, c, t, g, unknown or other
  misc_feature (166)..(166): n is a, c, g, or t
  modified_base (172)..(183): a, c, t, g, unknown or other
  misc_feature (172)..(183): n is a, c, g, or t
tcagacgagtgcgtcacgaccggtgctcgatttagtgtgagtagttcgcgggggggtnttccggcggagggaccaaactgaccgtcctaggtcagcccaaggctgccccctcggtcactctgttcccaccctcctctactgctagtctgagcgggctggcaaggcncatagnnnnnnnnnnnn

SEQ ID NO: 288429 - DNA, 211 bp, Homo sapiens
  misc_feature: GYAE6OF01CB3ED.1.14.B03.1.454.CMB.1.raw
  modified_base (59)..(59): a, c, t, g, unknown or other
  misc_feature (59)..(59): n is a, c, g, or t
  modified_base (155)..(155): a, c, t, g, unknown or other
  misc_feature (155)..(155): n is a, c, g, or t
  modified_base (166)..(166): a, c, t, g, unknown or other
  misc_feature (166)..(166): n is a, c, g, or t
  modified_base (172)..(211): a, c, t, g, unknown or other
  misc_feature (172)..(211): n is a, c, g, or t
tcagacgagtgcgtcacgaccggtgctcgatttagtgtgagtagttcggcgggggggtnttcggcggagggaccaaactgaccgtcctaggtcagcccaaggcctgccccctggtcactctgttcccaccctctctactgctagtctgagcgggntggacaaggcncatagnnnnnnnnnnnnnnnnnnnnnnnnnnnnnnnnnnnnnnnn

SEQ ID NO: 288430 - DNA, 894 bp, Homo sapiens
  misc_feature: GYAE6OF01CWVV5.1.14.B03.1.454.CMB.1.raw
  modified_base (229)..(229): a, c, t, g, unknown or other
  misc_feature (229)..(229): n is a, c, g, or t
  modified_base (728)..(728): a, c, t, g, unknown or other
  misc_feature (728)..(728): n is a, c, g, or t
tcagacgagtgcgtcacgaccggtgctcgatttagtgtgagtagtttagggttaggggggcgcctgggtacggccggggggtcgctgagactcgtcctgtcgccggccctctgggaactttaaggttttaggagttcattgccctacttcgaaacctcgggtccgccgacggccgtcccgagggaaggggtcctgggacgttggggtctcgggcctagttagtcggacngtggtcggcgtctagtagttattagtcgacagcgaccctggaacggccgttacaccgtattaccgagacgaaccaagttccgaaagaaccgacgtcgttagttacttaccttggaacctaagtggtaacgaacgcctacggacgtacgacggaaccgacgacccggtaccgtcttaattctttaggttagttaaacggcggtaacgacgttaagggtaaccgtaccggggtacccggggtacccgtacgtttacggaaccgttacggtcggggtacccgtagggggaccgtacgtccggttacccgaacccggttccgtaccccgtacgtaacccggtcccccgttacccgaacccggtaaccgggtaacccccgttcggtcccgggtttacccccgttccccgtacccgggaccccttacccccgttaccgaccccggaacggtaccgacccggttaaccccgtttacggtccgggggtaacctaaccgccggtaccncccggtacccgttacggccgttaaccggtccgttaaggcccctaaaagggtccctttaacgttacccgttaagttaccccgttagttaaaccgtccgggtataaccggggtcccgttcggttacggaacggtacccggttacgaacccgttaacgcgttccgacgg

SEQ ID NO: 288431 - DNA, 199 bp, Homo sapiens
  misc_feature: GYAE6OF01CSXCX.1.14.B03.1.454.CMB.1.raw
  modified_base (59)..(59): a, c, t, g, unknown or other
  misc_feature (59)..(59): n is a, c, g, or t
  modified_base (128)..(128): a, c, t, g, unknown or other
  misc_feature (128)..(128): n is a, c, g, or t
  modified_base (147)..(147): a, c, t, g, unknown or other
  misc_feature (147)..(147): n is a, c, g, or t
  modified_base (166)..(166): a, c, t, g, unknown or other
  misc_feature (166)..(166): n is a, c, g, or t
  modified_base (169)..(199): a, c, t, g, unknown or other
  misc_feature (169)..(199): n is a, c, g, or t
tcagacgagtgcgtcacgaccggtgctcgatttagtgtgagtagttcggcgggggggtnttcgggcggagggaccaaactgaccgtcctaggtcagcccaaggctcgcccctgtcactctgttccccncctcctctactgctagtcngagcggcctggcaaggcgntannnnnnnnnnnnnnnnnnnnnnnnnnnnnnn

SEQ ID NO: 288432 - DNA, 622 bp, Homo sapiens
  misc_feature: GYAE6OF01DU48O.1.14.B03.1.454.CMB.1.raw
  modified_base (59)..(59): a, c, t, g, unknown or other
  misc_feature (59)..(59): n is a, c, g, or t
  modified_base (196)..(196): a, c, t, g, unknown or other
  misc_feature (196)..(196): n is a, c, g, or t
  modified_base (198)..(198): a, c, t, g, unknown or other
  misc_feature (198)..(198): n is a, c, g, or t
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (267)..(267): a, c, t, g, unknown or other
  misc_feature (267)..(267): n is a, c, g, or t
  modified_base (289)..(289): a, c, t, g, unknown or other
  misc_feature (289)..(289): n is a, c, g, or t
  modified_base (311)..(311): a, c, t, g, unknown or other
  misc_feature (311)..(311): n is a, c, g, or t
  modified_base (313)..(313): a, c, t, g, unknown or other
  misc_feature (313)..(313): n is a, c, g, or t
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
  modified_base (340)..(340): a, c, t, g, unknown or other
  misc_feature (340)..(340): n is a, c, g, or t
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
  modified_base (371)..(371): a, c, t, g, unknown or other
  misc_feature (371)..(371): n is a, c, g, or t
  modified_base (413)..(413): a, c, t, g, unknown or other
  misc_feature (413)..(413): n is a, c, g, or t
  modified_base (451)..(451): a, c, t, g, unknown or other
  misc_feature (451)..(451): n is a, c, g, or t
  modified_base (483)..(483): a, c, t, g, unknown or other
  misc_feature (483)..(483): n is a, c, g, or t
  modified_base (495)..(495): a, c, t, g, unknown or other
  misc_feature (495)..(495): n is a, c, g, or t
  modified_base (530)..(530): a, c, t, g, unknown or other
  misc_feature (530)..(530): n is a, c, g, or t
  modified_base (536)..(536): a, c, t, g, unknown or other
  misc_feature (536)..(536): n is a, c, g, or t
tcagacgagtgcgtcacgaccggtgctcgatttagtgtgagtagttcggcgggggggtnttcggcggacggaccaaactgaccgtcctaggtcagcccaaggctcgccccctgtcactctcgttccccaccctctcctactgcctagtctggacggtcgggtcgtcgggacaacgggtccgtactaacgtggcgtncncgngcagtgacgntacgcctaagccgttanccgagnttcgcagcgtagtcgcgcgtaccgatttcgaanccgttagcctgtcgaacggtcncgtgtcgactgccgttgctcgngntacgcgcttaggccngttacngacgtnccggtanctagacgtgtacngaacgcctaancgttcgcggtcctcggaatttccccgggaatacgcggtttcnccgtagggaaatttcccctagacgtaacgggttacccncggacttcgaaacgcgtagactcgtgtaaccngccgttaacggntccgctaagcggtctaccggagtttcgatcggacncgttancgtgtacgtacgtcgtcgtcggtcgtacaccgtcgtccggtaccggttaccgtcgtaccggtacgttacggtacgtacggtaccgg

SEQ ID NO: 288433 - DNA, 183 bp, Homo sapiens
  misc_feature: GYAE6OF01BJZZG.1.14.B03.1.454.CMB.1.raw
  modified_base (173)..(183): a, c, t, g, unknown or other
  misc_feature (173)..(183): n is a, c, g, or t
tcagacgagtgcgtcacgaccggtgctcgatttagtgtgagtagttcgcgggggggtgttcggcggagggaccaaactgaccgtcctaggtcagcccaaggctgccccctcggtcactctcgttccccgccctcctctactgctagtctgagcgggctggacaggcgcatagnnnnnnnnnnn

SEQ ID NO: 288434 - DNA, 168 bp, Homo sapiens
  misc_feature: GYAE6OF02IAVOX.1.14.B03.1.454.CMB.1.raw
  modified_base (167)..(168): a, c, t, g, unknown or other
  misc_feature (167)..(168): n is a, c, g, or t
tcagacgagtgcgtcacgaccggtgctcgatttagtgtgagtagttcgcggggtgttcggcggagggaccaaactgaccgtcctaggtcagcccaaggctgcccctcggtcactctgttcccgccctcctctactgctagtctgagcgggctggcaaggcgcatagnn

SEQ ID NO: 288435 - DNA, 174 bp, Homo sapiens
  misc_feature: GYAE6OF02ID9SX.1.14.B03.1.454.CMB.1.raw
  modified_base (167)..(174): a, c, t, g, unknown or other
  misc_feature (167)..(174): n is a, c, g, or t
tcagacgagtgcgtcacgaccggtgctcgatttagtgtgagtagttcgcgggggtgttcggcggagggaccaaactgaccgtcctaggttagcccaaggctgcccctcggtcactctgttcccgccctcctctactgctagtctgagcggctggcaaggcgcatagnnnnnnnn

SEQ ID NO: 288436 - DNA, 168 bp, Homo sapiens
  misc_feature: GYAE6OF02IGS55.1.14.B03.1.454.CMB.1.raw
  modified_base (167)..(168): a, c, t, g, unknown or other
  misc_feature (167)..(168): n is a, c, g, or t
tcagacgagtgcgtcacgaccggtgctcgatttagtgtgagtagttcgcgggggtgttcggcggagggaccaaactgaccgtccaggtcagcccaaggctgcccctcggtcactctgttcccaccctcctctactgctagtctgagcgggctggcaaggcgcatagnn

SEQ ID NO: 288437 - DNA, 171 bp, Homo sapiens
  misc_feature: GYAE6OF02I47T6.1.14.B03.1.454.CMB.1.raw
  modified_base (168)..(171): a, c, t, g, unknown or other
  misc_feature (168)..(171): n is a, c, g, or t
tcagacgagtgcgtcacgaccggtgctcgatttagtgtgagtagttcgcgggggtgttcggcggagggaccaaactgaccgtcctaggtcagcccaaggctgcccctcggtcactctgttcccaccctcctctactgctagtctgagcgggctggcaaggcgcatagnnnn

SEQ ID NO: 288438 - DNA, 169 bp, Homo sapiens; identical to SEQ ID NO: 288400
  misc_feature: GYAE6OF02HL646.1.14.B03.1.454.CMB.1.raw
  modified_base (168)..(169): a, c, t, g, unknown or other
  misc_feature (168)..(169): n is a, c, g, or t

SEQ ID NO: 288439 - DNA, 167 bp, Homo sapiens; identical to SEQ ID NO: 288377
  misc_feature: GYAE6OF02H7WTU.1.14.B03.1.454.CMB.1.raw
  modified_base (167)..(167): a, c, t, g, unknown or other
  misc_feature (167)..(167): n is a, c, g, or t

SEQ ID NO: 288440 - DNA, 165 bp, Homo sapiens
  misc_feature: GYAE6OF02ITEGR.1.14.B03.1.454.CMB.1.raw
  modified_base (164)..(165): a, c, t, g, unknown or other
  misc_feature (164)..(165): n is a, c, g, or t
tcagacgagtgcgtcacgaccggtgctcgatttagtgtgagtagttcgcgggtgttcggcggaggaccaaactgaccgtcctaggtcagcccaaggctgcccctcggtcactctgttcccgcctcctctactgctagtctgagcgggctggcaaggcgcatagnn

SEQ ID NO: 288441 - DNA, 168 bp, Homo sapiens; identical to SEQ ID NO: 288370
  misc_feature: GYAE6OF02GLVUV.1.14.B03.1.454.CMB.1.raw
  modified_base (168)..(168): a, c, t, g, unknown or other
  misc_feature (168)..(168): n is a, c, g, or t

SEQ ID NO: 288442 - DNA, 188 bp, Homo sapiens
  misc_feature: GYAE6OF02IKPTS.1.14.B03.1.454.CMB.1.raw
  modified_base (167)..(188): a, c, t, g, unknown or other
  misc_feature (167)..(188): n is a, c, g, or t
tcagacgagtgcgtcacgaccggtgctcgatttagtgtgagtagttcgcgggggtgttcggcggagggaccaaactgaccgtcctaggtcagcccaaggctgcccctcggtcactctgttcccacctcctctactgctagtctgagcgggctggcaaggcgcatagnnnnnnnnnnnnnnnnnnnnnn

SEQ ID NO: 288443 - DNA, 263 bp, Homo sapiens
  misc_feature: GYAE6OF02I0G39.1.14.B03.1.454.CMB.1.raw
  modified_base (258)..(263): a, c, t, g, unknown or other
  misc_feature (258)..(263): n is a, c, g, or t
tcagacgagtgcgtcacgaccggtgctcgatttagtgtgagtagttcgcgggaagatgaagacagatttcactctcaccatcagcagcctacagtctgaagattttgcagtttattactgtcagcagtataataactggcctctcactttcggcggagggaccaaggtggagatcaaacgaactgtggctgcaccatctgtcttcatcttcccgccatctgaacgcactcgtctgagcgggctggcaaggcgcatagnnnnnn

SEQ ID NO: 288444 - DNA, 169 bp, Homo sapiens; identical to SEQ ID NO: 288400
  misc_feature: GYAE6OF02HGILX.1.14.B03.1.454.CMB.1.raw
  modified_base (168)..(169): a, c, t, g, unknown or other
  misc_feature (168)..(169): n is a, c, g, or t

SEQ ID NO: 288445 - DNA, 168 bp, Homo sapiens; identical to SEQ ID NO: 288366
  misc_feature: GYAE6OF02G60U4.1.14.B03.1.454.CMB.1.raw
  modified_base (168)..(168): a, c, t, g, unknown or other
  misc_feature (168)..(168): n is a, c, g, or t

SEQ ID NO: 288446 - DNA, 169 bp, Homo sapiens
  misc_feature: GYAE6OF02GWMER.1.14.B03.1.454.CMB.1.raw
  modified_base (168)..(169): a, c, t, g, unknown or other
  misc_feature (168)..(169): n is a, c, g, or t
tcagacgagtgcgtcacgaccggtgctcgatttagtgtgagtagttcgcggggggtgttcggcggagggaccaaactgaccgtcctaggtcagcccaaggctgcccctcggtcactctgttcccgcctcctctactgctagtctgagcgggctggcaaggcgcatagnn

SEQ ID NO: 288447 - DNA, 169 bp, Homo sapiens; identical to SEQ ID NO: 288389
  misc_feature: GYAE6OF02HZHHF.1.14.B03.1.454.CMB.1.raw
  modified_base (169)..(169): a, c, t, g, unknown or other
  misc_feature (169)..(169): n is a, c, g, or t

SEQ ID NO: 288448 - DNA, 169 bp, Homo sapiens; identical to SEQ ID NO: 288389
  misc_feature: GYAE6OF02FXA9T.1.14.B03.1.454.CMB.1.raw
  modified_base (169)..(169): a, c, t, g, unknown or other
  misc_feature (169)..(169): n is a, c, g, or t

SEQ ID NO: 288449 - DNA, 174 bp, Homo sapiens
  misc_feature: GYAE6OF02FS15E.1.14.B03.1.454.CMB.1.raw
  modified_base (168)..(174): a, c, t, g, unknown or other
  misc_feature (168)..(174): n is a, c, g, or t
tcagacgagtgcgtcacgaccggtgctcgatttagtgtgagtagttcgcggggggtgttcggcggagggaccaaactgaccgtcctaggtcagcccaaggctgcccctcggtcactctgttcccacctcctctactgctagtctgagcgggctggcaaggcgcatagnnnnnnn

SEQ ID NO: 288450 - DNA, 169 bp, Homo sapiens; identical to SEQ ID NO: 288389
  misc_feature: GYAE6OF02GPT5O.1.14.B03.1.454.CMB.1.raw
  modified_base (169)..(169): a, c, t, g, unknown or other
  misc_feature (169)..(169): n is a, c, g, or t

SEQ ID NO: 288451 - DNA, 167 bp, Homo sapiens
  misc_feature: GYAE6OF02HHR7I.1.14.B03.1.454.CMB.1.raw
  modified_base (166)..(167): a, c, t, g, unknown or other
  misc_feature (166)..(167): n is a, c, g, or t
tcagacgagtgcgtcacgaccggtgctcgatttagtgtgagtagttcgcggggtgttcggcggagggaccaaactgaccgtcctaggtcagcccaaggctgcccctcggtcactctgttcccacctcctctactgctagtctgagcgggctggcaaggcgcatagnn

SEQ ID NO: 288452 - DNA, 169 bp, Homo sapiens; identical to SEQ ID NO: 288400
  misc_feature: GYAE6OF02H23TK.1.14.B03.1.454.CMB.1.raw
  modified_base (168)..(169): a, c, t, g, unknown or other
  misc_feature (168)..(169): n is a, c, g, or t

SEQ ID NO: 288453 - DNA, 170 bp, Homo sapiens; identical to SEQ ID NO: 288398
  misc_feature: GYAE6OF02HRUGF.1.14.B03.1.454.CMB.1.raw
  modified_base (169)..(170): a, c, t, g, unknown or other
  misc_feature (169)..(170): n is a, c, g, or t

SEQ ID NO: 288454 - DNA, 222 bp, Homo sapiens
  misc_feature: GYAE6OF02F95VC.1.14.B03.1.454.CMB.1.raw
  modified_base (167)..(222): a, c, t, g, unknown or other
  misc_feature (167)..(222): n is a, c, g, or t
tcagacgagtgcgtcacgaccggtgctcgatttagtgtgagtagttcgcggggttgttcggcggaggaccaaactgaccgtcctaggtcagcccaaggctgccccctggtcactctgttcccacctcctctactgctagtcctgagcgggctggcaaggcgcatagnnnnnnnnnnnnnnnnnnnnnnnnnnnnnnnnnnnnnnnnnnnnnnnnnnnnnnnn

SEQ ID NO: 288455 - DNA, 217 bp, Homo sapiens
  misc_feature: GYAE6OF02GYZK9.1.14.B03.1.454.CMB.1.raw
  modified_base (57)..(57): a, c, t, g, unknown or other
  misc_feature (57)..(57): n is a, c, g, or t
  modified_base (166)..(217): a, c, t, g, unknown or other
  misc_feature (166)..(217): n is a, c, g, or t
tcagacgagtgcgtcacgaccggtgctcgatttagtgtgagtagttcgcggggggtnttcggcggagggaccaaactgaccgtcctaggtcagcccaaggctgcccctggtcactctgttcccgcctcctctactgctagtctgagcgggctggcaggcgcatagnnnnnnnnnnnnnnnnnnnnnnnnnnnnnnnnnnnnnnnnnnnnnnnnnnnn

SEQ ID NO: 288456 - DNA, 225 bp, Homo sapiens
  misc_feature: GYAE6OF02H5JC3.1.14.B03.1.454.CMB.1.raw
  modified_base (59)..(59): a, c, t, g, unknown or other
  misc_feature (59)..(59): n is a, c, g, or t
  modified_base (169)..(170): a, c, t, g, unknown or other
  misc_feature (169)..(170): n is a, c, g, or t
  modified_base (172)..(225): a, c, t, g, unknown or other
  misc_feature (172)..(225): n is a, c, g, or t
tcagacgagtgcgtcacgaccggtgctcgatttagtgtgagtagttcgcggggggggtnttcggcggagggaccaaactgaccgtcctaggtcagcccaaggctgcccctggtcactctgttcccgcctctctactgctagtctggagcgggctggcaaggcgcatagnngnnnnnnnnnnnnnnnnnnnnnnnnnnnnnnnnnnnnnnnnnnnnnnnnnnnnnn

SEQ ID NO: 288457 - DNA, 188 bp, Homo sapiens
  misc_feature: GYAE6OF02HEAVF.1.14.B03.1.454.CMB.1.raw
  modified_base (172)..(188): a, c, t, g, unknown or other
  misc_feature (172)..(188): n is a, c, g, or t
tcagacgagtgcgtcacgaccggtgctcgatttagtgtgagtagttcgcggggggggtgttcggcggagggaccaaactgaccgtcctaggtcagcccaaggctgccccctcggtcactctgttcccaccctcctctactgctagtctgagcgggctggcaaggcgcatagnnnnnnnnnnnnnnnnn

SEQ ID NO: 288458 - DNA, 172 bp, Homo sapiens
  misc_feature: GYAE6OF02GSNLG.1.14.B03.1.454.CMB.1.raw
  modified_base (171)..(172): a, c, t, g, unknown or other
  misc_feature (171)..(172): n is a, c, g, or t
tcagacgagtgcgtcacgaccggtgctcgatttagtgtgagtagttcgcgggggggtgttcggcggagggaccaaactgaccgtcctaggtcagcccaaggctgccccctcggtcactctgttcccgccctcctctactgctagtctgagcgggctggcaaggcgcatagnn

SEQ ID NO: 288459 - DNA, 170 bp, Homo sapiens
  misc_feature: GYAE6OF02ICYBM.1.14.B03.1.454.CMB.1.raw
tcagacgagtgcgtcacgaccggtgctcgatttagtgtgagtagttcgcgggggggtgttcggcggagggaccaaactgaccgtcctaggtcagcccaaggctgccccctcggtcactctgttcccaccctcctctactgctagtctgagcgggctggcaaggcgcatag

SEQ ID NO: 288460 - DNA, 170 bp, Homo sapiens; identical to SEQ ID NO: 288398
  misc_feature: GYAE6OF02GEHHA.1.14.B03.1.454.CMB.1.raw
  modified_base (169)..(170): a, c, t, g, unknown or other
  misc_feature (169)..(170): n is a, c, g, or t

SEQ ID NO: 288461 - DNA, 172 bp, Homo sapiens
  misc_feature: GYAE6OF02G90T1.1.14.B03.1.454.CMB.1.raw
  modified_base (170)..(172): a, c, t, g, unknown or other
  misc_feature (170)..(172): n is a, c, g, or t
tcagacgagtgcgtcacgaccggtgctcgatttagtgtgagtagttcgcggggggtgttcggcggagggaccaaactgaccgtcctaggtcagcccaaggctgccccctcggtcactctgttcccgccctcctctactgctagtctgagcgggctggcaaggcgcatagnnn

SEQ ID NO: 288462 - DNA, 261 bp, Homo sapiens
  misc_feature: GYAE6OF02FWCRK.1.14.B03.1.454.CMB.1.raw
  modified_base (258)..(261): a, c, t, g, unknown or other
  misc_feature (258)..(261): n is a, c, g, or t
tcagacgagtgcgtcacgaccggtgctcgatttagtgtgagtagttcgcgggaagatgaagacagatttcactctcaccatcagcagcctacagtctgaagattttgcagtttattactgtcagcagtataataactggccttggacgtccgaccaagggaccaaggtggatatcaaaggaactgtggctgcaccatctgtcttcatcttcccaccctcctcacgcactcgtctgagcgggctggcaaggcgcatagnnnn

SEQ ID NO: 288463 - DNA, 225 bp, Homo sapiens
  misc_feature: GYAE6OF02IWFTC.1.14.B03.1.454.CMB.1.raw
  modified_base (58)..(58): a, c, t, g, unknown or other
  misc_feature (58)..(58): n is a, c, g, or t
  modified_base (169)..(225): a, c, t, g, unknown or other
  misc_feature (169)..(225): n is a, c, g, or t
tcagacgagtgcgtcacgaccggtgctcgatttagtgtgagtagttcgcgggggggtnttcggcggagggaccaaactgaccgtcctaggtcagcccaaggctgcccctggtcactctgttcccaccctcctctactgctagtctgagcgggctggcaaggcgcatagnnnnnnnnnnnnnnnnnnnnnnnnnnnnnnnnnnnnnnnnnnnnnnnnnnnnnnnnn

SEQ ID NO: 288464 - DNA, 172 bp, Homo sapiens
  misc_feature: GYAE6OF02HGQFP.1.14.B03.1.454.CMB.1.raw
  modified_base (170)..(172): a, c, t, g, unknown or other
  misc_feature (170)..(172): n is a, c, g, or t
tcagacgagtgcgtcacgaccggtgctcgatttagtgtgagtagttcgcggggggtgttcggcggagggaccaaactgaccgtcctaggtcagcccaaggctgccccctcggtcactctgttcccaccctcctctactgctagtctgagcgggctggcaaggcgcatagnnn

SEQ ID NO: 288465 - DNA, 171 bp, Homo sapiens
  misc_feature: GYAE6OF02F2ZD8.1.14.B03.1.454.CMB.1.raw
  modified_base (171)..(171): a, c, t, g, unknown or other
  misc_feature (171)..(171): n is a, c, g, or t
tcagacgagtgcgtcacgaccggtgctcgatttagtgtgagtagttcgcgggggggtgttcggcggagggaccaaactgaccgtcctaggtcagcccaaggctgccccctcggtcactctgttcccaccctcctctactgctagtctgagcgggctggcaaggcgcatagn

SEQ ID NO: 288466 - DNA, 694 bp, Homo sapiens
  misc_feature: GYAE6OF02FNLUT.1.14.B03.1.454.CMB.1.raw
  modified_base (188)..(189): a, c, t, g, unknown or other
  misc_feature (188)..(189): n is a, c, g, or t
  modified_base (192)..(192): a, c, t, g, unknown or other
  misc_feature (192)..(192): n is a, c, g, or t
  modified_base (194)..(194): a, c, t, g, unknown or other
  misc_feature (194)..(194): n is a, c, g, or t
  modified_base (212)..(212): a, c, t, g, unknown or other
  misc_feature (212)..(212): n is a, c, g, or t
  modified_base (216)..(216): a, c, t, g, unknown or other
  misc_feature (216)..(216): n is a, c, g, or t
  modified_base (219)..(219): a, c, t, g, unknown or other
  misc_feature (219)..(219): n is a, c, g, or t
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
tcagacgagtgcgtcacgaccggtgctcgatttagtgtgagtagttcgcgggggggtgggttcggacggagggaccaaactgtaccggtccctaggtcgaacgcccaaggctcgcccctcggtcactctgttcccaccctcctctactgctagtctcgaggacgggctggaccaaggccgcataggcnnagngntgcggtacagctgacagngacncgngcagctccgagtctctctctagtgancncacacacgacgacacgacgacacaccgacgacgtacgtcgtcgtcggtcggtcggtcggtacggacgtacgtacgtctactacctacctacctacgtacgacgacgacgacgtacgacgacgtacgtaacgttacgttacgtacgtacgttagttacgtttacgttacgtacgtacgtacgtaacgttacggttacgttacgtacgttacgttaccgtaccggtaccggtaaccggtaaacggtaaacggtaacggtaaacggtaaacgtaacgtaaacgtaacgtacgtacggtacgtacgtaccgtacgtacgtacgttacgttacgttacttaccgttaccgtaccgtacctacgttacgtacgtacgtacgtacgtacgtacgtacggtacggtacggtacggtacggtacgtacggtacgtacgtacgtagtagtagagacg

SEQ ID NO: 288467 - DNA, 233 bp, Homo sapiens
  misc_feature: GYAE6OF02H662I.1.14.B03.1.454.CMB.1.raw
  modified_base (58)..(58): a, c, t, g, unknown or other
  misc_feature (58)..(58): n is a, c, g, or t
  modified_base (169)..(233): a, c, t, g, unknown or other
  misc_feature (169)..(233): n is a, c, g, or t
tcagacgagtgcgtcacgaccggtgctcgatttagtgtgagtagttcgcgggggggtnttcggcggagggaccaaactgaccgtcctaggtcagcccaaggctgccccctggtcactctgttcccacctcctctactgctagtctgagcgggctggcaaggcgcatagnnnnnnnnnnnnnnnnnnnnnnnnnnnnnnnnnnnnnnnnnnnnnnnnnnnnnnnnnnnnnnnnn

SEQ ID NO: 288468 - DNA, 168 bp, Homo sapiens
  misc_feature: GYAE6OF02HSKGO.1.14.B03.1.454.CMB.1.raw
tcagacgagtgcgtcacgaccggtgctcgatttagtgtgagtagttcgcggggggtgttcggcggagggaccaaactgaccgtcctaggtcagcccaaggctgcccctcggtcactctgttcccaccctcctctactgctagtctgagcgggctggcaaggcgcatag

SEQ ID NO: 288469 - DNA, 173 bp, Homo sapiens
  misc_feature: GYAE6OF02GKM1N.1.14.B03.1.454.CMB.1.raw
  modified_base (170)..(173): a, c, t, g, unknown or other
  misc_feature (170)..(173): n is a, c, g, or t
tcagacgagtgcgtcacgaccggtgctcgatttagtgtgagtagttcgcggggggggtgttcggcggagggaccaaactgaccgtcctaggtcagcccaaggctgcccctcggtcactctgttcccacctcctctactgctagtctgagcgggctggcaaggcgcatagnnnn

SEQ ID NO: 288470 - DNA, 178 bp, Homo sapiens
  misc_feature: GYAE6OF02IIV9C.1.14.B03.1.454.CMB.1.raw
  modified_base (171)..(178): a, c, t, g, unknown or other
  misc_feature (171)..(178): n is a, c, g, or t
tcagacgagtgcgtcacgaccggtgctcgatttagtgtgagtagttcgcggggggggtgttcggcggagggaccaaactgaccgtcctaggtcagcccaaggctgcccctcggtcactctgttcccgccctcctctactgctagtctgagcgggctggcaaggcgcatagnnnnnnnn

SEQ ID NO: 288471 - DNA, 182 bp, Homo sapiens
  misc_feature: GYAE6OF02FYKX4.1.14.B03.1.454.CMB.1.raw
  modified_base (170)..(182): a, c, t, g, unknown or other
  misc_feature (170)..(182): n is a, c, g, or t
tcagacgagtgcgtcacgaccggtgctcgatttagtgtgagtagttcgcgggggggtgttcggcggagggaccaaactgaccgtcctaggtcagcccaaggctgcccctcggtcactctgttcccaccctcctctactgctagtctgagcgggctggcaaggcgcatagnnnnnnnnnnnnn

SEQ ID NO: 288472 - DNA, 566 bp, Homo sapiens
  misc_feature: GYAE6OF02GTUTY.1.14.B03.1.454.CMB.1.raw
  modified_base (564)..(566): a, c, t, g, unknown or other
  misc_feature (564)..(566): n is a, c, g, or t
tcagacgagtgcgtcacgaccggtgctcgatttagtgtgagtagtttgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaaatggagagcctgagactcgacgacacggccgtctattattgtagttaaaggcgagctaggaatacggggaccggggcccgacttgaccacgtggggccagggggacgcgtggtcaccgtctcctcacgcctaccaccgaaacgggcccagtccggtcctttccccctggcccaccctcctaccaacgacgccacctcgtcggggcacgacgcacgtccgtgggctcgccgtggtacaaggactacttaccagtactctatcgtgacgcgggctcggcgaacggcacatagnnn

SEQ ID NO: 288473 - DNA, 170 bp, Homo sapiens
  misc_feature: GYAE6OF02FSS84.1.14.B03.1.454.CMB.1.raw
  modified_base (170)..(170): a, c, t, g, unknown or other
  misc_feature (170)..(170): n is a, c, g, or t
tcagacgagtgcgtcacgaccggtgctcgatttagtgtgagtagttcgcgggggggtgttcggcggagggaccaaactgaccgtcctaggtcagcccaaggctgcccctcggtcactctgttcccgccctcctctactgctagtctgagcgggctggcaaggcgcatagn

SEQ ID NO: 288474 - DNA, 221 bp, Homo sapiens
  misc_feature: GYAE6OF02G10RD.1.14.B03.1.454.CMB.1.raw
  modified_base (48)..(48): a, c, t, g, unknown or other
  misc_feature (48)..(48): n is a, c, g, or t
  modified_base (58)..(58): a, c, t, g, unknown or other
  misc_feature (58)..(58): n is a, c, g, or t
  modified_base (168)..(221): a, c, t, g, unknown or other
  misc_feature (168)..(221): n is a, c, g, or t
tcagacgagtgcgtcacgaccggtgctcgatttagtgtgagtagttcncgggggggtnttcggcggagggaccaaactgaccgtcctaggtcagcccaaggctgcccctggtcactctgttcccacctcctctactgctagtctgagcgggctggcaaggcgcatagnnnnnnnnnnnnnnnnnnnnnnnnnnnnnnnnnnnnnnnnnnnnnnnnnnnnnn

SEQ ID NO: 288475 - DNA, 171 bp, Homo sapiens
  misc_feature: GYAE6OF02I25OF.1.14.B03.1.454.CMB.1.raw
  modified_base (170)..(171): a, c, t, g, unknown or other
  misc_feature (170)..(171): n is a, c, g, or t
tcagacgagtgcgtcacgaccggtgctcgatttagtgtgagtagttcgcggggggtgttcggcggagggaccaaactgaccgtcctaggtcagcccaaggctgccccctcggtcactctgttcccaccctcctctactgctagtctgagcgggctggcaaggcgcatagnn

SEQ ID NO: 288476 - DNA, 171 bp, Homo sapiens; identical to SEQ ID NO: 288408
  misc_feature: GYAE6OF02G4SRA.1.14.B03.1.454.CMB.1.raw
  modified_base (170)..(171): a, c, t, g, unknown or other
  misc_feature (170)..(171): n is a, c, g, or t

SEQ ID NO: 288477 - DNA, 190 bp, Homo sapiens
  misc_feature: GYAE6OF02I5GZH.1.14.B03.1.454.CMB.1.raw
  modified_base (173)..(190): a, c, t, g, unknown or other
  misc_feature (173)..(190): n is a, c, g, or t
tcagacgagtgcgtcacgaccggtgctcgatttagtgtgagtagttcgcgggggggtgttcggggcggagggaccaaactgaccgtcctaggtcagcccaaggctgccccctggtcactctgttcccacccctcctctactgctagtctgagcgggctggcaaggcgcatagnnnnnnnnnnnnnnnnnn

SEQ ID NO: 288478 - DNA, 172 bp, Homo sapiens
  misc_feature: GYAE6OF02GIZL8.1.14.B03.1.454.CMB.1.raw
  modified_base (170)..(172): a, c, t, g, unknown or other
  misc_feature (170)..(172): n is a, c, g, or t
tcagacgagtgcgtcacgaccggtgctcgatttagtgtgagtagttcgcgggggggtgttcggcggagggaccaaactgaccgtcctaggtcagcccaaggctgcccctcggtcactctgttcccaccctcctctactgctagtctgagcgggctggcaaggcgcatagnnn

SEQ ID NO: 288479 - DNA, 172 bp, Homo sapiens; identical to SEQ ID NO: 288458
  misc_feature: GYAE6OF02HCKB1.1.14.B03.1.454.CMB.1.raw
  modified_base (171)..(172): a, c, t, g, unknown or other
  misc_feature (171)..(172): n is a, c, g, or t

SEQ ID NO: 288480 - DNA, 173 bp, Homo sapiens
  misc_feature: GYAE6OF02HR5JG.1.14.B03.1.454.CMB.1.raw
  modified_base (170)..(173): a, c, t, g, unknown or other
  misc_feature (170)..(173): n is a, c, g, or t
tcagacgagtgcgtcacgaccggtgctcgatttagtgtgagtagttcgcgggggggtgttcggcggagggaccaaactgaccgtcctaggtcagcccaaggctgccccctggtcactctgttcccaccctcctctactgctagtctgagcgggctggcaaggcgcatagnnnn

SEQ ID NO: 288481 - DNA, 239 bp, Homo sapiens
  misc_feature: GYAE6OF02IWPAQ.1.14.B03.1.454.CMB.1.raw
  modified_base (180)..(239): a, c, t, g, unknown or other
  misc_feature (180)..(239): n is a, c, g, or t
tcagacgagtgcgtcacgaccggtgctcgatttagtgtgagtagttcgcggggggggttggttcggcggtagggaccaaactgaccgtcctaggtcagcccaaggctgccccctcggtcactctgttcccgaccctcctctactgcttagtctgagcgggctggcaaggcgcataagcannnnnnnnnnnnnnnnnnnnnnnnnnnnnnnnnnnnnnnnnnnnnnnnnnnnnnnnnnnn

SEQ ID NO: 288482 - DNA, 238 bp, Homo sapiens
  misc_feature: GYAE6OF02F4UE6.1.14.B03.1.454.CMB.1.raw
  modified_base (59)..(59): a, c, t, g, unknown or other
  misc_feature (59)..(59): n is a, c, g, or t
  modified_base (168)..(238): a, c, t, g, unknown or other
  misc_feature (168)..(238): n is a, c, g, or t
tcagacgagtgcgtcacgaccggtgctcgatttagtgtgagtagttcgcggggggggtnttcggcggagggaccaaactgaccgtcctaggtcagcccaaggctgcccctggtcactctgttcccgcctctctactgctagtctgagcgggctggcaaggcgcatagnnnnnnnnnnnnnnnnnnnnnnnnnnnnnnnnnnnnnnnnnnnnnnnnnnnnnnnnnnnnnnnnnnnnnnn

SEQ ID NO: 288483 - DNA, 173 bp, Homo sapiens
  misc_feature: GYAE6OF02I9TN6.1.14.B03.1.454.CMB.1.raw
  modified_base (171)..(173): a, c, t, g, unknown or other
  misc_feature (171)..(173): n is a, c, g, or t
tcagacgagtgcgtcacgaccggtgctcgatttagtgtgagtagttcgcgggggggtgttcggcggagggaccaaactgaccgtcctaggtcagcccaaggctgccccctcggtcactctgttcccgccctcctctactgctagtctgagcgggctggcaaggcgcatagnnn

SEQ ID NO: 288484 - DNA, 173 bp, Homo sapiens
  misc_feature: GYAE6OF02G2HD8.1.14.B03.1.454.CMB.1.raw
  modified_base (172)..(173): a, c, t, g, unknown or other
  misc_feature (172)..(173): n is a, c, g, or t
tcagacgagtgcgtcacgaccggtgctcgatttagtgtgagtagttcgcgggggggtgttcggcggagggaccaaactgaccgtcctaggtcagcccaaggctgccccctcggtcactctgttcccaccctcctctactgctagtctgagcgggctgggcaaggcgcatagnn

SEQ ID NO: 288485 - DNA, 230 bp, Homo sapiens
  misc_feature: GYAE6OF02GPJ6R.1.14.B03.1.454.CMB.1.raw
  modified_base (63)..(63): a, c, t, g, unknown or other
  misc_feature (63)..(63): n is a, c, g, or t
  modified_base (181)..(182): a, c, t, g, unknown or other
  misc_feature (181)..(182): n is a, c, g, or t
  modified_base (184)..(230): a, c, t, g, unknown or other
  misc_feature (184)..(230): n is a, c, g, or t
tcagacgagtgcgtcacgaccggtgctcgatttagtgtgagtagtttcggtcgggggggggtnttcggcggagggaccaaactgaccgtcctaggtcagaccccaaggctgccccctcggtcactcctgttccccgccctcctctactgctagtctgagcgggtctggcaaggcgcatagnncnnnnnnnnnnnnnnnnnnnnnnnnnnnnnnnnnnnnnnnnnnnnnnn

SEQ ID NO: 288486 - DNA, 203 bp, Homo sapiens
  misc_feature: GYAE6OF02FL7B4.1.14.B03.1.454.CMB.1.raw
  modified_base (170)..(203): a, c, t, g, unknown or other
  misc_feature (170)..(203): n is a, c, g, or t
tcagacgagtgcgtcacgaccggtgctcgatttagtgtgagtagttcgcgggggggtgttcggcggagggaccaaactgaccgtcctaggtcagcccaaggctgcccctcggtcactctgttcccaccctcctctactgctagtctgagcgggctggcaaggcgcatagnnnnnnnnnnnnnnnnnnnnnnnnnnnnnnnnnn

SEQ ID NO: 288487 - DNA, 189 bp, Homo sapiens
  misc_feature: GYAE6OF02INXMD.1.14.B03.1.454.CMB.1.raw
  modified_base (172)..(189): a, c, t, g, unknown or other
  misc_feature (172)..(189): n is a, c, g, or t
tcagacgagtgcgtcacgaccggtgctcgatttagtgtgagtagttcgcgggggggtgttcggcggagggaccaaactgaccgtcctaggtcagcccaaggctgccccctcggtcactctcgttcccaccctcctctactgctagtctggagcgggctggcaggcgcatagnnnnnnnnnnnnnnnnnn

SEQ ID NO: 288488 - DNA, 185 bp, Homo sapiens
  misc_feature: GYAE6OF02G3AZS.1.14.B03.1.454.CMB.1.raw
  modified_base (170)..(185): a, c, t, g, unknown or other
  misc_feature (170)..(185): n is a, c, g, or t
tcagacgagtgcgtcacgaccggtgctcgatttagtgtgagtagttcgcggggggtgttcggcggagggaccaaactgaccgtcctaggtcagcccaaggctgccccctcggtcactctgttcccaccctcctctactgctagtctgagcgggctggcaaggcgcatagnnnnnnnnnnnnnnnn

SEQ ID NO: 288489 - DNA, 180 bp, Homo sapiens
  misc_feature: GYAE6OF02I07KN.1.14.B03.1.454.CMB.1.raw
  modified_base (169)..(180): a, c, t, g, unknown or other
  misc_feature (169)..(180): n is a, c, g, or t
tcagacgagtgcgtcacgaccggtgctcgatttagtgtgagtagttcgcggggggtgttcggcggagggaccgaaacgtgaccgtcctaggtcagcccaaggctgcccctcggtcactctgttcccacctcctctactgctagtctgagcggctggcaaggcgcatagnnnnnnnnnnnn

SEQ ID NO: 288490 - DNA, 180 bp, Homo sapiens
  misc_feature: GYAE6OF02IPUI8.1.14.B03.1.454.CMB.1.raw
  modified_base (172)..(180): a, c, t, g, unknown or other
  misc_feature (172)..(180): n is a, c, g, or t
tcagacgagtgcgtcacgaccggtgctcgatttagtgtgagtagttcgcgggggggggtgttcggcggagggaccaaactgaccgtcctaggtcagcccaaggctgcccctcggtcactctgttcccaccctcctctactgctagtctgagcgggctggcaaggcgcatagnnnnnnnnn

SEQ ID NO: 288491 - DNA, 685 bp, Homo sapiens
  misc_feature: GYAE6OF02FQ8Q6.1.14.B03.1.454.CMB.1.raw
  modified_base (184)..(184): a, c, t, g, unknown or other
  misc_feature (184)..(184): n is a, c, g, or t
  modified_base (186)..(187): a, c, t, g, unknown or other
  misc_feature (186)..(187): n is a, c, g, or t
  modified_base (191)..(192): a, c, t, g, unknown or other
  misc_feature (191)..(192): n is a, c, g, or t
  modified_base (197)..(197): a, c, t, g, unknown or other
  misc_feature (197)..(197): n is a, c, g, or t
  modified_base (203)..(204): a, c, t, g, unknown or other
  misc_feature (203)..(204): n is a, c, g, or t
  modified_base (206)..(206): a, c, t, g, unknown or other
  misc_feature (206)..(206): n is a, c, g, or t
  modified_base (208)..(208): a, c, t, g, unknown or other
  misc_feature (208)..(208): n is a, c, g, or t
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (221)..(221): a, c, t, g, unknown or other
  misc_feature (221)..(221): n is a, c, g, or t
  modified_base (229)..(229): a, c, t, g, unknown or other
  misc_feature (229)..(229): n is a, c, g, or t
  modified_base (232)..(232): a, c, t, g, unknown or other
  misc_feature (232)..(232): n is a, c, g, or t
  modified_base (235)..(235): a, c, t, g, unknown or other
  misc_feature (235)..(235): n is a, c, g, or t
  modified_base (256)..(256): a, c, t, g, unknown or other
  misc_feature (256)..(256): n is a, c, g, or t
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (398)..(398): a, c, t, g, unknown or other
  misc_feature (398)..(398): n is a, c, g, or t
  modified_base (412)..(412): a, c, t, g, unknown or other
  misc_feature (412)..(412): n is a, c, g, or t
  modified_base (604)..(604): a, c, t, g, unknown or other
  misc_feature (604)..(604): n is a, c, g, or t
tcagacgagtgcgtcacgaccggtgctcgattttagtgtgagtagttccgcgggggggggtgttcggcggagggaccaaactgaccgtcctaggtcagcccaaggctgccccctcggtcactctgttccccgccctcctctactgctagtcctagacgcgggctggcaaaggccgacaatacgntnncgannacatnagacanncncntacnctnacgtanactgtacncgncgntacgatagcgtgactgacgtncctacgtacncggngtacgagtgacccttagtacggtactaccacggttcacgttcgtaaccgccgtacgtaaccgtgtaacccgtaggtacccgtcaggttaccgttcgtaacggacggaaccctcgtaacgaaccgggtntacgttaaaccggnagggtacccggttttcggtaaacttacccgttaacgtcgggttaccctacgggtacccttaagcgtaaccgtaccgttacggtaaccgtacacgtaggtaccggtaccacgtcggtaccggtaccggacgtaccgtaaccgtaccgtaaccgtacgtagaaccgtacgtagaacgaccgccgtaacgacggngtacgagtactacgtacgtacggtaccgggttacggcggtacggaacgtactaccgtacggaaccgacaccggtacgaacg

SEQ ID NO: 288492 - DNA, 503 bp, Homo sapiens
  misc_feature: GYAE6OF01C1GL7.51.81.H04.1.454.CMB.1.raw
  modified_base (218)..(218): a, c, t, g, unknown or other
  misc_feature (218)..(218): n is a, c, g, or t
  modified_base (372)..(372): a, c, t, g, unknown or other
  misc_feature (372)..(372): n is a, c, g, or t
  modified_base (440)..(440): a, c, t, g, unknown or other
  misc_feature (440)..(440): n is a, c, g, or t
  modified_base (496)..(496): a, c, t, g, unknown or other
  misc_feature (496)..(496): n is a, c, g, or t
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaaaccgatatgcttattggtaccagcagaagccgggccaggcccctgtgttggtgatgtaataaagacactgagacggccctcgagggactccctgagcgattctctggctccgaggtcagggacaacggtcacattggcancagtgagtcaggcaggaggacgaggctagactattatgtacaatcaacagacactattggtacttatntcgttcgactgacgacagtcaccgtcgtggtcacgacccgaagcccacccatgccntctcccg

SEQ ID NO: 288493 - DNA, 539 bp, Homo sapiens
  misc_feature: GYAE6OF01EVXEI.51.81.H04.1.454.CMB.1.raw
  modified_base (236)..(236): a, c, t, g, unknown or other
  misc_feature (236)..(236): n is a, c, g, or t
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgntatgcttattggtaccagcagaagccgggccaggccctgtgttggtgatgtataaagacactggagacggccctcgagggactcccctaggagcgtattcctctcggctccgaggtcgaagggacaacggtcacgattcggccatcagtggacgtccaggcgagaggacgaggctagactattattgtacaatcaacagacaacattaggtacttatcgtcgttacggaactgcgaaccgaaggtccaccgtcgtgggtacacgacccgaagaccccaacccactacgctaccgtcgttcccg

SEQ ID NO: 288494 - DNA, 747 bp, Homo sapiens
  misc_feature: GYAE6OF01DC2QF.51.81.H04.1.454.CMB.1.raw
  modified_base (233)..(233): a, c, t, g, unknown or other
  misc_feature (233)..(233): n is a, c, g, or t
tcagcgatcgtatacacgaccggtgctcgatttagtagtgtagattcgcgggggtgggtccaggaggcagaactctgggtgtctcaccatggcctggatccctctacttctccccctctcactctctgcacaggctctgaggcctcctatgagctgacacagccaccctcggtgtcagtcgtccccaggacagacgccaggatcacctgctctggagatgcattgccaaacgntatgcttattggtacagcagaacgccggcacggcccctgtgttggtgtatagtaataaagacacgtgagacggcccgtcgagggactccgtgacgcgtattctcgtggcctacgacggtcgaacgggaaccgaaccggtcaacgtagtttacggacctagtaccgagggttcggacgtacccggaagggaccgaaagggaacgggaacggtagggaccgttacggttaaccgtttaagttttagttacggtaacctaaacttaccgaaaacgtaccgtaaccgtaaacccgttaaggttttaacgggtttaaccttttaagtttacggtttacccggttaaccgggtaaaccgttacggaacccggtaaacccggtaacgggtaccccgttacccgggttacccggttaccggggttacccgaaccccgggaaaccccggtaaacccgggacccccgtaaaaccccccgtacgtttacccgttacccctaaccgtttccccggtttaacccccc

SEQ ID NO: 288495 - DNA, 668 bp, Homo sapiens
  misc_feature: GYAE6OF01ACP7E.51.81.H04.1.454.CMB.1.raw
  modified_base (235)..(235): a, c, t, g, unknown or other
  misc_feature (235)..(235): n is a, c, g, or t
  modified_base (281)..(281): a, c, t, g, unknown or other
  misc_feature (281)..(281): n is a, c, g, or t
tcagcgatcgtatacacgaccggtgctcgatttagtagtgtagattcgcgggggtgggtccaggaggcagaactctgggtgtctcaccatggcctggatccctctacttctcccctctcactctctgcacaggctctgaggcctctatgagctgacacagccaccctcggtgtcagtcgtccccaggacagacggccaggatcacctgctctggagatgcattcgaccaaaccgntatgcttatggtaccagcagaacgccggccacggccctgtgtggtnatgtaataaagcacgtgagacggccctacgagggactcccgtagacgtcgtaacttccgtcgtcggcctaccggaaggttaccggaacgggaacctaaaccgggttccaacgtagtttacggacctagtaccgtaagggttcgggaacgtacccggaagggacgaaacgggaacgggaacggaacgggtacctacgggtaacctttaagtttaacgttacggtaacctaaacttacgaaacgtacgtaacgtaacccgttagttacgggttaactttagttacgttaccgttaaccggacgtacggaccgtaaccgtaacggtcctaccggtcgtacggtaccacgtacccgaacgccccaaccctctacgtcctctccgttacccg

SEQ ID NO: 288496 - DNA, 705 bp, Homo sapiens
  misc_feature: GYAE6OF01DUFJX.51.81.H04.1.454.CMB.1.raw
  modified_base (689)..(689): a, c, t, g, unknown or other
  misc_feature (689)..(689): n is a, c, g, or t
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacacgccacccgtggtgtcagtcgtccccaggacagacggccaggatcacctgctcgtgggagtatgcattcgaccaaacgatatgtacttagttcggtaccagacgaaggaacggcccgggccacggtcccctggttacggttgggtagtaagttacggttaaaataaaacggacctaacgtaggaacggtaccggccctacggaacgggtactcccgtagaacgtcgtattccgtcgtcggctacggaggtcgaagggaacgtaacggtacacgtagttccggacctagtacgaggtacgggtacgtaccggaagggacgaagggaacgggacgacgggtactagtaactttaagtttacgttacgtaacctaactaccgaacgtaacgtaaccgtaaccgttaagtttacggttaactttagttacgttacggttaacgacgtacgaccgtaacgtacggtaccgtacccggttcggtacgggtccaacggaaccccgaccggaacccctaccctacgtagtacccnccgttcgttacccccg

SEQ ID NO: 288497 - DNA, 679 bp, Homo sapiens
  misc_feature: GYAE6OF01E1RP7.51.81.H04.1.454.CMB.1.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggcaggcccctgtgttggtgatgtataaagacacgtgagacggccctcgagggactcccgtgagcgattcctcgtggctccgaggtcagggaacaacggtcaacagttcggcctatcagtggacgtccgaggcaggaggacgaggtcagaactattagttcgtactaatacgaacagaaccaaccgtaagtttacgggtaactttagtacgtttaccgtttacgggaaaccgttcggtaacccgtaaaccggtaaaacgggttacccgtaaaccccgggtttcccgggttacccggggttaccgaaacccggttaaccccccggaaaaacccggggtacccccctaaaaacccccccggtaactttacccggttaccccgtttaaaccccgttttccccggttttaacccccccccgg

SEQ ID NO: 288498 - DNA, 636 bp, Homo sapiens
  misc_feature: GYAE6OF01CUC0Z.51.81.H04.1.454.CMB.1.raw
  modified_base (614)..(614): a, c, t, g, unknown or other
  misc_feature (614)..(614): n is a, c, g, or t
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgctattcgaccaaaaccgatatgtacttattcggtaaccagcaagaacggcccgggccacggccctgtggttggtgatgtaataaagacacgtgaacgacggccctacgaagggtactcccgtagacggtcgtacgtttctcgtcggtcctccgaagggtaccgaagggtaacccgaacggttaccacgtaagttcggacctaagttcgagggtcggaacgttaccgagggacgaagggacgggacgaggcgtagaacttatttattgtacaatcaactagaacctactaattacggttaacttagttcgttaccgttacggacttccggaacgtaaccgtaacggtcacccggtcgtggtaccaaccgacccgaaccggcccaaaccccgntacgtccaccttcgttaccccg

SEQ ID NO: 288499 - DNA, 595 bp, Homo sapiens
  misc_feature: GYAE6OF01CX48M.51.81.H04.1.454.CMB.1.raw
  modified_base (239)..(239): a, c, t, g, unknown or other
  misc_feature (239)..(239): n is a, c, g, or t
  modified_base (299)..(299): a, c, t, g, unknown or other
  misc_feature (299)..(299): n is a, c, g, or t
  modified_base (583)..(583): a, c, t, g, unknown or other
  misc_feature (583)..(583): n is a, c, g, or t
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcattcgaccaaaccgntatgtcttagttcggtaccagcagaacggccggaccacggccctgtgtggtgatagtaanaagacacgtagacgacggccctacgacgggtactcccgtagacgcgtacttctcgtcggctacgaggtcgacgggaactaacggtcagtacgtcgacctacgtagtaggtacggacgtccgagggtacgagggacgggacgagggtcgtagactttagtttagtacgtaacaacgttacaaacacgaactacgtaagtttacgtacttagtcgttacgtacgactcgacgaccgtacgtctaccgtcgtaggcaccgcccgacgaccctaacccgcttagtccnccgtcgtacccc

SEQ ID NO: 288500 - DNA, 751 bp, Homo sapiens
  misc_feature: GYAE6OF01A7BFR.51.81.H04.1.454.CMB.1.raw
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (241)..(241): a, c, t, g, unknown or other
  misc_feature (241)..(241): n is a, c, g, or t
  modified_base (510)..(510): a, c, t, g, unknown or other
  misc_feature (510)..(510): n is a, c, g, or t
  modified_base (561)..(561): a, c, t, g, unknown or other
  misc_feature (561)..(561): n is a, c, g, or t
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctctatgagctgacacacgccaccctcggtgtcagtcgtcccaggacagaccggcaggntcactgctcgtgganatgctagttcgaccaaaaccgtntaagtgtctttaagtggtaaccgagtacgaaggaacggcccgggaccgtaaccggtccccgttggttggtttcggtaggtagttaaggttaaattaaaacgaccgtaacgtacggacgtacggtaccccgtaggaacgggtactaccccgtaggaccgtacggttacttccgtcgtacggtccttacggaacggttacgaacgggaacttaacggactaacgtagttacggaccctagtacggtcgttagggacgttaccggcgggtanaaggggtacgacgggacggtactacggttaacttaagtttagtaccgttanaaacccgttacgaaacgactaacgaccggtttaatttacgggtactttaacgttccgttacgttaaccggacgttccgaccggtaacgtaaccggtcgttaaacccggttcggtaaccgttcgaaccccggacccggtaacggaacccccttaaacccgagttacccgtctaccccgttacgttcccccg

SEQ ID NO: 288501 - DNA, 781 bp, Homo sapiens
  misc_feature: GYAE6OF01B21R1.51.81.H04.1.454.CMB.1.raw
  modified_base (207)..(207): a, c, t, g, unknown or other
  misc_feature (207)..(207): n is a, c, g, or t
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccacccgtggtgtcagtcgtccccgaggacaggacggccaggntccacctgctcgtgganatgactagtcgaccaaaccgnttacgtgtaccttagttcggtaaccaggtaccgaaggaaccggcccggggacccgtaaccggggtcccccttagggttcgggtttagggtacgtaagttagttaaagtaaaacggacctaccgtaggaacggaaccggtccccgtaggaacgggtactccccggtagacgtcgtacttctcgtcgctaccgtaggtacgacggaacgtacggtcaacgtacggttcgaccgtatcgaaggtggaccgtccgaaggaccgtaggacgggaccgtagggacgtacgtaacttaagtttagtacgtacaacgtaacaaccgaacgtaccgtaacgttaggtttaacggttaccttttagttacggttaccgtttaacggtacgtacggtacccggtaaaccgtaaaccgggttccccgtaacccggtttacccgggtaggggttaacccccggaccggtaaacccccgtaaacccggggtaaccccctaaaccccgttccgttacccggttaccctaccgtttcccgttaccccccggg

SEQ ID NO: 288502 - DNA, 567 bp, Homo sapiens
  misc_feature: GYAE6OF01BR8P0.51.81.H04.1.454.CMB.1.raw
  modified_base (545)..(545): a, c, t, g, unknown or other
  misc_feature (545)..(545): n is a, c, g, or t
  modified_base (553)..(553): a, c, t, g, unknown or other
  misc_feature (553)..(553): n is a, c, g, or t
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaacgccgggccacggcccctgtggttggtgatgtaataaagacactgagacggccctcgagggactcccgtgacgcgtattctcgtggctccgaggtcgagggacaacggtcacgtagttcggctatcgaggtggacgtccgaggcaggaggacgaggctgacttagttattgtacaatcaaacagacaactagttggttaacttagttcgttcgttacggacttgaccgaaccgtaacggtccgacccggttcgtacggtcacggcccgaacggaccccaaccccgntacgtccncgtccgttacccgg

SEQ ID NO: 288503 - DNA, 964 bp, Homo sapiens
  misc_feature: GYAE6OF01BCU4E.51.81.H04.1.454.CMB.1.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgacggcctcctatgagctgacacacgccacccgtcggtgtcagtcgtccccgaggacacggaccggccgaggactccgacctgcctcgtgggagatgctagttccgaacccaaaccgattagtcgtactttagttcggtaaccaggacgaacggaaccgggcccgggaccgaccgggtccccgttgggttcgggtttggtacggttaagtaggttaaacgtaaaacggtacccgtacggttacggaaccggtaccggtaccccgtacggaacgggtaccttaccccggtaggaccggtaccgtacgttccgttacggtccggtcccgttaaccggtacggtaccgggtaacgggtaaccgtaaccggtactaacgtacgttacggacccgtagttaccggtaaggggttcggaccggttaaccggaacgggacgaaacggggtaacgggtaaccggtacgggtacgttaaccggttaacgttttaaacgttttacggttactaaacccggttaacgtaaaccctaaacccggtaaccgtaacccgttaaaccggtttaaccgttttaacgggttttaacccttttaaggtttacccgggttttaaccccggttaacgggtaacccggttaaccggtaaacccgggtaaaaccccggttacccgggttaaccccgttaaccccgggggttacccggttaccggggtaccccgtaaaaccccccggggtaaccccggtaaacccccggtaaacccccccgttaaaccccccgtacgggtttaaccccgttaccccttaccccggttttcccggtttaccccccccgg

SEQ ID NO: 288504 - DNA, 168 bp, Homo sapiens
  misc_feature: GYAE6OF02G65OZ.51.81.H04.1.454.CMB.1.raw
  modified_base (156)..(168): a, c, t, g, unknown or other
  misc_feature (156)..(168): n is a, c, g, or t
tcagcgatcgtatacacgaccggtgctcgatttagtagtgtagattcgcgggcacgaccggtgctcgatttagctgtgcgtcgaagggaaagggcagcgtcactctgttcccacctcctctcgtagcactctgagcgggctggcaaggcgcatagnnnnnnnnnnnnn

SEQ ID NO: 288505 - DNA, 498 bp, Homo sapiens
  misc_feature: GYAE6OF02F8CFU.51.81.H04.1.454.CMB.1.raw
tcagcgatcgtatacacgaccggtgctcgatttagtagtgtagattcgcgggggtgggtccaggaggcagaactctgggtgtctcaccatgacctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgttcttacgactgcgacagtccacgtctggtcacgcccaaggcccaacccactgtcactctccg

SEQ ID NO: 288506 - DNA, 565 bp, Homo sapiens
  misc_feature: GYAE6OF02FS50A.51.81.H04.1.454.CMB.1.raw
  modified_base (218)..(218): a, c, t, g, unknown or other
  misc_feature (218)..(218): n is a, c, g, or t
  modified_base (235)..(235): a, c, t, g, unknown or other
  misc_feature (235)..(235): n is a, c, g, or t
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaaccgntatgcttattgtaccagcagaagccggccaggcccctgtgttggtgatgtataaagacactgagaggccctcgagggatccctggacgcgtattctctggctccaggtcagggacaacgggtcacgattggaccatcagtggagtccaggcaggaggaccgaggctggacttattatgtacaatcaacagacaccagttggtaactttagtcgttcttacggaacttgaccgtaaccgaggtccaacccggttccgtaggggtcctaacggcccccgaaagggtcccccaaacccccgtacgttccggtacctaaccgttccttaccccg

SEQ ID NO: 288507 - DNA, 504 bp, Homo sapiens
  misc_feature: GYAE6OF02I4Z8U.51.81.H04.1.454.CMB.1.raw
  modified_base (235)..(235): a, c, t, g, unknown or other
  misc_feature (235)..(235): n is a, c, g, or t
  modified_base (491)..(491): a, c, t, g, unknown or other
  misc_feature (491)..(491): n is a, c, g, or t
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcagggatccctgagcgattctctggctccaggtcagggacaacgggtcaacattggccatcagtggacgtccaggcaggaggacgaggctgacttattattgtcaatcaacagacacctattggtacttatgttcttcggaactgacgacaggtcaccgtcgtggtcagcccaggccaacccntcgcacgtctccg

SEQ ID NO: 288508 - DNA, 769 bp, Homo sapiens
  misc_feature: GYAE6OF02JA281.51.81.H04.1.454.CMB.1.raw
tcagcgatcgtatacacgaccggtgctcgatttagtagtgtagattcgcgggggtgggtccaggaggcagaactctgggtgtctcaccatggcctggatccctctacttcctccccctcctcactctctgcacaggctctgacggcctcctatgagctgacacacgcccacccgtcggtgtcagtccgtccccaggacaggaccggccgaggactccacctgctcgtggagatgctattcgacccaaaccgatagtcgtctttagttcggtaaccagcaacggaacggcccgggaccgaccggccccccgttggttcggtttcgggtgaattaggttaaagtaaaacggacctaaccgtaggaaggaccggtcccccgtacggaacgggaccttcccgtaggacggtacgtaacgtttccttcgtcggccttacccgtagggtaccggaacggggaaccgtaaccgggtacctaaccgtaagttccgggacctacgtactagggtacggtacggtacccgaagggtacgaagggacgggaacggtacgggtctaggaacctttaagtttaagttgtaactaactaccgaaacctacgaaccctacgttagtttacgtaaccttttagttcggttaccgtttaacggtaaccgttacggaccgtaaaccgacggttccgtacccggtccggttacgggtaccgtaaccggaccccgaacgacccccgaacccctacggttaccgtcctaacccgttccgtttacccccgg

SEQ ID NO: 288509 - DNA, 676 bp, Homo sapiens
  misc_feature: GYAE6OF02IOLFO.51.81.H04.1.454.CMB.1.raw
tcagcgatcgtatacacgaccggtgctcgatttagtagtgtagattcgcgggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagaccggccaggatcacctgctcgtggagatgctattcgacccaaaaccgatatgtactttattcggtaccagcaaggaacggcccgggccacggcccctggtggttggtgtatgtaataaagacacgtggaggacggcccctaggagggactcccgtgagcgtacttctcgtcgctccgaggtcgagggactaacggtcaacgtagttcggacctagtcgaggtacgggacgtaccgagggacgaagggacgggacggacggctaggtaacttagtttagttagtactaacttcttacagtactactacgtacggttagtttaactttagttcgtttaacggttaccggtaaacgttacggggtaaccgtaacgggtacccgtacccggttccgttaacgggtccgtaacccggtaaccccggaaaccggtaccccctaaaccccgtacgttccggtacccttacccgttccgttaccccg

SEQ ID NO: 288510 - DNA, 514 bp, Homo sapiens
  misc_feature: GYAE6OF02IG7KA.51.81.H04.1.454.CMB.1.raw
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
  modified_base (507)..(507): a, c, t, g, unknown or other
  misc_feature (507)..(507): n is a, c, g, or t
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtaataaagacactgagacggccctcagggatccctgagcgattctctggctccgaggtcagggacaacggtcacattggcatcagtggagtccaggcagaggacgaggctgacttattattganaatcaangaacacctattaggtacttatgtcttcggatgacgacaggtcaccggtcctaggtcaacgcccaaggcccaacccgctacggccacctnttacccg

SEQ ID NO: 288511 - DNA, 673 bp, Homo sapiens
  misc_feature: GYAE6OF02JJEJM.51.81.H04.1.454.CMB.1.raw
  modified_base (238)..(238): a, c, t, g, unknown or other
  misc_feature (238)..(238): n is a, c, g, or t
  modified_base (310)..(310): a, c, t, g, unknown or other
  misc_feature (310)..(310): n is a, c, g, or t
tcagcgatcgtatacacgaccggtgctcgatttagtagtgtagattcgcgggggtgggtccgaggaggcagaactctgggtgtctcaccatggcctggatccctctacttctcccctcctcactctctgcacaggctctgaggcctcctatgagctgacacagccaccctcggtgtcagtgtccccaggacagaccggccaggatcgacctgctctggagatgcattgaccaaaccgntatgcttatggtaccagcagaagccggcacggcccctgtgttggtgatgtataagacacgtgagaggccctnacggggtactcccgtggaacgcgtaatttcgtcgttagggaccttccgacgggttacgaaggggtacctaaacgggtcctaacgtaacgtttcgggacccaagttccgtaaggtcgggaacgtccgaagggcgaaaggacgggaacgacgggcgtacggtaccgttaagttaacgtttacgtaccgtaaattcaaacacggtaacctaaccgtagtttacggtactttaagtcgttcttaacgggtactacggacgtaaccgtagggttaccaccggttaccgttacgggtcctaaccggtacccaaacggtcccccgtaaaccccgtccgttacgggtaccctaaccgttcccgttccccgg

SEQ ID NO: 288512 - DNA, 588 bp, Homo sapiens
  misc_feature: GYAE6OF02GH2SB.51.81.H04.1.454.CMB.1.raw
  modified_base (296)..(296): a, c, t, g, unknown or other
  misc_feature (296)..(296): n is a, c, g, or t
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcagttgaccaaaaccgatatgtcttagttggtaccagcagaagccgggccacggcccctgtgttggtgatgtaanaaagacactgagacggcctacgagggactccctgacgcattctcgtggcctcgaggtcgacggacaacggtcacacgttcggactacgtcgagtcggacgtaccgaggacgtaggaggacgaggacgtgaacgttagttaattgtactaaactcaaactagaaccactaagtttcgtaactttagtgtttaccgtacgtaacttgaaccgacgtacgtccgtaccggtcgtcggtacaccggaccgtaaccggaccctaaccccgtataccgtactaccttcgttaccccgg

SEQ ID NO: 288513 - DNA, 513 bp, Homo sapiens
  misc_feature: GYAE6OF02F85RT.51.81.H04.1.454.CMB.1.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtacagcagaagccgggcaggcccctgtgttggtgatgtataaagacactgagaggccctcagggatcccgtgagcgattctctggctccaggtcgaggacaacggtcacattcggccatcgagtggagtccgaggcaggaggacgaggctgacttattattgtacaatcaacagacaccattaggtacttatgttcttacgactgccgacctagtccaccgtcgtcggtcacgcccaaggacccaaccctactcgtcactctcccg

SEQ ID NO: 288514 - DNA, 593 bp, Homo sapiens
  misc_feature: GYAE6OF02GOLI2.51.81.H04.1.454.CMB.1.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggccaggcccctgtgttggtgatgtataaagacactgagaggccctcgagggactcccgtgagcgtattctcgtggctcgacggtcgaacggactaacggtcactacgttcgcctatcgacgtggacgtccgagggcaaggtaggacgaggccgtagaacgtatttagttagtctaaataccgaacaagaaccactacgttaggttactttaagtcgttacgttacggtaacgtcggtaccgaccgtaaggtccctaccggttccgtacgggtaccgacgtacccggaaccggtaccctaacccccgataccggtcctaccgtcgttaccccg

SEQ ID NO: 288515 - DNA, 640 bp, Homo sapiens
  misc_feature: GYAE6OF02FQIVL.51.81.H04.1.454.CMB.1.raw
  modified_base (235)..(235): a, c, t, g, unknown or other
  misc_feature (235)..(235): n is a, c, g, or t
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattgtacagcagaagccgggccaggcccctgtgttggtgatgtataaagacactgagacggccctcgagggatccccgtaggacgcgtattctcgtcgcctccgaggtcagggacaacggtccaatacgttcggacctagtcgaggtggtacgtccgaaggcgaagggaaggacgagggcgtagaacttaagtttagttagtactaaactacgaaaccgtaaggaaccctaacctaagttttacggttaactttaacggttcgttaccgtttacggaaaccgttcggaccgtaaccgtacggtacccgtacccggttccgtacgggttaccacccggtaccccgaaacggaccccctaacccgtacgttaccgtaccgttaccctcccgttaccccgg

SEQ ID NO: 288516 - DNA, 672 bp, Homo sapiens
  misc_feature: GYAE6OF02JIVA1.51.81.H04.1.454.CMB.1.raw
  modified_base (172)..(172): a, c, t, g, unknown or other
  misc_feature (172)..(172): n is a, c, g, or t
  modified_base (217)..(217): a, c, t, g, unknown or other
  misc_feature (217)..(217): n is a, c, g, or t
  modified_base (244)..(244): a, c, t, g, unknown or other
  misc_feature (244)..(244): n is a, c, g, or t
  modified_base (296)..(296): a, c, t, g, unknown or other
  misc_feature (296)..(296): n is a, c, g, or t
tcagcgatcgtatacacgaccggtgctcgatttagtagtgtagattcgcggggtgggtccgaggaggcgagaactctgggtgtctcaccatgcctggatccctctactctcccctcctcactctctgcacagctctgaggcctcctatgagctgacacagcccacctcggtntcagtcgtccccaggacaggacggccaggacttcacctgcctcgnggtagatgccattcgacccaaaaccgntaatgacttattggtaccagtcagaagccgggcacggcccctggtcgttggngtactgtaataagactaactggaagacggtaccctcgaagggtactcccgtaggaacgcgtaacgttcgtctacgggtccttcggaacggttcgtacgggaaaccgtaaccggtactaacgaagtttcccggacgtaactcgaaggttacggacgtaccgtaggacgaggaacgggacgacggtacgtagaaccgttaatttattcgtaacaacgttaacgaacaacgaacaacctaagtttacgtaacgttactagttaccgttaggtaactcgtacgtaaccgtagtaccgaccgttaccggtacgggttaccaacggtacccgtaacggaccccgaacccgtaaccgtcgtacccgtaactttcccgttaccg

SEQ ID NO: 288517 - DNA, 503 bp, Homo sapiens
  misc_feature: GYAE6OF02GW4MW.51.81.H04.1.454.CMB.1.raw
  modified_base (487)..(487): a, c, t, g, unknown or other
  misc_feature (487)..(487): n is a, c, g, or t
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccaggcccctgtgtggtgatgtataaagacactgagacggccctgagggactcctgagcgattctctggcctcaggtcagggacaacggtcacattggccatcgagtggagtccgaggcaggagacgaggctagactattatgtacaatcaaacagacacctattggtacttatcgttcttggactgcgtacgagtcaccggtcaggtcacgccgaagccaccntacgctacgtctcccg

SEQ ID NO: 288518 - DNA, 696 bp, Homo sapiens
  misc_feature: GYAE6OF02H61DU.51.81.H04.1.454.CMB.1.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttaattggtaccagcagaagccgggccaggcccctgtgttggtgatgtataaaagacaactgaagacggccctcgagggactcccgtaggacggtcgatttctcgtacggtcctccgaaggtccgaagggaaccgaaacgggtcaactagttgggacccaatccgaggtagggacgttacccgaagggcaaggaacgggacgaagggtcctaggtaaacttaagttaacgttttacgtaccgtaaaacgtttacaaaaccacggtaacctaaaccctaaagttttacgggtttaaactttaaggttacgtttaccgtttaaccgggtaaacctacggtacgaacccgttaaacgggtcccgtaacccggttaccggtcgggtaccaaccggtaacccccgaacgggaccccctaaaccccgaacgttccggtaacctaccgttccttacccccggg

SEQ ID NO: 288519 - DNA, 754 bp, Homo sapiens
  misc_feature: GYAE6OF02HXVHU.51.81.H04.1.454.CMB.1.raw
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgcctcgtggacgatgctagttcgaccaaaaccgtattagtcgtctttagtttcgggttaacccaggacgaaggaaacgggccccggggacccgaaccgggtacccccgttgggttcggggtttacgggttggtaagttagggttaaaacgtaaaaacggtaccctaacgttaggaacggtaaccggtcccccgttaacggaacggggtaaccttccccgtaggacggtaccggtactttccgtcggtacggtcctaccgacggggtcgtaacgggaaccgaacggtccaacgtagttacggccagtacgaggtacggacgtaccgaggcgtaacggacggacggaggtctaacggtatttaagttatttcggaactaactacgaactaaccgactaaccgttaagttcggtttaacttggttaccgttcgttacgggtactacgggtaccaacgtacggttccctacccgttcggtaccggtcaacccggtacccgaaccgccctaaacccacgttaccgtacctaccctaccgtttaccccg

SEQ ID NO: 288520 - DNA, 812 bp, Homo sapiens
  misc_feature: GYAE6OF02IGNQU.51.81.H04.1.454.CMB.1.raw
  modified_base (244)..(244): a, c, t, g, unknown or other
  misc_feature (244)..(244): n is a, c, g, or t
tcagcgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagcccacccgtcggtgtcagtcgtccccaggacagacgccaggatcacctgctcgtggacgatgctattcgacccaaaccgtntactgtacttattcggtaccagcagacgccggccacggcccgtgtggtggtacgagtagtaataaacgacacgtgacgacgccgtacgaggactccgtgagtacgtattccgtcgtcgggtcctaccggtacggtacggaacgggaacgtaaaccggtccgtaacgtagttaccggaccgtacgttacgtacggggtacggtacgtacccggtaacgggacggaaacggggacggtaaccgggacgggtaccgtaacggttaaacctttaaggtttaagttaaccgggtttacctaaaacgtttaaccgtaaacgaaaccgggtaacctaaaccgtttaaggtttacggtaaacttttaaccggttacgtttaaccggttaacccgggtaaccttcgggtaacccgtaaccggtttaaaccgggtacccggtttacccgggttacccggggttaaccggtacccggaacccggttaaacccccggaaccccggttaaccccccgtaaacccgggttacccgtaaccggttaccccttaaccccggtttacccggtttccccccccggg

SEQ ID NO: 288521 - DNA, 726 bp, Homo sapiens
  misc_feature: GYAE6OF02IIN0A.51.81.H04.1.454.CMB.1.raw
  modified_base (293)..(293): a, c, t, g, unknown or other
  misc_feature (293)..(293): n is a, c, g, or t
  modified_base (336)..(336): a, c, t, g, unknown or other
  misc_feature (336)..(336): n is a, c, g, or t
tcagcgatcgtatacacgaccggtgctcgatttagtagtgtagattcgcgggggtgggtccaggaggcagaactctgggtgtctcaccatggcctggatccctctacttctcccctcctcactctctgcacaggctctgaggcctcctatgagctgacacagccaccctggtgtcagtcgtccccaggacagacggccaggatcacctgctcgtggcgatgccattgaccaaaccgatatgtccttaattcggtaccagcaggaagcccgggacacggcccctggtgttcggngacttgtaataaacggcacgtgagcggccctacgagggtaccnccgtagacggtctacttccgtcgtcgtaccgtacggtacgggtacggtaacgggtaccgtaaccggtaccgtacttaccgggttcgaccttagtacgtaacgggtacggaccggtaaccggacgggtaaccggaggggtaaaccggaccgggacggttacgtcgtaaaccgtttagtttaagtttccgtaacgtaaacctaacctaacggacgtaaccctacgtttaaggtttaaccggttaattttacggtaccgtttacgttaaccgggtaacgtaccgtagttaaaccccggtacgttaccgtacccggtcccgggttagttaccgggaccctacccggaaccgttccctaacccgtccgtcccgttagtaccccttcggttccccg

SEQ ID NO: 288522 - DNA, 744 bp, Homo sapiens
  misc_feature: GYAE6OF02IXE5J.51.81.H04.1.454.CMB.1.raw
  modified_base (177)..(177): a, c, t, g, unknown or other
  misc_feature (177)..(177): n is a, c, g, or t
  modified_base (263)..(263): a, c, t, g, unknown or other
  misc_feature (263)..(263): n is a, c, g, or t
tcagcgatcgtatacacgaccggtgctcgatttagtagtgtagattcgcgggggtgggtccaggaggcagaactctgggtgtctcaccatggcctggatccctctacttcctccccctctcactctctgcacaggctctgacgccttctatgagctgacacacgcccaccgtcggtntacgagtcgtacccgaaggacacggacgccgaaggtctcaccttgccttcgaggagatcggactacgttacggaaccctaaacgtntaacgtcgttacgtttagttacggtaaccagacgaaggaaccggtccgggaccgtacggtccccgttggttaggttcggtacgttaagttaaggttaaactaaacggtaccgaaggttcgaacggaaccgtccctaaggacgggtaacctccggtagaccgtagtacttccgtacgcggtaccctacggaggacgtacggaacgtacgtcgaaacgtgtccggaccatcggtaggacgtacgtacggacggacggtacggaaggacgtacgtcgtaacgtacgttagttaacggttactaagtaactacgaaacgtacgaacgtacgttagttacgtaacgtttacgttgttacggttaccgtacgtaacggtacgtaaccgtaacggtccgttaaccgggtcccggttacgtacgaacccggtaaccgaacccgtacccggtaacccgtacgttaccggtacctaccgttcccgtacccg

SEQ ID NO: 288523 - DNA, 133 bp, Homo sapiens
  misc_feature: GYAE6OF01CR95N.30.23.C01.1.454.CMB.1.raw
  modified_base (130)..(133): a, c, t, g, unknown or other
  misc_feature (130)..(133): n is a, c, g, or t
tcagcacgctacgtcacgaccggtgctcgatttagtacacgtgattagggattgggcacagcggccctgggctgcctggtcaaggactacttccacgtagcgtgctgagcgggctggcaaggcgcatagnnnn

SEQ ID NO: 288524 - DNA, 130 bp, Homo sapiens
  misc_feature: GYAE6OF01A82Y2.30.23.C01.1.454.CMB.1.raw
  modified_base (130)..(130): a, c, t, g, unknown or other
  misc_feature (130)..(130): n is a, c, g, or t
tcagcacgctacgtcacgaccggtgctcgatttagtacacgtgattagggattgggcacagcggccctgggctgcctggtcaaggactacttccacgtagcgtgctgagcgggctggcaaggcgcatagn

SEQ ID NO: 288525 - DNA, 130 bp, Homo sapiens; identical to SEQ ID NO: 288524
  misc_feature: GYAE6OF01ELDNK.30.23.C01.1.454.CMB.1.raw
  modified_base (130)..(130): a, c, t, g, unknown or other
  misc_feature (130)..(130): n is a, c, g, or t

SEQ ID NO: 288526 - DNA, 132 bp, Homo sapiens
  misc_feature: GYAE6OF01EVGR3.30.23.C01.1.454.CMB.1.raw
  modified_base (130)..(132): a, c, t, g, unknown or other
  misc_feature (130)..(132): n is a, c, g, or t
tcagcacgctacgtcacgaccggtgctcgatttagtacacgtgattagggattgggcacagcggccctgggctgcctggtcaaggactacttccacgtagcgtgctgagcgggctggcaaggcgcatagnnn

SEQ ID NO: 288527 - DNA, 132 bp, Homo sapiens
  misc_feature: GYAE6OF01EZQMZ.30.23.C01.1.454.CMB.1.raw
  modified_base (129)..(132): a, c, t, g, unknown or other
  misc_feature (129)..(132): n is a, c, g, or t
tcagcacgctacgtcacgaccggtgctcgatttagtacacgtgattagggattgggcacagcggcctgggctgcctggtcaaggactacttccacgtagcgtgctgagcgggctggcaaggcgcatagnnnn

SEQ ID NO: 288528 - DNA, 155 bp, Homo sapiens
  misc_feature: GYAE6OF01EL3DW.30.23.C01.1.454.CMB.1.raw
  modified_base (131)..(155): a, c, t, g, unknown or other
  misc_feature (131)..(155): n is a, c, g, or t
tcagcacgctacgtcacgaccggtgctcgatttagtacacgtgattagggattggggcacagcggccctgggctgcctggtcaaggactacttccacgtagcgtgctgagcgggctggcaaggcgcatagnnnnnnnnnnnnnnnnnnnnnnnnn

SEQ ID NO: 288529 - DNA, 129 bp, Homo sapiens
  misc_feature: GYAE6OF01AFZEW.30.23.C01.1.454.CMB.1.raw
tcagcacgctacgtcacgaccggtgctcgatttagtacacgtgattagggattgggcacagcggccctgggctgcctggtcaaggactacttccacgtagcgtgctgagcgggctggcaaggcgcatag

SEQ ID NO: 288530 - DNA, 147 bp, Homo sapiens
  misc_feature: GYAE6OF01E3WCT.30.23.C01.1.454.CMB.1.raw
  modified_base (129)..(147): a, c, t, g, unknown or other
  misc_feature (129)..(147): n is a, c, g, or t
tcagcacgctacgtcacgaccggtgctcgatttagtacacgtgattagggattgggcacagcggccctgggctgcctggtcaaggactacttccacgtagcgtgctgagcggctggcaaggcgcatagnnnnnnnnnnnnnnnnnnn

SEQ ID NO: 288531 - DNA, 131 bp, Homo sapiens
  misc_feature: GYAE6OF01D6UY7.30.23.C01.1.454.CMB.1.raw
  modified_base (130)..(131): a, c, t, g, unknown or other
  misc_feature (130)..(131): n is a, c, g, or t
tcagcacgctacgtcacgaccggtgctcgatttagtacacgtgattagggattgggcacagcggccctgggctgcctggtcaaggactacttccacgtagcgtgctgagcgggctggcaaggcgcatagnn

SEQ ID NO: 288532 - DNA, 133 bp, Homo sapiens; identical to SEQ ID NO: 288523
  misc_feature: GYAE6OF01AMNFG.30.23.C01.1.454.CMB.1.raw
  modified_base (130)..(133): a, c, t, g, unknown or other
  misc_feature (130)..(133): n is a, c, g, or t

SEQ ID NO: 288533 - DNA, 130 bp, Homo sapiens; identical to SEQ ID NO: 288524
  misc_feature: GYAE6OF01DLQML.30.23.C01.1.454.CMB.1.raw
  modified_base (130)..(130): a, c, t, g, unknown or other
  misc_feature (130)..(130): n is a, c, g, or t

SEQ ID NO: 288534 - DNA, 141 bp, Homo sapiens
  misc_feature: GYAE6OF01CCLXU.30.23.C01.1.454.CMB.1.raw
  modified_base (131)..(141): a, c, t, g, unknown or other
  misc_feature (131)..(141): n is a, c, g, or t
tcagcacgctacgtcacgaccggtgctcgatttagtacacgtgattagggattgggcacagcggccctgggctgcctggtcaaggactacttccacgtagccgtgctgagcgggctggcaaggcgcatagnnnnnnnnnnn

SEQ ID NO: 288535 - DNA, 135 bp, Homo sapiens
  misc_feature: GYAE6OF01CVSPT.30.23.C01.1.454.CMB.1.raw
  modified_base (130)..(135): a, c, t, g, unknown or other
  misc_feature (130)..(135): n is a, c, g, or t
tcagcacgctacgtcacgaccggtgctcgatttagtacacgtgattagggattgggcacagcggccctgggctgcctggtcaaggactacttccacgtagcgtgctgagcgggctggcaaggcgcatagnnnnnn

SEQ ID NO: 288536 - DNA, 130 bp, Homo sapiens; identical to SEQ ID NO: 288524
  misc_feature: GYAE6OF01CRQA0.30.23.C01.1.454.CMB.1.raw
  modified_base (130)..(130): a, c, t, g, unknown or other
  misc_feature (130)..(130): n is a, c, g, or t

SEQ ID NO: 288537 - DNA, 130 bp, Homo sapiens; identical to SEQ ID NO: 288524
  misc_feature: GYAE6OF01DM913.30.23.C01.1.454.CMB.1.raw
  modified_base (130)..(130): a, c, t, g, unknown or other
  misc_feature (130)..(130): n is a, c, g, or t

SEQ ID NO: 288538 - DNA, 130 bp, Homo sapiens; identical to SEQ ID NO: 288524
  misc_feature: GYAE6OF01EAZ8E.30.23.C01.1.454.CMB.1.raw
  modified_base (130)..(130): a, c, t, g, unknown or other
  misc_feature (130)..(130): n is a, c, g, or t

SEQ ID NO: 288539 - DNA, 130 bp, Homo sapiens
  misc_feature: GYAE6OF01B3YPQ.30.23.C01.1.454.CMB.1.raw
  modified_base (129)..(130): a, c, t, g, unknown or other
  misc_feature (129)..(130): n is a, c, g, or t
tcagcacgctacgtcacgaccggtgctcgatttagtacacgtgattagggattgggcacagcggccctggctgcctggtcaaggactacttccacgtagcgtgctgagcgggctggcaaggcgcatagnn

SEQ ID NO: 288540 - DNA, 130 bp, Homo sapiens; identical to SEQ ID NO: 288524
  misc_feature: GYAE6OF01DT8CM.30.23.C01.1.454.CMB.1.raw
  modified_base (130)..(130): a, c, t, g, unknown or other
  misc_feature (130)..(130): n is a, c, g, or t

SEQ ID NO: 288541 - DNA, 133 bp, Homo sapiens; identical to SEQ ID NO: 288523
  misc_feature: GYAE6OF01AUCOT.30.23.C01.1.454.CMB.1.raw
  modified_base (130)..(133): a, c, t, g, unknown or other
  misc_feature (130)..(133): n is a, c, g, or t

SEQ ID NO: 288542 - DNA, 131 bp, Homo sapiens; identical to SEQ ID NO: 288531
  misc_feature: GYAE6OF01DVDQE.30.23.C01.1.454.CMB.1.raw
  modified_base (130)..(131): a, c, t, g, unknown or other
  misc_feature (130)..(131): n is a, c, g, or t

SEQ ID NO: 288543 - DNA, 130 bp, Homo sapiens
  misc_feature: GYAE6OF01DCNAJ.30.23.C01.1.454.CMB.1.raw
  modified_base (128)..(130): a, c, t, g, unknown or other
  misc_feature (128)..(130): n is a, c, g, or t
tcagcacgctacgtcacgaccggtgctcgatttagtacacgtgattagggattgggcacagcggccctgggctgcctggtcaaggaacttccacgtagcgtgctgagcgggctggcaaggcgcatagnnn

SEQ ID NO: 288544 - DNA, 130 bp, Homo sapiens; identical to SEQ ID NO: 288524
  misc_feature: GYAE6OF01BO9W7.30.23.C01.1.454.CMB.1.raw
  modified_base (130)..(130): a, c, t, g, unknown or other
  misc_feature (130)..(130): n is a, c, g, or t

SEQ ID NO: 288545 - DNA, 131 bp, Homo sapiens; identical to SEQ ID NO: 288531
  misc_feature: GYAE6OF01A0L8V.30.23.C01.1.454.CMB.1.raw
  modified_base (130)..(131): a, c, t, g, unknown or other
  misc_feature (130)..(131): n is a, c, g, or t

SEQ ID NO: 288546 - DNA, 130 bp, Homo sapiens; identical to SEQ ID NO: 288524
  misc_feature: GYAE6OF01BGA09.30.23.C01.1.454.CMB.1.raw
  modified_base (130)..(130): a, c, t, g, unknown or other
  misc_feature (130)..(130): n is a, c, g, or t

SEQ ID NO: 288547 - DNA, 175 bp, Homo sapiens
  misc_feature: GYAE6OF01BX5LG.30.23.C01.1.454.CMB.1.raw
  modified_base (130)..(175): a, c, t, g, unknown or other
  misc_feature (130)..(175): n is a, c, g, or t
tcagcacgctacgtcacgaccggtgctcgatttagtacacgtgattagggattgggcacagcggccctgggctgcctggtcaaggactacttccacgtagcgtgctgagcgggctggcaaggcgcatagnnnnnnnnnnnnnnnnnnnnnnnnnnnnnnnnnnnnnnnnnnnnnn

SEQ ID NO: 288548 - DNA, 130 bp, Homo sapiens; identical to SEQ ID NO: 288524
  misc_feature: GYAE6OF01BP93J.30.23.C01.1.454.CMB.1.raw
  modified_base (130)..(130): a, c, t, g, unknown or other
  misc_feature (130)..(130): n is a, c, g, or t

SEQ ID NO: 288549 - DNA, 141 bp, Homo sapiens
  misc_feature: GYAE6OF01BPMVB.30.23.C01.1.454.CMB.1.raw
  modified_base (130)..(141): a, c, t, g, unknown or other
  misc_feature (130)..(141): n is a, c, g, or t
tcagcacgctacgtcacgaccggtgctcgatttagtacacgtgattagggattgggcacagcggccctgggctgcctggtcaaggactacttccacgtagccgtgtgagcgggctggcaaggcgcatagnnnnnnnnnnnn

SEQ ID NO: 288550 - DNA, 130 bp, Homo sapiens; identical to SEQ ID NO: 288524
  misc_feature: GYAE6OF01AZ8WS.30.23.C01.1.454.CMB.1.raw
  modified_base (130)..(130): a, c, t, g, unknown or other
  misc_feature (130)..(130): n is a, c, g, or t

SEQ ID NO: 288551 - DNA, 131 bp, Homo sapiens; identical to SEQ ID NO: 288531
  misc_feature: GYAE6OF01CGZAM.30.23.C01.1.454.CMB.1.raw
  modified_base (130)..(131): a, c, t, g, unknown or other
  misc_feature (130)..(131): n is a, c, g, or t

SEQ ID NO: 288552 - DNA, 130 bp, Homo sapiens; identical to SEQ ID NO: 288524
  misc_feature: GYAE6OF01DQBHM.30.23.C01.1.454.CMB.1.raw
  modified_base (130)..(130): a, c, t, g, unknown or other
  misc_feature (130)..(130): n is a, c, g, or t

SEQ ID NO: 288553 - DNA, 130 bp, Homo sapiens; identical to SEQ ID NO: 288524
  misc_feature: GYAE6OF01CTV62.30.23.C01.1.454.CMB.1.raw
  modified_base (130)..(130): a, c, t, g, unknown or other
  misc_feature (130)..(130): n is a, c, g, or t

SEQ ID NO: 288554 - DNA, 131 bp, Homo sapiens; identical to SEQ ID NO: 288531
  misc_feature: GYAE6OF01B73LP.30.23.C01.1.454.CMB.1.raw
  modified_base (130)..(131): a, c, t, g, unknown or other
  misc_feature (130)..(131): n is a, c, g, or t

SEQ ID NO: 288555 - DNA, 136 bp, Homo sapiens
  misc_feature: GYAE6OF01B18NJ.30.23.C01.1.454.CMB.1.raw
  modified_base (130)..(136): a, c, t, g, unknown or other
  misc_feature (130)..(136): n is a, c, g, or t
tcagcacgctacgtcacgaccggtgctcgatttagtacacgtgattagggattgggcacagcggccctgggctgcctggtcaaggactacttccacgtagcgtgctgagcgggctggcaaggcgcatagnnnnnnn

SEQ ID NO: 288556 - DNA, 144 bp, Homo sapiens
  misc_feature: GYAE6OF01EAERN.30.23.C01.1.454.CMB.1.raw
  modified_base (130)..(144): a, c, t, g, unknown or other
  misc_feature (130)..(144): n is a, c, g, or t
tcagcacgctacgtcacgaccggtgctcgatttagtacacgtgattagggattgggcacagcggccctgggctgcctggtcaaggactacttccacgtagcgtgctgagcgggctggcaaggcgcatagnnnnnnnnnnnnnnn

SEQ ID NO: 288557 - DNA, 131 bp, Homo sapiens; identical to SEQ ID NO: 288531
  misc_feature: GYAE6OF01E0ZZM.30.23.C01.1.454.CMB.1.raw
  modified_base (130)..(131): a, c, t, g, unknown or other
  misc_feature (130)..(131): n is a, c, g, or t

SEQ ID NO: 288558 - DNA, 129 bp, Homo sapiens; identical to SEQ ID NO: 288529
  misc_feature: GYAE6OF01EATKS.30.23.C01.1.454.CMB.1.raw

SEQ ID NO: 288559 - DNA, 147 bp, Homo sapiens
  misc_feature: GYAE6OF01C8AMI.30.23.C01.1.454.CMB.1.raw
  modified_base (130)..(147): a, c, t, g, unknown or other
  misc_feature (130)..(147): n is a, c, g, or t
tcagcacgctacgtcacgaccggtgctcgatttagtacacgtgattagggattgggcacagcggccctgggctgcctggtcaaggactacttccacgtagcgtgctgagcgggctggcaaggcgcatagnnnnnnnnnnnnnnnnnn

SEQ ID NO: 288560 - DNA, 131 bp, Homo sapiens; identical to SEQ ID NO: 288531
  misc_feature: GYAE6OF01AGUKD.30.23.C01.1.454.CMB.1.raw
  modified_base (130)..(131): a, c, t, g, unknown or other
  misc_feature (130)..(131): n is a, c, g, or t

SEQ ID NO: 288561 - DNA, 147 bp, Homo sapiens
  misc_feature: GYAE6OF01CCLU9.30.23.C01.1.454.CMB.1.raw
  modified_base (124)..(124): a, c, t, g, unknown or other
  misc_feature (124)..(124): n is a, c, g, or t
  modified_base (130)..(147): a, c, t, g, unknown or other
  misc_feature (130)..(147): n is a, c, g, or t
tcagcacgctacgtcacgaccggtgctcgatttagtacacgtgattagggtattgggcacagcggccctgggctgcctggtcaaggactacttccacgtagcgtgctgagcggctggcaaggcncatagnnnnnnnnnnnnnnnnnn

SEQ ID NO: 288562 - DNA, 135 bp, Homo sapiens
  misc_feature: GYAE6OF01ES2EC.30.23.C01.1.454.CMB.1.raw
  modified_base (124)..(124): a, c, t, g, unknown or other
  misc_feature (124)..(124): n is a, c, g, or t
  modified_base (130)..(135): a, c, t, g, unknown or other
  misc_feature (130)..(135): n is a, c, g, or t
tcagcacgctacgtcacgaccggtgctcgatttagtacacgtgattagggattgggcacagcggccctgggctgcctggtcaaggactacttccacgtagcgtgctgagcgggctggcaaggcncatagnnnnnn

SEQ ID NO: 288563 - DNA, 130 bp, Homo sapiens; identical to SEQ ID NO: 288524
  misc_feature: GYAE6OF01BWXWV.30.23.C01.1.454.CMB.1.raw
  modified_base (130)..(130): a, c, t, g, unknown or other
  misc_feature (130)..(130): n is a, c, g, or t

SEQ ID NO: 288564 - DNA, 140 bp, Homo sapiens
  misc_feature: GYAE6OF01CZEQW.30.23.C01.1.454.CMB.1.raw
  modified_base (123)..(123): a, c, t, g, unknown or other
  misc_feature (123)..(123): n is a, c, g, or t
  modified_base (128)..(140): a, c, t, g, unknown or other
  misc_feature (128)..(140): n is a, c, g, or t
tcagcacgctacgtcacgaccggtgctcgatttagtacacgtgattagggattgggcacagcggccctgggctgcctggtcaaggactacttccacgtagcgtgctgagcgggctggcaggcncatgnnnnnnnnnnnnn

SEQ ID NO: 288565 - DNA, 126 bp, Homo sapiens
  misc_feature: GYAE6OF02HNEBE.30.23.C01.1.454.CMB.1.raw
  modified_base (126)..(126): a, c, t, g, unknown or other
  misc_feature (126)..(126): n is a, c, g, or t
tcagcacgctacgtcacgaccggtgctcgatttagtacacgtgattaggattggcacagcggcctggctgcctggtcaaggactacttccacgtagcgtgctgagcgggctggcaaggcgcatagn

SEQ ID NO: 288566 - DNA, 130 bp, Homo sapiens; identical to SEQ ID NO: 288524
  misc_feature: GYAE6OF02INCGE.30.23.C01.1.454.CMB.1.raw
  modified_base (130)..(130): a, c, t, g, unknown or other
  misc_feature (130)..(130): n is a, c, g, or t

SEQ ID NO: 288567 - DNA, 157 bp, Homo sapiens
  misc_feature: GYAE6OF02IAG7A.30.23.C01.1.454.CMB.1.raw
  modified_base (130)..(157): a, c, t, g, unknown or other
  misc_feature (130)..(157): n is a, c, g, or t
tcagcacgctacgtcacgaccggtgctcgatttagtacacgtgattagggattgggcacagcggcctgggctgcctggtcaaggactacttccaccgtagcgtgctgagcgggctggcaaggcgcatagnnnnnnnnnnnnnnnnnnnnnnnnnnnn

SEQ ID NO: 288568 - DNA, 130 bp, Homo sapiens; identical to SEQ ID NO: 288524
  misc_feature: GYAE6OF02H6ESJ.30.23.C01.1.454.CMB.1.raw
  modified_base (130)..(130): a, c, t, g, unknown or other
  misc_feature (130)..(130): n is a, c, g, or t

SEQ ID NO: 288569 - DNA, 132 bp, Homo sapiens; identical to SEQ ID NO: 288526
  misc_feature: GYAE6OF02FRSZQ.30.23.C01.1.454.CMB.1.raw
  modified_base (130)..(132): a, c, t, g, unknown or other
  misc_feature (130)..(132): n is a, c, g, or t

SEQ ID NO: 288570 - DNA, 130 bp, Homo sapiens; identical to SEQ ID NO: 288524
  misc_feature: GYAE6OF02F9Q5X.30.23.C01.1.454.CMB.1.raw
  modified_base (130)..(130): a, c, t, g, unknown or other
  misc_feature (130)..(130): n is a, c, g, or t

SEQ ID NO: 288571 - DNA, 133 bp, Homo sapiens; identical to SEQ ID NO: 288523
  misc_feature: GYAE6OF02JCM1N.30.23.C01.1.454.CMB.1.raw
  modified_base (130)..(133): a, c, t, g, unknown or other
  misc_feature (130)..(133): n is a, c, g, or t

SEQ ID NO: 288572 - DNA, 131 bp, Homo sapiens; identical to SEQ ID NO: 288531
  misc_feature: GYAE6OF02GZM3T.30.23.C01.1.454.CMB.1.raw
  modified_base (130)..(131): a, c, t, g, unknown or other
  misc_feature (130)..(131): n is a, c, g, or t

SEQ ID NO: 288573 - DNA, 153 bp, Homo sapiens
  misc_feature: GYAE6OF02HQAUD.30.23.C01.1.454.CMB.1.raw
  modified_base (132)..(153): a, c, t, g, unknown or other
  misc_feature (132)..(153): n is a, c, g, or t
tcagcacgctacgtcacgaccggtgctcgatttagtacacgtgattagggagttgggacacagcggccctgggctgcctggtcaaggactacttccacgtagcgtgctgagcgggctggcaaggcgcatagnnnnnnnnnnnnnnnnnnnnnn

SEQ ID NO: 288574 - DNA, 130 bp, Homo sapiens; identical to SEQ ID NO: 288524
  misc_feature: GYAE6OF02F9NFX.30.23.C01.1.454.CMB.1.raw
  modified_base (130)..(130): a, c, t, g, unknown or other
  misc_feature (130)..(130): n is a, c, g, or t

SEQ ID NO: 288575 - DNA, 159 bp, Homo sapiens
  misc_feature: GYAE6OF02JELCY.30.23.C01.1.454.CMB.1.raw
  modified_base (133)..(159): a, c, t, g, unknown or other
  misc_feature (133)..(159): n is a, c, g, or t
tcagcacgctacgtcacgaccggtgctcgatttagtacacgtgattaggagttcggcacagcggccctgggctgcctcggtcaaggactacttccaccgtagcgtgctgagcgggctggcaaggtcgcatagnnnnnnnnnnnnnnnnnnnnnnnnnnn

SEQ ID NO: 288576 - DNA, 130 bp, Homo sapiens; identical to SEQ ID NO: 288524
  misc_feature: GYAE6OF02IOBSI.30.23.C01.1.454.CMB.1.raw
  modified_base (130)..(130): a, c, t, g, unknown or other
  misc_feature (130)..(130): n is a, c, g, or t

SEQ ID NO: 288577 - DNA, 130 bp, Homo sapiens; identical to SEQ ID NO: 288524
  misc_feature: GYAE6OF02H3GLD.30.23.C01.1.454.CMB.1.raw
  modified_base (130)..(130): a, c, t, g, unknown or other
  misc_feature (130)..(130): n is a, c, g, or t

SEQ ID NO: 288578 - DNA, 130 bp, Homo sapiens; identical to SEQ ID NO: 288524
  misc_feature: GYAE6OF02HD9LA.30.23.C01.1.454.CMB.1.raw
  modified_base (130)..(130): a, c, t, g, unknown or other
  misc_feature (130)..(130): n is a, c, g, or t

SEQ ID NO: 288579 - DNA, 135 bp, Homo sapiens; identical to SEQ ID NO: 288535
  misc_feature: GYAE6OF02GSU2C.30.23.C01.1.454.CMB.1.raw
  modified_base (130)..(135): a, c, t, g, unknown or other
  misc_feature (130)..(135): n is a, c, g, or t

SEQ ID NO: 288580 - DNA, 156 bp, Homo sapiens
  misc_feature: GYAE6OF02IM7ZN.30.23.C01.1.454.CMB.1.raw
  modified_base (134)..(156): a, c, t, g, unknown or other
  misc_feature (134)..(156): n is a, c, g, or t
tcagcacgctacgtcacgaccggtgctcgatttagtacacgtgattagggagttgggcacagcggccctgggctgcctggtcaagggactacttccacgtagcgtgctcgagcgggctggccaaggcgcatagnnnnnnnnnnnnnnnnnnnnnnn

SEQ ID NO: 288581 - DNA, 130 bp, Homo sapiens; identical to SEQ ID NO: 288524
  misc_feature: GYAE6OF02G5JFN.30.23.C01.1.454.CMB.1.raw
  modified_base (130)..(130): a, c, t, g, unknown or other
  misc_feature (130)..(130): n is a, c, g, or t

SEQ ID NO: 288582 - DNA, 130 bp, Homo sapiens; identical to SEQ ID NO: 288524
  misc_feature: GYAE6OF02H1LZA.30.23.C01.1.454.CMB.1.raw
  modified_base (130)..(130): a, c, t, g, unknown or other
  misc_feature (130)..(130): n is a, c, g, or t

SEQ ID NO: 288583 - DNA, 131 bp, Homo sapiens; identical to SEQ ID NO: 288531
  misc_feature: GYAE6OF02H9TMR.30.23.C01.1.454.CMB.1.raw
  modified_base (130)..(131): a, c, t, g, unknown or other
  misc_feature (130)..(131): n is a, c, g, or t

SEQ ID NO: 288584 - DNA, 138 bp, Homo sapiens
  misc_feature: GYAE6OF02JGNBF.30.23.C01.1.454.CMB.1.raw
  modified_base (129)..(129): a, c, t, g, unknown or other
  misc_feature (129)..(129): n is a, c, g, or t
  modified_base (131)..(138): a, c, t, g, unknown or other
  misc_feature (131)..(138): n is a, c, g, or t
tcagcacgctacgtcacgaccggtgctcgatttagtacacgtgattagggattgggcgacagcggcctgggctgcctggtcaaggactacttccacgtagcgtgctgagcggctggcaaggcgcatagnannnnnnnn

SEQ ID NO: 288585 - DNA, 130 bp, Homo sapiens; identical to SEQ ID NO: 288524
  misc_feature: GYAE6OF02G9LWE.30.23.C01.1.454.CMB.1.raw
  modified_base (130)..(130): a, c, t, g, unknown or other
  misc_feature (130)..(130): n is a, c, g, or t

SEQ ID NO: 288586 - DNA, 158 bp, Homo sapiens
  misc_feature: GYAE6OF02F695O.30.23.C01.1.454.CMB.1.raw
  modified_base (127)..(127): a, c, t, g, unknown or other
  misc_feature (127)..(127): n is a, c, g, or t
  modified_base (133)..(158): a, c, t, g, unknown or other
  misc_feature (133)..(158): n is a, c, g, or t
tcagcacgctacgtcacgaccggtgctcgatttagtacacgtgattagggtagttgggcacagcggccctgggctgcctggtcaaggactacttccacgtagccgtgctgagcgggctggcaaggcncatagnnnnnnnnnnnnnnnnnnnnnnnnnn

SEQ ID NO: 288587 - DNA, 132 bp, Homo sapiens; identical to SEQ ID NO: 288526
  misc_feature: GYAE6OF02H84OU.30.23.C01.1.454.CMB.1.raw
  modified_base (130)..(132): a, c, t, g, unknown or other
  misc_feature (130)..(132): n is a, c, g, or t

SEQ ID NO: 288588 - DNA, 130 bp, Homo sapiens; identical to SEQ ID NO: 288524
  misc_feature: GYAE6OF02HSQL2.30.23.C01.1.454.CMB.1.raw
  modified_base (130)..(130): a, c, t, g, unknown or other
  misc_feature (130)..(130): n is a, c, g, or t

SEQ ID NO: 288589 - DNA, 155 bp, Homo sapiens
  misc_feature: GYAE6OF02IA11B.30.23.C01.1.454.CMB.1.raw
  modified_base (132)..(155): a, c, t, g, unknown or other
  misc_feature (132)..(155): n is a, c, g, or t
tcagcacgctacgtcacgaccggtgctcgatttagtacacgtgattagggagttgggcacagcggccctgggctgcctggtcaaggactacttccacgtagcgtgctgagcgggctggcaaggcgcataggnnnnnnnnnnnnnnnnnnnnnnnn

SEQ ID NO: 288590 - DNA, 499 bp, Homo sapiens
  misc_feature: GYAE6OF01ATHTV.44.75.G09.1.454.CMB.1.raw
  modified_base (424)..(424): a, c, t, g, unknown or other
  misc_feature (424)..(424): n is a, c, g, or t
  modified_base (494)..(494): a, c, t, g, unknown or other
  misc_feature (494)..(494): n is a, c, g, or t
tcagacagtatatacacgaccggtgctcgatttagtatagacatcagggaggaatcagacccagtcacggacacagcatggacatgagagtcctcgctcagctcctgggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtcccctgatcttttctggatccactttgaagagtggagtcccagccaggttcagcggcagtggtctgggacacatttcactctcaccatcagcagcctgcagcctggagatttcgcgtacttattactgccaacatattctttttanccgttacagttttgcctaggggaccaagctggagagtcaaagggtaactgtaggctgcacatctgtcttnattcc

SEQ ID NO: 288591 - DNA, 498 bp, Homo sapiens
  misc_feature: GYAE6OF01EEY9M.44.75.G09.1.454.CMB.1.raw
  modified_base (496)..(496): a, c, t, g, unknown or other
  misc_feature (496)..(496): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtacttattactgaccaaacaattattcttttttatccgttactagttttggccaggggaccaagctggagatcaaagactgtgctgcacatctgtcttcatctccgcatctgatatatactgtctgagcggtctggcaggcgnag

SEQ ID NO: 288592 - DNA, 498 bp, Homo sapiens
  misc_feature: GYAE6OF01BOGOA.44.75.G09.1.454.CMB.1.raw
  modified_base (496)..(496): a, c, t, g, unknown or other
  misc_feature (496)..(496): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtacttattactgccaacaattattcttttttatccgttactagttttggccagggaccaagctggagatcaaaggactgtgctgcacatctgtcttcatcttccgcatctgatatatatgtctgagcgggtctggcaaggcgnag

SEQ ID NO: 288593 - DNA, 546 bp, Homo sapiens
  misc_feature: GYAE6OF01EBD86.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgactttattactgaccaactaatattcttttttaatcccgttaactaggtttttggaccgtaaggggacccaaagtccgtaggaagtatacgaaaagggtaaccttaggtaggctaggctaacccgattacctagttccttctacgttcccc

SEQ ID NO: 288594 - DNA, 688 bp, Homo sapiens
  misc_feature: GYAE6OF01C4XZP.44.75.G09.1.454.CMB.1.raw
tcagacagtatatacacgaccggtgctcgatttagtatagacatcaggggacttaggggctttgcccaggctcctgctgtctctgtttccccggtgccaggtgtgacatcgagactgacccaggtctccgtcctcactgtctgcgtctattggggacagagtcaccatcacttgccggcgagtgccgacattaggacttttttggccttggtttcagcaggagcctggcaaagccctaagtccctgtattctttctggactccaacgtttgaagagtggagtcccagccaggttcagcggcagttggtctgggacacgtatttcactctcaccatcagacagctgcagcctaggacgtacttttacggaccgtaactttaacgttaaccgtcgaaccctaaaactaaaactttaactttaccttttttaactacccgttaacgttacggtttttacgggacccgtaagggggtaacccaaggtcgtacgggaacgtaacttaacgtaaaacggtacgttaggttacggacgttacgacgtaaccgtaacttccgttacggttccttaccgtacgtttccctttaccccggaccttaacgttaccgttacgtaacttaacgttaacgtaccgttacggttacccgtaggacggtcgggtacgttacgggacgtaacgggcgacgtaacg

SEQ ID NO: 288595 - DNA, 495 bp, Homo sapiens
  misc_feature: GYAE6OF01CTBV6.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggttcagcaggagcctggcaaaagcccctaagtccctgatcttttctggatccactttgaagagtggagtcccagccaggttcagcggcagtggtctgggacacatttcactctcaccatcagcagcctgcagcctggagatttcgcgacttattactgaccaacaatattctttttatccgtatagtttggccagggaccaagctggagatcaaaggactgtggctgcacatctgtcttcatctcccgcatctgatatatactgtctgagcgggctggacaaggcgctag

SEQ ID NO: 288596 - DNA, 501 bp, Homo sapiens
  misc_feature: GYAE6OF01B5J7T.44.75.G09.1.454.CMB.1.raw
  modified_base (345)..(345): a, c, t, g, unknown or other
  misc_feature (345)..(345): n is a, c, g, or t
  modified_base (370)..(370): a, c, t, g, unknown or other
  misc_feature (370)..(370): n is a, c, g, or t
  modified_base (492)..(492): a, c, t, g, unknown or other
  misc_feature (492)..(492): n is a, c, g, or t
  modified_base (498)..(498): a, c, t, g, unknown or other
  misc_feature (498)..(498): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctagcaaagcccctaagtccctgatcttttctggatccactttgaagagtggagtcccagccaggttcagcggcagtggttctgggacacatttcactctcaccatcagcagcctgcagcctgganattttcgcgacttattactgccaanaatattctttttatccgtactagtttgccgagggaccaagctggagatacaaacgactgtggctgcaccatctgtcttcatccttccgcctatctgatatatactgtctgagcggtctgganaggcgntag

SEQ ID NO: 288597 - DNA, 492 bp, Homo sapiens
  misc_feature: GYAE6OF01DU5HA.44.75.G09.1.454.CMB.1.raw
  modified_base (490)..(490): a, c, t, g, unknown or other
  misc_feature (490)..(490): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtcccctgatcttttctggatccactttgaagagtggagtcccagccaggttcagcggcagtggttctgggacacatttcactctcaccatcagcagcctgcagcctggagatttcgcgtacttatactgccaacaattatctttttatccgtacagttttgccagggaccaagctggagatcaaaggactgtgctgcacatctgtcttcatctcccgcatctgatatatatgtctgagcgggctggcaaggcgnag

SEQ ID NO: 288598 - DNA, 509 bp, Homo sapiens
  misc_feature: GYAE6OF01DTWZJ.44.75.G09.1.454.CMB.1.raw
  modified_base (507)..(507): a, c, t, g, unknown or other
  misc_feature (507)..(507): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgacttatactgccaaacaattattctttttatccgttactagttttggccaggggaccaagctggagatcaaaggactggtggctgcaccatctgttcttcacttccttcccgcctactctgatatatacttgtctgagcgggctggcaaggcgnag

SEQ ID NO: 288599 - DNA, 507 bp, Homo sapiens
  misc_feature: GYAE6OF01DTW1S.44.75.G09.1.454.CMB.1.raw
tcagacagtatatacacgaccggtgctcgatttagtatagacatcaggggaggaatcagacccagtcaggacacagcatggacatgagagtcctcgctcagctcctgggactcctgctgctctgtttccccggtgccaggtgtgacatcgagatgacccagtctccatcctccctgtctgcatctgtgggagacagagtcaccatcacttgccgggcgagtcaggccattagcaattatttagcctggtatcagcagaaaccagggaaacctcctaacctcctgatctttgctgcatccactttgcaatcaggggtcccatctcggttcagcggcagtggatctgggacagatttctctctcaccatcagcagcctgcagccctgaagatgttgactaacttattactgtacaaaagtacaacagtcgcccctcacctacctttccggcccctagggaacccaaaggtggaatactacaaaaccgtaactaggtggctgctaacccg

SEQ ID NO: 288600 - DNA, 512 bp, Homo sapiens
  misc_feature: GYAE6OF01D3504.44.75.G09.1.454.CMB.1.raw
  modified_base (486)..(486): a, c, t, g, unknown or other
  misc_feature (486)..(486): n is a, c, g, or t
  modified_base (507)..(507): a, c, t, g, unknown or other
  misc_feature (507)..(507): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtcccctgatcttttctggatccactttgaagagtggagtcccagccaggttcagcggcagtggttctgggacacatttcactctcaccatcagcagcctgcagcctggagtatttcgcgtactttattactgaccaactaattattcttttttatcccgttactagttttcggacctaggggaccagctggagatcgaaaggactggnggctgcacctatctgtcttcnttccc

SEQ ID NO: 288601 - DNA, 511 bp, Homo sapiens
  misc_feature: GYAE6OF01CCJJR.44.75.G09.1.454.CMB.1.raw
  modified_base (507)..(507): a, c, t, g, unknown or other
  misc_feature (507)..(507): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggttctgggacacatttcactctcaccatcagcagcctgcagcctggagtatttcgcgtacttattactgccaaacaattattctttttatccgttactagttttcggcctaggggaccaaggctaggagatacaaaggactgtggctgcacatctgtcttcactccttcccgctatctgattatatactgtctgagcggtctggcaggcgngtag

SEQ ID NO: 288602 - DNA, 506 bp, Homo sapiens
  misc_feature: GYAE6OF01BW5BU.44.75.G09.1.454.CMB.1.raw
  modified_base (251)..(251): a, c, t, g, unknown or other
  misc_feature (251)..(251): n is a, c, g, or t
  modified_base (492)..(492): a, c, t, g, unknown or other
  misc_feature (492)..(492): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggttctgggacacatttcactctcaccatcagcagcctgcagcctggagattttcgcgtacttattactgccaaacaatattctttttatccgtactagttttggccaggggaccaagcttaggagatacgaaagaactgtggctgcaccatctgtcttcactcttcccgcatctgatatatactgtctgagcggntggacaaggcgcta

SEQ ID NO: 288603 - DNA, 506 bp, Homo sapiens
  misc_feature: GYAE6OF01CPWOX.44.75.G09.1.454.CMB.1.raw
  modified_base (252)..(252): a, c, t, g, unknown or other
  misc_feature (252)..(252): n is a, c, g, or t
  modified_base (389)..(389): a, c, t, g, unknown or other
  misc_feature (389)..(389): n is a, c, g, or t
  modified_base (422)..(422): a, c, t, g, unknown or other
  misc_feature (422)..(422): n is a, c, g, or t
  modified_base (437)..(437): a, c, t, g, unknown or other
  misc_feature (437)..(437): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
  modified_base (500)..(500): a, c, t, g, unknown or other
  misc_feature (500)..(500): n is a, c, g, or t
tcagacagtatatacacgaccggtgctcgatttagtatagacatcagggacgttaggggcttgccaggctcctgctgctctgtttccccggtgccaggtgtgacatcgagatgacccagtctccgtcctcactgtctgcgtctagttggggacagagtcacatcacttgccgggcgagtgccgacattaggacttttttggcctgggttcagcaggagcctgggcaaagcccctaagtccctgatcttttcnggatccactttgaagtagtggagtcccagccaggttcagcggcagtggtctgggacacattcactctcaccagtcagcagtcctgcagcctggagatttcgcgtacttattactgtacaactaatacttctttttanccgtatagtttcgcgacgggtacaagctagganatacaaagactgtgntagcacatctgtctcatctccncatcngtatatatactgtctgcgtcgggctaggacaggcgngtaacg

SEQ ID NO: 288604 - DNA, 524 bp, Homo sapiens
  misc_feature: GYAE6OF01AVM33.44.75.G09.1.454.CMB.1.raw
  modified_base (514)..(514): a, c, t, g, unknown or other
  misc_feature (514)..(514): n is a, c, g, or t
  modified_base (521)..(521): a, c, t, g, unknown or other
  misc_feature (521)..(521): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggatatttcgcgtacttattactgaccaactaattatttctttttatccgttactagttttcggaccgtaggggtaccaaggtcgtaggagtagtacaaaggtactgtcggctgacacatctgtcttcacttctccgcctatctgattatacttatgtctgagcgggtctggnaaggcgntag

SEQ ID NO: 288605 - DNA, 505 bp, Homo sapiens
  misc_feature: GYAE6OF01A2IKU.44.75.G09.1.454.CMB.1.raw
  modified_base (370)..(370): a, c, t, g, unknown or other
  misc_feature (370)..(370): n is a, c, g, or t
  modified_base (495)..(495): a, c, t, g, unknown or other
  misc_feature (495)..(495): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtacttattactgccaanaattattctttttatccgttactagttttggcctaggggaccaaggctggagatcgaaaggaactgtggctgcaccatctgtcttcatctccgccatctgatatatactgtctgagcgggctggnaaggcgcgag

SEQ ID NO: 288606 - DNA, 499 bp, Homo sapiens
  misc_feature: GYAE6OF01AFPWO.44.75.G09.1.454.CMB.1.raw
  modified_base (490)..(490): a, c, t, g, unknown or other
  misc_feature (490)..(490): n is a, c, g, or t
  modified_base (495)..(495): a, c, t, g, unknown or other
  misc_feature (495)..(495): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgacttatactgccaacaatatctttttatccgtacagttttggccaggggaccaaatctggagatcaaaaggaactgtggctgcaccatctgtcttcatcttcccgccatctgatatatactgtctgagcgggctggnaaggngcaa

SEQ ID NO: 288607 - DNA, 682 bp, Homo sapiens
  misc_feature: GYAE6OF01BITAU.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccgggcgagtgccgacattaggactttttggcctggtttcagcaggagccgtgacaacgccctaacgtccctgtactttcttttcgtggtactccttacgtttagaagtaggtaggtacgtcccgacgaccgtaggttcacggcggtacgtagggttcggttcggtacgggacctaacgttactttaccgaccttcctaccaacctactaccgacgtacgacgtcccgtagaccgtacgtcccgtagggaacgttacgtttaccggaccgttaacgtttaacgttaccgtacgaacctaaacttaatttacttttactttttaacgtacccgttaacgttacgggttttcgaccggtaacgggtaacctaaggtccgtaggaacgtacgtaaaccggaaacggtacgtgggtacggtcgtacgtacctaaccgtacgttacgttacgtttccttacgtaccgtttaccccg

SEQ ID NO: 288608 - DNA, 512 bp, Homo sapiens
  misc_feature: GYAE6OF01A9I7Z.44.75.G09.1.454.CMB.1.raw
  modified_base (509)..(509): a, c, t, g, unknown or other
  misc_feature (509)..(509): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtacttattactgaccaactaattattctttttatccgttactagttttggcctaggggaccaagctggagatacgaaaggactgtggctgcaccatctgtcttcatccttcccgcctactctgattatatactgtctgagcggtctggacaggcgngag

SEQ ID NO: 288609 - DNA, 502 bp, Homo sapiens
  misc_feature: GYAE6OF01EF7ID.44.75.G09.1.454.CMB.1.raw
  modified_base (345)..(345): a, c, t, g, unknown or other
  misc_feature (345)..(345): n is a, c, g, or t
  modified_base (484)..(484): a, c, t, g, unknown or other
  misc_feature (484)..(484): n is a, c, g, or t
  modified_base (494)..(494): a, c, t, g, unknown or other
  misc_feature (494)..(494): n is a, c, g, or t
  modified_base (501)..(501): a, c, t, g, unknown or other
  misc_feature (501)..(501): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttggcctggtttcagcaggagcctggcaaagcccctaagtcccctgatcttttctggatccactttgaagagtggagtcccagccaggttcagcggcagtggttctgggacacatttcactctcaccatcagcagcctgcagcctgganatttcgcgacttattactgaccaaacaattattcttttttatccgttactagttttggccaggggaccaagctggagatcaaagactgtggctgcaccatctgtcttcatcttcccgccatctgatatatactgtctgngcgggctggnaaggcgna

SEQ ID NO: 288610 - DNA, 508 bp, Homo sapiens
  misc_feature: GYAE6OF01AM5OO.44.75.G09.1.454.CMB.1.raw
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtacttattactgccaacaattattctttttatccgttactagtttggccgagggtaccaagcgtaggagatacaaaggactgtggctgcaccatctgtcttcactctcccgcatctagtatatatactgtctgagcgggtctggcaaggngngag

SEQ ID NO: 288611 - DNA, 666 bp, Homo sapiens
  misc_feature: GYAE6OF01DBM0H.44.75.G09.1.454.CMB.1.raw
  modified_base (252)..(252): a, c, t, g, unknown or other
  misc_feature (252)..(252): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttcnggatccactttgaagagtggagtcccagccaggttcagcggcagtggttctgggacacatttcactctcaccatcagcagcctgcagcctggagtatttcgcgtactttatactgacctaaataattactttcttttttaactcccgttaacttagtttttcggacccgtaaggggtaccctaaaggtcttagggaacgtaacgttaccgaaaagggtaacttaggttacgggacttacggacccgaaccgtaacttaccgtttacgtttcccgtttactaacgtttccctttcccccggtaccctacgttaccgtacgttaaactttaacgttaacgtttacgtttacggttaccgtacgggtacgggtaccggggtccgttacggggaccgtaaacggggccgtacgtaaag

SEQ ID NO: 288612 - DNA, 523 bp, Homo sapiens
  misc_feature: GYAE6OF01CAI9B.44.75.G09.1.454.CMB.1.raw
  modified_base (518)..(518): a, c, t, g, unknown or other
  misc_feature (518)..(518): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagtatttcgcgtacttattactgacctaaactaattatttcttttttactccgttactagttttcggaccgtagggaccaagtctggagatacgaaaggtactgtcgctgcaccatctcgtcttcactctcccgctatctgatatatatgtctgaggcggtcgtggacgaggcgngtacg

SEQ ID NO: 288613 - DNA, 519 bp, Homo sapiens
  misc_feature: GYAE6OF01B0DA0.44.75.G09.1.454.CMB.1.raw
  modified_base (344)..(344): a, c, t, g, unknown or other
  misc_feature (344)..(344): n is a, c, g, or t
  modified_base (509)..(509): a, c, t, g, unknown or other
  misc_feature (509)..(509): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggtctgggacacatttcactctcaccatcagcagcctgcagcctgganatttcgcgtacttattactgaccaaacaattattcttttttatccgttactagttttcggacctaggggaccaaggcctaggagattacgaaaggtactgtaggctgcaccatctgtcttcactcctcccgctatctgatatatatgtctgagcgggtctagganacggcgctag

SEQ ID NO: 288614 - DNA, 521 bp, Homo sapiens
  misc_feature: GYAE6OF01C44JE.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcatggcaaagcccctaagtccctgatcttttctggatccactttgaagagtggagtcccagccaggttcagcggcagtggttctgggacacatttcactctcaccatcagcagcctgcagccctggagatttcgcgtactttattactgacctaaacaattattcttttttatccgttactagttttggccaggggaccaaggctggagatacaaaggaactgtggctgcaccatctgtctttcacttccttcccgcctactctgatatatactgtctgaggtcgggactggcaagggcgacg

SEQ ID NO: 288615 - DNA, 723 bp, Homo sapiens
  misc_feature: GYAE6OF01CDRJN.44.75.G09.1.454.CMB.1.raw
tcagacagtatatacacgaccggtgctcgattttagtatagacatctaggggacttagggggctttggccaccggcctccgttcgcgtgtctctgttttcccggtgccaggtgtgacatcgagatgaacccagtctccgtcctcgacttggtctgcgtcttagttttcggggtactagacgttacttaaccgattccaacgtttggccggggcggaggtcgccggactagtttagggactttttttgggccggtgggtttcctaggtccagggacgtccgggttcggcgaaacggccccttaacgttccccttggtacttccttttcgtcggtacttccgtacttttcgaaacgtagtaggtattcccagcctaggttcacgtcggtcgacggtcggttcgtcgggaccacggagtttcacgtactcaccgtactcaggtctagaccttagcacgacctaggagtattttacgacgtactttaacttaactcgtacctaaacgtaaagttacttacttttttaactacccgttaacttagttttcggacccgtaaggggtaacctaaggtcctaggaacacgtacgtaaaggtacttgtacgacgttcggacaccgtattcgtagtcttctacgtaccgttcccgactactcttagtacttagtacgttagtggtcgtacggtacggtacgggtcgtaggtacggtacgggtcggcgtaacgg

SEQ ID NO: 288616 - DNA, 504 bp, Homo sapiens
  misc_feature: GYAE6OF01AOF1D.44.75.G09.1.454.CMB.1.raw
  modified_base (475)..(475): a, c, t, g, unknown or other
  misc_feature (475)..(475): n is a, c, g, or t
  modified_base (501)..(501): a, c, t, g, unknown or other
  misc_feature (501)..(501): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtacttattactgaccaacaattacttctttttatccgttactagttttcggcctagggaccaagctaggagatcaaaggactgtgctgcacatctgtcttcattcctccgctatctgatatntactgtctgagcggctggacaggcgntag

SEQ ID NO: 288617 - DNA, 507 bp, Homo sapiens
  misc_feature: GYAE6OF01BD02O.44.75.G09.1.454.CMB.1.raw
  modified_base (498)..(498): a, c, t, g, unknown or other
  misc_feature (498)..(498): n is a, c, g, or t
  modified_base (505)..(505): a, c, t, g, unknown or other
  misc_feature (505)..(505): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagtatttcgcgtacttattactgaccaacaattattcttttttatccgttactagttttcgccagggaccaagctggagatacaaaggactgtggctgcacatctgtcttcactctcccgctatctgatatactactgtctgacgcggtctgganacggcgnag

SEQ ID NO: 288618 - DNA, 583 bp, Homo sapiens
  misc_feature: GYAE6OF01B1DTS.44.75.G09.1.454.CMB.1.raw
  modified_base (301)..(301): a, c, t, g, unknown or other
  misc_feature (301)..(301): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtgtcgnggacactattcactctcaccatcagcacgcctgcacgccgtggagtatttcgacgtactttattactgaccaactaattactttactttttactaccgttacttaggttttcggaccgtacggggaacctaaggtcgtagggagtacgtaacgaaaggtaactggtacggtcgtcgacacctacttcgttcgttcttctacttcccttacccgcctacttcgtagtattactacttacttcgtcgtggacggcgggtcgtacggacgaacgggtcgagtacg

SEQ ID NO: 288619 - DNA, 510 bp, Homo sapiens
  misc_feature: GYAE6OF01CGGHJ.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttccactctcaccatcagcagcctgcagcctggagtatttcgcgactttattactgaccaaactaatattcttttttatccgttactagttttggcctaggggaccaagctggagatacaaaggactgtgctgcacatctgtcttcatcttccgctatctgatactatactgtctgagcgggctaggcaacggcgctag

SEQ ID NO: 288620 - DNA, 608 bp, Homo sapiens
  misc_feature: GYAE6OF01A2LTL.44.75.G09.1.454.CMB.1.raw
tcagacagtatatacacgaccggtgctcgatttagtatagacatcagggacttaggggcgtttgccaggctcctgctgctctgtttccccggtgccaggtgtgacatccgagatgacccagtcgtccgtcctcactgtctgcgtctattgggacagagtcaccatcacttgccgggcgagtgccgacattaggacttttttggcctggtttcagcaggagcctggcaaagcccctaaagtccctgatcgttttctggatccactttgaagagtggagtccagccaggttcagcgcagtggtctgggacacagtttcactctcacatcagcagcctagcagcctggagtactttcggcgtacttacgttactagcctaaacgtaattacgtttaccttttttaactcccgttaactacgttttacgggacctaacggggtacctaaggccgtacgggacgtaacgtacgaaaggtaactaggtcggtctacgcgtacctagttccttacgtaccttctacttccgttcccgtccctacttccgtgtaagttacgtacgttagtacggtcgtacgtaggtcgggtctacgggacaacgggccgcgtaacg

SEQ ID NO: 288621 - DNA, 761 bp, Homo sapiens
  misc_feature: GYAE6OF01C2QU2.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcacatcagcagctgcagctggatatttcgcgtacttattactcgacctaaactaattactttacttttttactaccgttaacgttacggtttttacggacccgtaaggggtaaccctaaaggtccgttagggaacgtaacgttaaccgtaaaaacgggtaaaccgttagggttacgggtaccgttacgggtaaccctaacccgtaacgtttcccgtttacgggttttacccttttaacccggttaaccttttcccccggttttaccccccggtacccccttaaacgtttccccgtttacgggttaaaacctttaaacgttttaaacctttaaacccgttttcgggttaacccggtttacgggttaaaccggggtcccggggggttacccgtttaacgggggaacccggtaaaacgggggtccccggtacccggttaaaacgg

SEQ ID NO: 288622 - DNA, 564 bp, Homo sapiens
  misc_feature: GYAE6OF01DH5MC.44.75.G09.1.454.CMB.1.raw
  modified_base (491)..(491): a, c, t, g, unknown or other
  misc_feature (491)..(491): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaagcccctaagtccctgattcttttctggatcctactttgaagagtggagtcccagccaggttcagcggcagtggttctgggacactatttcactctcaccatcagcagcctgcagcctggagtatttcgacgtactttattactcgaccaaactaattatttcttttttaactccgttacttagttttcggaccgtaacggggtaccaagtcgtagggagatacgaaaaggtacgtggtggctgcaacctatcttcgtcttcncttccttcccgcctatctagtattataattacttgtctacggaggcgggtcgtagggcgaacgggcgcgtaag

SEQ ID NO: 288623 - DNA, 595 bp, Homo sapiens
  misc_feature: GYAE6OF01C9BCM.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggacaaagcccctaagtccctgtattcttttctggactccactttgaagagtggagtcccagccaggttcagcggctaggtggttcgtgggacactatttcactctcaccatcagcacgctgcagcctggatatttcgacgtactttattaactcgaccctaaataactttactttcttttttaactccgtttacttaggttttcggaccggtaacggggaacctaaggtccgtaggaacgtagtaccgaaaggtactggtggctggacacctagttcttcgtacttcacttccttcccgacctatccgtagtattacgttattacctgttcgtcggaggtccgggtcgtacggacggtaacggcgtacgtag

SEQ ID NO: 288624 - DNA, 599 bp, Homo sapiens
  misc_feature: GYAE6OF01CLW9X.44.75.G09.1.454.CMB.1.raw
  modified_base (370)..(370): a, c, t, g, unknown or other
  misc_feature (370)..(370): n is a, c, g, or t
  modified_base (444)..(444): a, c, t, g, unknown or other
  misc_feature (444)..(444): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctagttggggacagagtcaccatcacttgccgggcgagtgccgacattaggtacttttttggccttggtttcagcaggagcctggcaaacgcccctaagtccctgattcttttctggactccactttgaagtagtggagtcccagccaggttcagcgcagtggtctgggacacatttcactctcacntcagcagcctgcagcctggactattcgacgtactttattacctgacctaaactaattactttctttttttaacnccgttaacgttaggttttcggacccgtaacgggggtaaccctaggtaccgtagggaacgtaacgttaacgaaaaagggtaccgttagggtacgggtccttacgggaccctaacccgtaagttccttaggtttccctttacgtaccgtttcccccg

SEQ ID NO: 288625 - DNA, 598 bp, Homo sapiens
  misc_feature: GYAE6OF01CUD27.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtcctccgtcctcactgtctgcgtctattggggacagagtcaccatcacttgccgggcaagtcagagcattaggaactcttaaattggtatcagcagaggccagggaacgcccctcaactcctagatctatgctgcgtccattttgactaaaggtcggggtacccagtctaaggtttcaaggttggcgtaggtggatcgtagggacaggtattcactctacacatcagcagtctgactaaccgtagaagtatttccgactacgtctttaattattagtacaaaccgtagtagttagaacctaatacgtaccccgacttacctacggttttaccgggaccgggtaacggggtacccgtaggttacggttagggtaacggtaacgtaccgtaaaaaccggtaacgttaggtaccgggtacttcggtaccgttaaaccccg

SEQ ID NO: 288626 - DNA, 509 bp, Homo sapiens
  misc_feature: GYAE6OF01BN3N5.44.75.G09.1.454.CMB.1.raw
  modified_base (373)..(373): a, c, t, g, unknown or other
  misc_feature (373)..(373): n is a, c, g, or t
  modified_base (422)..(422): a, c, t, g, unknown or other
  misc_feature (422)..(422): n is a, c, g, or t
  modified_base (506)..(506): a, c, t, g, unknown or other
  misc_feature (506)..(506): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagtatttcgcgtactttattactgaccaanaattattctttttatccgttactagttttcgccagggaccaagctgganatacgaaagactgtgctgcaccatctgtcttcactcttcccgctatctgatatatactgtctgacgcgggtctggacaaggcgntag

SEQ ID NO: 288627 - DNA, 513 bp, Homo sapiens
  misc_feature: GYAE6OF01BGEC3.44.75.G09.1.454.CMB.1.raw
  modified_base (259)..(259): a, c, t, g, unknown or other
  misc_feature (259)..(259): n is a, c, g, or t
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
  modified_base (392)..(392): a, c, t, g, unknown or other
  misc_feature (392)..(392): n is a, c, g, or t
  modified_base (454)..(454): a, c, t, g, unknown or other
  misc_feature (454)..(454): n is a, c, g, or t
  modified_base (494)..(494): a, c, t, g, unknown or other
  misc_feature (494)..(494): n is a, c, g, or t
  modified_base (509)..(513): a, c, t, g, unknown or other
  misc_feature (509)..(513): n is a, c, g, or t
tcagacagtatatacacgaccggtgctcgatttagtatagacatcagggacttaggggctttgccaggctcctgctgctctgtttccccggtgccaggtgtgacatcgagatgacccagtctccttccttcctgtcttcttctgttggaggcagcgtcaccatcacttgccgggcgagtcaggtcgttttcggtgctgttgcctggtttcaacgaaaaagggggagaggcccctaaggtcctcgtctctcgtgaaaccngactggaaggtagagtcccgtccaggttcagtgccagtccaggtggtgggccggagtccactctcaccattagcgacctgcggcctgaagnttctgcaacttntttcngtcagcagtatcatgtcgccccttnacgttttggccagggaccaagctaggaaatacaaacgactgtggctgcaccatctgtcttcnctccttcccgcctactctgatatatactgtctgagcgggntggcaggcgcatagnnnnn

SEQ ID NO: 288628 - DNA, 721 bp, Homo sapiens
  misc_feature: GYAE6OF01APX53.44.75.G09.1.454.CMB.1.raw
tcagacagtatatacacgaccggtgctcgatttagtatagacatcagggacttagggggctttgccaggctcctgctgcgtctgtttccccggtgccaggtgtgacatcgagatgacccagtctccgtcctcactgtctgcgtcgtattggggacagagtcaccatcacttgccgggcgagtgccgacagttaggtacttttttggcctggtttcagcaggacgcctggcaaacgccccgtaacgtccctgtattcttttcgtggtacttccactttggaagtaggttggacgtcccagcccgtaggttccaacggccggactaggttggtttcgtaggggacacgtactttccactccgtccacctagttcagcacgtcctgccgacgtccgtagggacgtacgttttccggaccgtaactttacgtttaccctcggtaaccctaaacgttaaactttacttttccgttttttaactcccgtttaacgttacggttttacgggacccgtaacggggaacctaaggtcgtaggtaagtactacgaaaggtacgtggtcggtacgtgactacctattcgttacgttactttaccgtacgttcccgttacccggtaccgtacgttaccgttacgtaacttaacgttaacgttaccgttacggttccgtacgggaccggtccggggtaccgttaccgggtaccgaacgggtcgtaccgtaacgg

SEQ ID NO: 288629 - DNA, 499 bp, Homo sapiens
  misc_feature: GYAE6OF01B1D88.44.75.G09.1.454.CMB.1.raw
  modified_base (497)..(497): a, c, t, g, unknown or other
  misc_feature (497)..(497): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtacttattactgaccaacaattattcttttttatccgttactagttttggccagggaccaagctggagatacaaaggactgtggctgcacatctgtcttcatctcccgcatctgatatatatgtctgagcggtctggcaggcgnag

SEQ ID NO: 288630 - DNA, 520 bp, Homo sapiens
  misc_feature: GYAE6OF01CUU2O.44.75.G09.1.454.CMB.1.raw
  modified_base (496)..(496): a, c, t, g, unknown or other
  misc_feature (496)..(496): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttctggatccacttttgaagagtggagtcccagccaggttcagcggcagtggttctgggacacatttcactctcaccatcagcagcctacagcctggagatttcgcgtacttattactgaccaaacaattattcttttttatccgttactagttttcggccgtagggggacctaagctaggagatacgaaaggtactgtggctgcactatctgtcttcacttccttcccgctactctgatatatactntctgagcggctggcaggcncntag

SEQ ID NO: 288631 - DNA, 512 bp, Homo sapiens
  misc_feature: GYAE6OF01BZ8AW.44.75.G09.1.454.CMB.1.raw
  modified_base (507)..(508): a, c, t, g, unknown or other
  misc_feature (507)..(508): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcccggcaaagcccctaagtccctgatcttttctggatccactttgaagagtggagtcccagccaggttcagcggcagtggttctgggacacatttcactctcaccatcagcagcctgcagcctggagatttcgcgtacttattactgaccaaacaattattcttttttatccgttactagttttggcctaggggacccaagctggagatcgaaaggaactgtgctgcacatctgtcttcatccttcccgcctatctgactatatactgtctgagcgggctggcaaggcnngtag

SEQ ID NO: 288632 - DNA, 524 bp, Homo sapiens
  misc_feature: GYAE6OF01D7RTX.44.75.G09.1.454.CMB.1.raw
  modified_base (267)..(267): a, c, t, g, unknown or other
  misc_feature (267)..(267): n is a, c, g, or t
  modified_base (429)..(429): a, c, t, g, unknown or other
  misc_feature (429)..(429): n is a, c, g, or t
  modified_base (498)..(498): a, c, t, g, unknown or other
  misc_feature (498)..(498): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagngtggacgtcccagccaggttcagcggcagtggttctgggacacatttcactctcaccatcagcagcctgcagcctggatatttcgcgtacttattactgaccaaactaattatttcttttttatccgttactaggttttggccgtaggggaccaagctgganatacaaaggactgtggctgcaccattctgttcttcacttccttcccgcattctgattatactattgtcngaggcgggtctggacaagggcgctag

SEQ ID NO: 288633 - DNA, 506 bp, Homo sapiens
  misc_feature: GYAE6OF01CRFWB.44.75.G09.1.454.CMB.1.raw
  modified_base (345)..(345): a, c, t, g, unknown or other
  misc_feature (345)..(345): n is a, c, g, or t
  modified_base (451)..(451): a, c, t, g, unknown or other
  misc_feature (451)..(451): n is a, c, g, or t
  modified_base (460)..(460): a, c, t, g, unknown or other
  misc_feature (460)..(460): n is a, c, g, or t
  modified_base (487)..(487): a, c, t, g, unknown or other
  misc_feature (487)..(487): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctgganattttcgcgtactttatactgccaaacaattattcttttttatcccgttactagttttcggccaggggtaccaaggctggagatacgaaaggactgtggctgcacntctgtcttnatctccgcatctgatatatatgtctgngcggctggcgaaggcgcag

SEQ ID NO: 288634 - DNA, 620 bp, Homo sapiens
  misc_feature: GYAE6OF01CZ0OS.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctagtggggacagagtcaccatcacttggccgggcgagtgccgactagttaggtactttttggccttggtttcaggcgaggacgccgtggacaaacgaccccgtaagtccctgtacttcttttctggtactcctactttaggaagtaggtcggacgtcccagccgtaggttcgacggcggcgtaggttcggtcgtgggactacgtactttcactctcacctatcagcacgctgcgagccgtaggacgtagttcgacttacttattactacgacctaactaattactttactttttactaccgttaacgttacggttttcggaccgtaacgggtaccgaagtccgtaggtaacgtacgtaacggtaaaggtacgtaggttaggccgttacgaccgtaaccgtacgttacgttacgttccttccgttaaccttcccccg

SEQ ID NO: 288635 - DNA, 535 bp, Homo sapiens
  misc_feature: GYAE6OF01BKR65.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagtatttcgcgtacttattacctgaccaactaattactttctttttactccgttactaggttttcggaccgtagggaaccaagcgtaggagatacgaaaggtactgtcgctgcacatctgttcttctacttcctcccgcctatctagtattatactactgtctgacgcgggtctcggacgacggcgcgtaag

SEQ ID NO: 288636 - DNA, 680 bp, Homo sapiens
  misc_feature: GYAE6OF01B1LKS.44.75.G09.1.454.CMB.1.raw
  modified_base (225)..(225): a, c, t, g, unknown or other
  misc_feature (225)..(225): n is a, c, g, or t
  modified_base (263)..(263): a, c, t, g, unknown or other
  misc_feature (263)..(263): n is a, c, g, or t
  modified_base (308)..(308): a, c, t, g, unknown or other
  misc_feature (308)..(308): n is a, c, g, or t
  modified_base (336)..(336): a, c, t, g, unknown or other
  misc_feature (336)..(336): n is a, c, g, or t
  modified_base (350)..(350): a, c, t, g, unknown or other
  misc_feature (350)..(350): n is a, c, g, or t
tcagacagtatatacacgaccggtgctcgatttagtatagacatcagggacgttaggggctttgccaggcctcctgctgctctcgtttcccggtgccaggtgtgacatcgagatcgacccagtctccgtcctcactgtctgcgtctagtggggacagagtcacatcacttggccgggcgagtcgccgactagttaggtcttttttggccttggtttcagcaggancctggacaaacgtcccctaagtccctgtattcttttcnggactcctagtttgaagtaggtgacgtccagcctaggttcagcgnagttggtcgtggacactatttcacttcncacatcagcagctncagctggatactttcgcgtaacttattactcgaacaaactaattacttttactttttacgtacccgttacgttaacggtttttcgggaccgtaacgggggtaaccaaacggtaccgtttaggaagtacttaacggaaaacggtaactgggttaacggcttaggacctaacctaacgtttcgtcggtttccttaccttaacttacccgtttccccgacttaacttccgtaggtaactttaacgttaaccgttaaccgttcggttacccgtaggttaacgggccgggggtccttacggggacccgttaaacggggtccgacccgttaaacgg

SEQ ID NO: 288637 - DNA, 508 bp, Homo sapiens
  misc_feature: GYAE6OF01DG9AT.44.75.G09.1.454.CMB.1.raw
  modified_base (228)..(228): a, c, t, g, unknown or other
  misc_feature (228)..(228): n is a, c, g, or t
  modified_base (316)..(316): a, c, t, g, unknown or other
  misc_feature (316)..(316): n is a, c, g, or t
  modified_base (401)..(401): a, c, t, g, unknown or other
  misc_feature (401)..(401): n is a, c, g, or t
  modified_base (431)..(431): a, c, t, g, unknown or other
  misc_feature (431)..(431): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
  modified_base (480)..(480): a, c, t, g, unknown or other
  misc_feature (480)..(480): n is a, c, g, or t
  modified_base (499)..(499): a, c, t, g, unknown or other
  misc_feature (499)..(499): n is a, c, g, or t
tcagacagtatatacacgaccggtgctcgatttagtatagacatcagggacttaggggctttgccaggctcctgctactctggctccgaggtgccagatgtgacatccagatgacccagtctccttcctccctgtctgcttctataggagacagagtcgccatcacttgccgggcaagtcagaccattaacagctatttaaattggtatcagcagagaccagggaaancccctgaactcctgatctctgctgcctccactctgcaagggtgagtcttcttcgaaggttcaggtggcaggtggatcgtgggacagtntttcactctcaccatctccagtctgaccaactgattatttgactaacttactactgtacaacgagtagttatactcgtcccgttntacgttttgggcggggtaccaagctagganctacaaacgactggtcgctgcacntctntcttcattcctccgctatctnattatactacttgtgtagnggcggtacg

SEQ ID NO: 288638 - DNA, 499 bp, Homo sapiens
  misc_feature: GYAE6OF01C3ZLL.44.75.G09.1.454.CMB.1.raw
  modified_base (250)..(250): a, c, t, g, unknown or other
  misc_feature (250)..(250): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagagtggatcccagccaggttcagcggcagtggttctgggacacatttcactctcaccatcagcacgctgcagcctggagatttcgcgtactttatactgaccaataatattcgtttttatccgttatagtttcggccgagggaccaagctgagatacaaagactgtgctgcacatctgtctcattcctccgctatctgtatatactatgtctgagcgggtctggacaaggcgcag

SEQ ID NO: 288639 - DNA, 502 bp, Homo sapiens
  misc_feature: GYAE6OF01C3TWI.44.75.G09.1.454.CMB.1.raw
  modified_base (369)..(369): a, c, t, g, unknown or other
  misc_feature (369)..(369): n is a, c, g, or t
  modified_base (415)..(415): a, c, t, g, unknown or other
  misc_feature (415)..(415): n is a, c, g, or t
  modified_base (463)..(463): a, c, t, g, unknown or other
  misc_feature (463)..(463): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgactttatactgccaanaatattctttttatccgtactagttttgcctaggggcaagctgganatcaaaggactgtggctgcaccatctgtcttcactcttcccgctatcngtatatattactgtctgagcgggtctggcaaggcgctag

SEQ ID NO: 288640 - DNA, 506 bp, Homo sapiens
  misc_feature: GYAE6OF01AB6TG.44.75.G09.1.454.CMB.1.raw
  modified_base (346)..(346): a, c, t, g, unknown or other
  misc_feature (346)..(346): n is a, c, g, or t
  modified_base (369)..(369): a, c, t, g, unknown or other
  misc_feature (369)..(369): n is a, c, g, or t
  modified_base (436)..(436): a, c, t, g, unknown or other
  misc_feature (436)..(436): n is a, c, g, or t
  modified_base (460)..(460): a, c, t, g, unknown or other
  misc_feature (460)..(460): n is a, c, g, or t
  modified_base (469)..(469): a, c, t, g, unknown or other
  misc_feature (469)..(469): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctgggcaaagcccctaagtccctgatcttttctggatccactttgaagagtggagtcccagccaggttcagcggcagtggttctgggacacatttcactctcaccatcagcagcctgcagcctgganatttcgcacttatactgaccaanattattctttttatccgtactgtttcgccgtagggacagcgtaggagatacaaaggactgtgctgcncatctgtcttcactccttccgctntctgatatntacttgtctaggagcgggctggacgaacggcgcgtag

SEQ ID NO: 288641 - DNA, 611 bp, Homo sapiens
  misc_feature: GYAE6OF01DFO7S.44.75.G09.1.454.CMB.1.raw
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaacgcccctaagtccctgattcttttcnggatccactttgaagngtggagtcccagccaggttcagcggcagtggttctgggacacatttcactctcaccatcagcacgcctgcagcctggacgtatttcgacgtacttacttactgacctaactaattactttcttttttaacgtcccgttaacgttaggttttacggaccgtaacgggggtaaccctaaggtccgtagggtaacgtaacgttaacgtaaaaacggggtaacttagggttacgggtaccgttacggaccctaaacccgtacgtttaccgttaggtttacctttccgtaacgtttccccccg

SEQ ID NO: 288642 - DNA, 577 bp, Homo sapiens
  misc_feature: GYAE6OF01AGDW8.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacactatttcactctcaccatcagcagcctgcagcctggatattttcgcgtactttattactgaccaaactaatttactttccttttttactacccgttacttacggttttcggacccgtaaggggaacctaaggtccgtagggaagtaacgtacgaaaagggtactggtacggctcgactaccatcttgttccttactacttccttccccgcctattcctagtacttatacttacttgtctggacggcgggtctcggacgacggcgtgtag

SEQ ID NO: 288643 - DNA, 502 bp, Homo sapiens
  misc_feature: GYAE6OF01C24TN.44.75.G09.1.454.CMB.1.raw
  modified_base (346)..(346): a, c, t, g, unknown or other
  misc_feature (346)..(346): n is a, c, g, or t
  modified_base (492)..(492): a, c, t, g, unknown or other
  misc_feature (492)..(492): n is a, c, g, or t
  modified_base (499)..(499): a, c, t, g, unknown or other
  misc_feature (499)..(499): n is a, c, g, or t
tcagacagtatatacacgaccggtgctcgatttagtatagacatcagggacttaggggctttgccaggctcctgctgctctgtttccccggtgccaggtgtgacatcgagatgaccccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctgganatttcgcgactttattactgccaaactaatattctttttatccgttactagttttggcctagggaccaagctggagatacaaaggactgtgctgcacatctgtcttcatcctccgcatctgatatatactgtctgagcggtctggnaaggcgntag

SEQ ID NO: 288644 - DNA, 489 bp, Homo sapiens
  misc_feature: GYAE6OF01DR8D2.44.75.G09.1.454.CMB.1.raw
  modified_base (234)..(234): a, c, t, g, unknown or other
  misc_feature (234)..(234): n is a, c, g, or t
  modified_base (484)..(484): a, c, t, g, unknown or other
  misc_feature (484)..(484): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcaagtcagagcattaggaactctttaaattggtatcagcagaggccagggaaagcccctnaactcctgatctatgctgcgtccattttgcaaagtggggtcccatcaaggttcagtggcagtggatctgggacagatttcactctcaccatcagcagtctgcaacctgaagatttcgctagcttattattgtcaacagagtagacaatactccgctcactttcggcggagggaccagttgtggagtatacgaaacgacgtgtggctggcacatctgtcttcatcttccgcatctgatatatactgtctgngtcgg

SEQ ID NO: 288645 - DNA, 519 bp, Homo sapiens
  misc_feature: GYAE6OF01C1ZP7.44.75.G09.1.454.CMB.1.raw
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagtactttcgcgactttatactgaccaaactaatattctttttatccgttacgtttgtcgacgggacgagacgtgagatacgaaagaacgtgtgcgtgcacatctcgtcttctactcttcccgcctactctgtatatactactgtctgacgcgggcgtcggcgaggacgngngtag

SEQ ID NO: 288646 - DNA, 621 bp, Homo sapiens
  misc_feature: GYAE6OF01D14RA.44.75.G09.1.454.CMB.1.raw
  modified_base (421)..(421): a, c, t, g, unknown or other
  misc_feature (421)..(421): n is a, c, g, or t
  modified_base (537)..(537): a, c, t, g, unknown or other
  misc_feature (537)..(537): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagtcaggagcctggacaaacgcccctaagtcccctgtacttcttttcgtggacttccactttggaagtaggtggacgtcccaggcctaggttcaggtccggctaggttgggtttcgtggggaacctacgtattttccaaccgttctacacctagtcagcagcctgcagcctggactatttcgacgtactttatactcgaccaactaattntttcctttttactccgttattacggttttggccgtaaggggaccaaggcgttaggagtacgtacgaaaggtactggtcggtctgcaccgtatctcgtcttctacttcctcccgctntctcgtaacttaacgttacttacgttcggttccgtacggtacggtcgggtacgtacgggaccgtaacgggtccgtacgtaacgg

SEQ ID NO: 288647 - DNA, 668 bp, Homo sapiens
  misc_feature: GYAE6OF01EHQ8P.44.75.G09.1.454.CMB.1.raw
  modified_base (260)..(260): a, c, t, g, unknown or other
  misc_feature (260)..(260): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgacattaggtacttttttggccttggtttcagcaggagcctggacaaacgcccctaagtccctgtacttctttttcnggtacttcctactttaggaagtaggtggacgtcccagccgtaggttcaggcggcgtaggttggttcgtgggacctactatttccactctacacctatcacgcacgcctgcacgccgtaggagtactttcgacgttaactttattaccgtacgacctaaactaatttacttttaccttttttaacgttacccgtttaacgttacggttttacgggacccggtaacggggtaacctaacggtcgtaggaagtaacgtaacgaaaggtacgtggtcggactcgactaacctacgttctacgttaccttactaccgtttccctacccgtacctacttccgtagtatttaacgtacttacgttcgtacgtacgggtacggtccgggtcgtacgggaccgaacgggcctagtag

SEQ ID NO: 288648 - DNA, 502 bp, Homo sapiens
  misc_feature: GYAE6OF01BAB77.44.75.G09.1.454.CMB.1.raw
  modified_base (483)..(483): a, c, t, g, unknown or other
  misc_feature (483)..(483): n is a, c, g, or t
  modified_base (498)..(498): a, c, t, g, unknown or other
  misc_feature (498)..(498): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtacttattactgaccaacaattattcttttttatccgttactagttttggccaggggaccaagctggagatcaaaggactgtgctgcaccatctgtcttcatcttcccgctatctgatatatatgtctgngcggctggacaggcncgag

SEQ ID NO: 288649 - DNA, 732 bp, Homo sapiens
  misc_feature: GYAE6OF01BIU30.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatcgaccagtctccgtcctcactgtctgcgtctagttgggacagagtcaccatcacttcggccgggcgagtcgccgactagttaggttacttttttcggccgttggtttcagcgaggacgccgtggacaaaccgtcccctaacgtccctgtactttccttttcgtggacttcctacgttttaggaagtaggtggacgtcccgagccgtaggttcacggcggcaggttcggttcgtgggacactatttcactctcacatcagcagcctgcacgtccgtggagtacgtttcgacgttaactttaacttacctcgaaccctaaactaatttactttttacctttttttaacgtaccccgttaacgttttacgggttttaccgggacccggtaacgggggtaaccctaaggtccggttagggaacgtaacgttaaccggaaaaacgggttaccgttagggttacgggtccgttacggacctaacccgtatttccgttacgttccctttacctaccgtttccccgttccccgacccttacttccgtagtaacttaacgttacttacgttcggttacgtagggtacgggtccgggtacgttcgggaacggaacgggtccgacgtaacg

SEQ ID NO: 288650 - DNA, 497 bp, Homo sapiens
  misc_feature: GYAE6OF01CINM9.44.75.G09.1.454.CMB.1.raw
  modified_base (346)..(346): a, c, t, g, unknown or other
  misc_feature (346)..(346): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggganatttcgcgattatactgccaacaattattcttttttatccgttacagttttggccaaggggaccaagctggagatcaaaggactgtgctgcacatctgtcttcatcttcccgcatctgatatatatgtctgagcggctggnaaggngtcag

SEQ ID NO: 288651 - DNA, 585 bp, Homo sapiens
  misc_feature: GYAE6OF01C31EM.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggtctgggacacatttcactctcaccatcagcagcctgcagcctggagtatttcgcgtacttattactgaccaactaattattctttttatccgttactagttttggccgaagggacctaaggctaggagtatacgaaaaggtaactggtacggctacgccaaccaattcctagttcctttactaacttcccgttccccgacctacttccttagtaacttaaattacttaacttcggttcgttacggagggtccggggtcgttacgggaccggaaacgggcgacgtaag

SEQ ID NO: 288652 - DNA, 529 bp, Homo sapiens
  misc_feature: GYAE6OF01BI5U0.44.75.G09.1.454.CMB.1.raw
  modified_base (252)..(252): a, c, t, g, unknown or other
  misc_feature (252)..(252): n is a, c, g, or t
  modified_base (302)..(302): a, c, t, g, unknown or other
  misc_feature (302)..(302): n is a, c, g, or t
  modified_base (374)..(374): a, c, t, g, unknown or other
  misc_feature (374)..(374): n is a, c, g, or t
  modified_base (502)..(502): a, c, t, g, unknown or other
  misc_feature (502)..(502): n is a, c, g, or t
  modified_base (525)..(525): a, c, t, g, unknown or other
  misc_feature (525)..(525): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgatcttttcnggatccactttgaagagtggagtcccagccaggttcagcgcagtggttcngggacacatttcactctcaccatcagcagcctgcagcctggagatttcgcgtacttattactgaccctaaanaattacttcttttttaatcccgttacttagttttcggaccgtaggggaaccaaggcctaggatagtacaaaggactgtggctgcacatctgtcttcacttcctcccgcctatctgtatatactacgtntctgaggcggctggacaaggcgntaag

SEQ ID NO: 288653 - DNA, 511 bp, Homo sapiens
  misc_feature: GYAE6OF01CCPSF.44.75.G09.1.454.CMB.1.raw
  modified_base (508)..(508): a, c, t, g, unknown or other
  misc_feature (508)..(508): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggttctgggacacatttcactctcaccatcagcagcctgcagcctggagatttcgcgtacttattactgccaacaattattctttttatccgttactacgttttggccaggggaccaagctggagatacaaagtactgtggctgcaccattctgttccttcacttccttcccgcctatctgatatatctgtcgtgagcggtctggacaggcgntag

SEQ ID NO: 288654 - DNA, 502 bp, Homo sapiens
  misc_feature: GYAE6OF01C87TZ.44.75.G09.1.454.CMB.1.raw
  modified_base (339)..(339): a, c, t, g, unknown or other
  misc_feature (339)..(339): n is a, c, g, or t
  modified_base (356)..(356): a, c, t, g, unknown or other
  misc_feature (356)..(356): n is a, c, g, or t
  modified_base (463)..(463): a, c, t, g, unknown or other
  misc_feature (463)..(463): n is a, c, g, or t
  modified_base (491)..(491): a, c, t, g, unknown or other
  misc_feature (491)..(491): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgtcgacattaggacttttttggcctggtttcagcaggagcctggcaaagcccctaagtccctgatcttttctggatccacttgaagagtggagtccagccaggttcagcgcagtggtctggacacatttcactctcaccatcagcagcctgcagctgganatttcgcgattattacngaccaaacaatattctttttatccgttactagttttggcctaggggaaccaagctggagatacaaagactgtggctgacacccatctgtcttcattctcccgcatcngatatatactgtctgagtcgggctgganaacggcgcaag

SEQ ID NO: 288655 - DNA, 505 bp, Homo sapiens
  misc_feature: GYAE6OF01CCBL7.44.75.G09.1.454.CMB.1.raw
  modified_base (253)..(253): a, c, t, g, unknown or other
  misc_feature (253)..(253): n is a, c, g, or t
  modified_base (368)..(368): a, c, t, g, unknown or other
  misc_feature (368)..(368): n is a, c, g, or t
  modified_base (502)..(502): a, c, t, g, unknown or other
  misc_feature (502)..(502): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaagcccctaagtccctgattctttcnggatccactttgaagagtggagtcccagccaggttcagcgcagtggttctgggacacatttcactctcacatcagcagcctgcagcctggagatttcgcacttatactgaccaanaatattctttttatccgttactagttttcgccgagggaccagctggagatacaaaggactgtgctgacaccatctgtcttcacttccttcccgctatcctgatatatactgttctgagcggctgggcacggcgntag

SEQ ID NO: 288656 - DNA, 505 bp, Homo sapiens
  misc_feature: GYAE6OF01EIEGA.44.75.G09.1.454.CMB.1.raw
  modified_base (485)..(485): a, c, t, g, unknown or other
  misc_feature (485)..(485): n is a, c, g, or t
  modified_base (502)..(502): a, c, t, g, unknown or other
  misc_feature (502)..(502): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctggggacacatttcactctcaccatcagcagcctgcagcctggagatttcgcgtacttattactgaccaaacaattattctttttatccgttactagttttggcctagggaccaagctggagatcaaaggactgtgctgcaccatctgtcttcactccttcccgcatctgatatatatgtctgngcggtctggacaggcgntag

SEQ ID NO: 288657 - DNA, 598 bp, Homo sapiens
  misc_feature: GYAE6OF01DZ4Y2.44.75.G09.1.454.CMB.1.raw
  modified_base (252)..(252): a, c, t, g, unknown or other
  misc_feature (252)..(252): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgatcttttcnggatccactttgaagagtggagtcccagccaggttcagcggcagtggttctgggacactatttcacttctcaccatcagcagcctgcagcctggatatttcgcgtactttatactcgaccaaataattatttctttttactaccgttactagttttcggaccgtaggggaccaagtcgtggagtatacgaaaggtacttggtcggtctcggaccaaccgtattaccgttcgttcctttacgtactttcccgttcccccgtacctacttccgttagtattacgttaacgttactcggttcgtacgtacgggacgggtcgttacgggacgaacgggtccgacgtaacg

SEQ ID NO: 288658 - DNA, 541 bp, Homo sapiens
  misc_feature: GYAE6OF01BL3ZL.44.75.G09.1.454.CMB.1.raw
  modified_base (536)..(536): a, c, t, g, unknown or other
  misc_feature (536)..(536): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggacgtcccagccaggttcaggcggcaggtggttcgtgggacactatttcactctcaccatcagcagcctgcagcctggactatttcgcgtacttattactcgaccaaactaattacttctttttactccgttactagttttcggccgtagggaccaagctaggagatacgaaaggtactgtggctcgcacctatctgttcttctacttcctcccgcctatctgattatacttactgtctggacggcgggtcgtcggacgaaggcgngtacg

SEQ ID NO: 288659 - DNA, 509 bp, Homo sapiens
  misc_feature: GYAE6OF01BDFM1.44.75.G09.1.454.CMB.1.raw
  modified_base (507)..(507): a, c, t, g, unknown or other
  misc_feature (507)..(507): n is a, c, g, or t
tcagacagtatatacacgaccggtgctcgatttagtatagacatcagggacttaggggctttgcaaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtactttattactgaccaaacaattattcttttttatccgttactagtttggccaggggaccaagctaggagatacaaaggactgtggctgcaccatctgtcttcacttccttcccgcatctgatatactatgtctgagcgggctggacaggcgnag

SEQ ID NO: 288660 - DNA, 513 bp, Homo sapiens
  misc_feature: GYAE6OF01DQ9AW.44.75.G09.1.454.CMB.1.raw
  modified_base (251)..(251): a, c, t, g, unknown or other
  misc_feature (251)..(251): n is a, c, g, or t
  modified_base (491)..(491): a, c, t, g, unknown or other
  misc_feature (491)..(491): n is a, c, g, or t
  modified_base (503)..(503): a, c, t, g, unknown or other
  misc_feature (503)..(503): n is a, c, g, or t
  modified_base (509)..(509): a, c, t, g, unknown or other
  misc_feature (509)..(509): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggtctgggacacatttcactctcaccatcagcagcctgcagcctggagtatttcgcgtacttatctgccaaactaatattctttttatccgttactagttttggccctaaggggaccaaggctaggagatacgaaaggactgtggctgcaccatctgttcttcacttccttcccgctatctgtatatatatgtcngagcggctgganagggcncgta

SEQ ID NO: 288661 - DNA, 625 bp, Homo sapiens
  misc_feature: GYAE6OF01CXZ1E.44.75.G09.1.454.CMB.1.raw
  modified_base (252)..(252): a, c, t, g, unknown or other
  misc_feature (252)..(252): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttcnggatccacttttgaagtagtggagtcccagccaggttcagcggcagtggtctgggacacatttcactctcaccatcagcagcctagcagccgtggagtatttcgcgtactttaattctagaccctaaataattacgtttcttttttacgtacccgttacgttacggtttttcgggaccgtaacggggtaacctaagttccgtaggaagtaactaaccgaaaaggtaacgtggttacggacttacggacaaccgtaatccgttcggttaccttaccgtaacttccctttcccgaccttagttccgtagtaacttaagtacttaacgttgttcgtcggtacggtccggtcgttacggtacgaacggcgacgtaag

SEQ ID NO: 288662 - DNA, 513 bp, Homo sapiens
  misc_feature: GYAE6OF01CACOB.44.75.G09.1.454.CMB.1.raw
  modified_base (252)..(252): a, c, t, g, unknown or other
  misc_feature (252)..(252): n is a, c, g, or t
  modified_base (348)..(348): a, c, t, g, unknown or other
  misc_feature (348)..(348): n is a, c, g, or t
  modified_base (494)..(494): a, c, t, g, unknown or other
  misc_feature (494)..(494): n is a, c, g, or t
  modified_base (503)..(503): a, c, t, g, unknown or other
  misc_feature (503)..(503): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgatcttttcnggatccactttgaagagtggagtcccagccaggttcagcggcagtggttctgggacacatttcactctcaccatcagcagcctgcagcctggagtntttcgcgtacttattactgaccaactaattatttctttttatcccgttactagttttggaccgtaggggaccaagcgtaggagactacaaaggactgtggctgcacatctgtcttcattctcccgctatctgatatatatgtctgngcggctggnacggcgctag

SEQ ID NO: 288663 - DNA, 551 bp, Homo sapiens
  misc_feature: GYAE6OF01B8PM7.44.75.G09.1.454.CMB.1.raw
  modified_base (255)..(255): a, c, t, g, unknown or other
  misc_feature (255)..(255): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaagcccctaagtccctgacttcttttcnggatccactttgaagagtggagtcccagccaggttcagcggcagtggttctgggacacatttcactctcaccatcagctagcctgcagcctggacgtatttcgcgtaactttattactacgacctaaacaattatttacttttttactccgttactagtttttcggccgtacggggtacctaagcgtaggagtatacgaaaggactgtgctgcaccatctgttctctactccttccgctactctagtatactacttatgtccgtagacgcgggtcgtaggacgaaggcgcgtaacg

SEQ ID NO: 288664 - DNA, 532 bp, Homo sapiens
  misc_feature: GYAE6OF01DAE88.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgaccccagtctccatcctccctgtctgcatctgtgggagacagagtcaccatcacttgccgggcgagtcagggcattagcaattatttagcctggtatcagcagaaaccagggaaagctacctaagctcctgatctatgaaacatccattttgcaatcagggtcccatctcggttcagcggcagtggatcgtgggacagatttcactctcaccgtcagcagcctgcagcctagacgtatgttagactaacgtttattaactagtactaaaagtataaacgagtcgaccctacacctacgtttccggccctagggaccagagtcggaatatacgaacgacgtaacgtcgtaggtctgccacctattctcgttcttacgtacttccttcccgctactctagtacttatatactgtgtacggg

SEQ ID NO: 288665 - DNA, 535 bp, Homo sapiens
  misc_feature: GYAE6OF01B5XSL.44.75.G09.1.454.CMB.1.raw
  modified_base (530)..(530): a, c, t, g, unknown or other
  misc_feature (530)..(530): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttccgcgtactttattactgaccaactaattattcttttttactccgttactagtttcggccgtagggacctaagcgtaggagatacgaaggaacgttgtgctgcacctatctgttcttctacttccttcccgacctatcctgtacttatacttactgtctgacggcggtctcggacaggcgngtacg

SEQ ID NO: 288666 - DNA, 610 bp, Homo sapiens
  misc_feature: GYAE6OF01DMW9O.44.75.G09.1.454.CMB.1.raw
  modified_base (303)..(303): a, c, t, g, unknown or other
  misc_feature (303)..(303): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaagcccctaagtccctgatctttctggatccactttgaagagtggagtcccagccaggttcagcggcagtggttcngggacacatttcactcctcaccatcagcacgcctgcacgcctggagtactttcgacgtacttattactcgaccaactaattactttctttttactccgttactaggttttcggccgtaaggggtacctaagcgtaggagtaatacgaaagggtactaggtacggtcgtcgacctacctagtcttgttaccttactacttcccttcccgacccttacgttctacgtaacttacgttacttacgttcgttccgttacgggacggttccggggtacgttacgggaaccgtaaacgggccgtaacgtacgg

SEQ ID NO: 288667 - DNA, 657 bp, Homo sapiens
  misc_feature: GYAE6OF01CGML6.44.75.G09.1.454.CMB.1.raw
  modified_base (234)..(234): a, c, t, g, unknown or other
  misc_feature (234)..(234): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
tcagacagtatatacacgaccggtgctcgatttagtatagacatcaggggaggaatcagacccagtcaggacacagcatggacatgagagtcctcgctcagctcctggggctcctgctgctctggctcccaggtgccaaatgtgacatccagatgacccagtctccttccttcctgtcttcttctgttggaggcagcgtcaccatcacttgccgggcagtcaggtcgtttcggngctgttgcctggtttcaaacgaaaaggggtagacggccctaaggtcctcgtctctcgtagaaccagactggaagtagacgtcccgtcaggttcagtcgccagtccgaggtggtcgggccggagtcccacgtctcgactattagcgacctgccggcctgaacgtnttcgngctaactttacttctacgtcagacgtagttactcgtaagttcgtcggtcccccgtttagtaccggtttttcgggaccggtaaccgggggtaacctaacgggtacgtaacgggtaaacttaaccgaaaaccggttaaaccgttcgggttaacgggaccttacgggtacccctaaacccgtacgttacccgttacggtttaccctttaccgttaaacctttcccccgtttacccccggtaccttaacgtttacccg

SEQ ID NO: 288668 - DNA, 509 bp, Homo sapiens
  misc_feature: GYAE6OF01AYQ27.44.75.G09.1.454.CMB.1.raw
  modified_base (475)..(475): a, c, t, g, unknown or other
  misc_feature (475)..(475): n is a, c, g, or t
  modified_base (507)..(507): a, c, t, g, unknown or other
  misc_feature (507)..(507): n is a, c, g, or t
tcagacagtatatacacgaccggtgctcgatttagtatagacatcagggacttaggggctttgccaggatcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagtatttcgcgtacttattactgacctaacaattattcttttttatccgttactagttttcggccgtagggaccaagcgtaggagatacgaaaggactggtgctgcaccatctgtcttcatctccgcatctnatatatactgtctgagcggtctggacaggcgnag

SEQ ID NO: 288669 - DNA, 503 bp, Homo sapiens
  misc_feature: GYAE6OF01ENE3M.44.75.G09.1.454.CMB.1.raw
  modified_base (251)..(251): a, c, t, g, unknown or other
  misc_feature (251)..(251): n is a, c, g, or t
  modified_base (345)..(345): a, c, t, g, unknown or other
  misc_feature (345)..(345): n is a, c, g, or t
  modified_base (494)..(494): a, c, t, g, unknown or other
  misc_feature (494)..(494): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggttctgggacacatttcactctcaccatcagcagcctgcagcctgganatttcgcgtacttattactgaccaaataatattcttttttatccgttactagttttggccagggaccaagctggagatacaagactgtgctgcacatctgtcttcactcttcccgcatctgatatactatgtctgagcgggtctagganaggcgctag

SEQ ID NO: 288670 - DNA, 506 bp, Homo sapiens
  misc_feature: GYAE6OF01C19CR.44.75.G09.1.454.CMB.1.raw
  modified_base (344)..(344): a, c, t, g, unknown or other
  misc_feature (344)..(344): n is a, c, g, or t
  modified_base (504)..(504): a, c, t, g, unknown or other
  misc_feature (504)..(504): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggttcagcaggagcctggcaaagcccctaagtccctgatcttttctggatccactttgaagagtggagtcccagccaggttcagcggcagtggttctgggacacatttcactctcaccatcagcagcctgcagcctgganatttcgcgactttatactgaccaaacaattattctttttatccgttactagttttggcctaggggaccaagctggagatacaaaggactgtggctgcacatctgtcttcacttcttcccgccatctgatatatactgtctgagcgggtctggcaaggcgnag

SEQ ID NO: 288671 - DNA, 512 bp, Homo sapiens
  misc_feature: GYAE6OF01DRGP6.44.75.G09.1.454.CMB.1.raw
  modified_base (376)..(376): a, c, t, g, unknown or other
  misc_feature (376)..(376): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (502)..(502): a, c, t, g, unknown or other
  misc_feature (502)..(502): n is a, c, g, or t
  modified_base (510)..(510): a, c, t, g, unknown or other
  misc_feature (510)..(510): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatcctactttgaagagtggagtcccagccaggttcagcggcagtggttctgggacacatttcactctcaccatcagcagcctgcagcctggagatttcgacgtactttatactgaccctaaanaattatttcttttttatccgttactagttttcggaccgtaggggaccaagctggagatacgaaagtactgtgctgcacatctgtcttcatcctccgcatctgatatatatgtcngngcggtctggnaacggcgnag

SEQ ID NO: 288672 - DNA, 523 bp, Homo sapiens
  misc_feature: GYAE6OF01AW83C.44.75.G09.1.454.CMB.1.raw
  modified_base (445)..(445): a, c, t, g, unknown or other
  misc_feature (445)..(445): n is a, c, g, or t
  modified_base (475)..(475): a, c, t, g, unknown or other
  misc_feature (475)..(475): n is a, c, g, or t
  modified_base (519)..(519): a, c, t, g, unknown or other
  misc_feature (519)..(519): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagtatttcggctaacttattactgacctaaactaatactttctttttaatccgttactagtttggaccgagggaccaagcgtggagatacgaaagactgtgntgacacctatctgtctctactcctcccgcntctgatatacttatgtctgacggcggtactcgggacgacggcgntaag

SEQ ID NO: 288673 - DNA, 677 bp, Homo sapiens
  misc_feature: GYAE6OF01D30HP.44.75.G09.1.454.CMB.1.raw
  modified_base (218)..(218): a, c, t, g, unknown or other
  misc_feature (218)..(218): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctagttggggacagagtcaccatcacttgccgggngagtcgccgacagtttaggtacttttttggccttggtttcagcaggagcctggacaaacgcccctaagtcccctgacttcttttctggactcctactttgaagtagtggagtcccagcctaggttcaggcggctaggtcggttcgtgggactacgtatttcacttcctcaccattaccgagaccacgtcccgtagccgaacggtcccgttagggaacgttacgttttccggaccgtttaactttacgtttaacgtcgaacccctaaacttaactttaacttttccttttttttaacgtacccgttttaacgttacgggtttttaccggacccgtaacgggggttaacccaagggtccgttaggggaacgtaaacgttaacgaaaacgggttacttagggtacggtccgtacggacctaaccgtacgttaccgttagtttcctttcctccgtttaccccg

SEQ ID NO: 288674 - DNA, 541 bp, Homo sapiens
  misc_feature: GYAE6OF01EQNN3.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgtagcctggagactttcgcgtacttattactgaccaaactaattattctttttttacttccgttacttaggttttggaccgtacggggaaccctaaggcgtggaagagtacgaaaggaactgtcggctgcacactctgtcttctacttccttcccgacctactctgtatatatactgtctgacgcgggctcggacaaggcgctgtag

SEQ ID NO: 288675 - DNA, 511 bp, Homo sapiens
  misc_feature: GYAE6OF01CB3G4.44.75.G09.1.454.CMB.1.raw
  modified_base (251)..(251): a, c, t, g, unknown or other
  misc_feature (251)..(251): n is a, c, g, or t
  modified_base (346)..(346): a, c, t, g, unknown or other
  misc_feature (346)..(346): n is a, c, g, or t
  modified_base (485)..(485): a, c, t, g, unknown or other
  misc_feature (485)..(485): n is a, c, g, or t
  modified_base (507)..(507): a, c, t, g, unknown or other
  misc_feature (507)..(507): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggttctgggacacgatttcactctcaccatcagcagcctgcagcctgganatttcgcgtacttattactgaccaacaattattctttttatccgttactagttttggcctagggaccaagctaggagatacaaaggactgtgctgcaccatctgtcttcattcctccgctatctgtatatatactgtcngagcgggtctgggcaacggcgngtag

SEQ ID NO: 288676 - DNA, 615 bp, Homo sapiens
  misc_feature: GYAE6OF01BH39G.44.75.G09.1.454.CMB.1.raw
  modified_base (253)..(253): a, c, t, g, unknown or other
  misc_feature (253)..(253): n is a, c, g, or t
  modified_base (307)..(307): a, c, t, g, unknown or other
  misc_feature (307)..(307): n is a, c, g, or t
  modified_base (372)..(372): a, c, t, g, unknown or other
  misc_feature (372)..(372): n is a, c, g, or t
tcagacagtatatacacgaccggtgctcgatttagtatagacatcagggacttaggggctttgtcaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaacgcccctaagtccctgattcttttcnggatcctactttgaagagtggacgtcccagccaggttcaggcggcagtggttcngggacactatttcactctcaccatcagcagcctgcagcctggatactttcgacgtacttattacngaccaataattactttacctttttactccgttacttagttttacggaccgtaagggaaccaagtcgtaggagtacgtacgaaaggtactggtcggtctacgactaaccgtacttaccgtcgttacctttactacttcccgttaccccgacctacttccgttacgtaattaacttaacttacgttacggttccgttacgggacggtccgggtacgtacgggtacggaacgggtccgacgtaacg

SEQ ID NO: 288677 - DNA, 748 bp, Homo sapiens
  misc_feature: GYAE6OF01BXTZI.44.75.G09.1.454.CMB.1.raw
tcagacagtatatacacgaccggtgctcgatttagtatagacatcaggggaggaatcagacccagtcaggacacagcatggacatgagagtcctcgctcagctccgtggggctcctgctgctctcgtttccccggtgccaggtgtgacatcgagatcgacccagtcctccgtcctcactgtctgcgtctagtgggacagagtcaccatcacgttcggccgggcgagtcgccgatagtttaggttactttttggccttggttcagcgaggacgccgtaggaccaaaccgtcccctaacgtcccctgtactttcttttcgtggtactccgtacgtttaggaaggtaggtacggtacgtcccgaggtaccgtacggttccgacggccggtacgtagggttcggttcgtacgggacctacgttactttaccgaccttcctaccaacctactaccgacgaccgtaccgtaccgcgttttttttttttttttttttttttttttttccgaccgtaccgtacggtacggtacgtttaccggtaccgttaaccgtttaactttaaccgttaccgtaaccgtaaacttaactttaacttttactttttaaccgtttaccgtttacgtttacggtttacggtaccggtaacgggtaaccgtacggtacggtaggtaacgtaacgtaacgtaaacggtaacgtaggtacggtcgtacgtaccgtacctacttacgttacgttccttccgtaccgttccc

SEQ ID NO: 288678 - DNA, 562 bp, Homo sapiens
  misc_feature: GYAE6OF01AX09Q.44.75.G09.1.454.CMB.1.raw
  modified_base (302)..(302): a, c, t, g, unknown or other
  misc_feature (302)..(302): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttcngggacacatttcactctcaccatcagcagcctgcagcctggagtatttcgcgtactttatactgaccaaactaattatttcttttttactccgttactacgttttcggaccgtaggggaacctaaggcgtaggagatacgaaaggtactggtagctgacacctatctgttccttctacttccgttcccgcctattccgtagtacttacgttacttacgttgtctaggacggtccgggtcgtaggacgacgggcgcgtacg

SEQ ID NO: 288679 - DNA, 528 bp, Homo sapiens
  misc_feature: GYAE6OF01BROXR.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaagcccctaagtccctgattcttttctggatcctactttgaagagtggagtcccagccaggttcagcggcagtggttcgtgggacactatttcactctcaccatcagcagcctgcagcctggagtatttccgcgtacttatactcgaccaaataattatttctttttactccgttactagtttcggacgtagggacctagcgtggagatacgaagtactgtggctgcacatctgtcttctacttcctcccgctatctagtatatactacttgtctgagcgggtctaggacgaggcgacgag

SEQ ID NO: 288680 - DNA, 525 bp, Homo sapiens
  misc_feature: GYAE6OF01CBVTE.44.75.G09.1.454.CMB.1.raw
  modified_base (374)..(374): a, c, t, g, unknown or other
  misc_feature (374)..(374): n is a, c, g, or t
  modified_base (521)..(521): a, c, t, g, unknown or other
  misc_feature (521)..(521): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttctggatccactttgaagagtggagtcccagccaggttcagcggcagtggttctgggacacatttcactctcaccatcagcagcctgcagcctggagtatttcgcgtacttattactgaccaaanaattatttactttttatccgttactagttttcggacgagggaccaagctaggagatacgaaaggtactgtgtctgcacatctgtcttcacttcctccgcctatctgtatatatactgtctcggaggcggtcgtaggacgaacggcgntaag

SEQ ID NO: 288681 - DNA, 509 bp, Homo sapiens
  misc_feature: GYAE6OF01CF74Q.44.75.G09.1.454.CMB.1.raw
  modified_base (491)..(491): a, c, t, g, unknown or other
  misc_feature (491)..(491): n is a, c, g, or t
  modified_base (498)..(498): a, c, t, g, unknown or other
  misc_feature (498)..(498): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctgactgattttgctaactttagttactgtacccaaacagttaataagtagttattctctagtagttttggaccgtaggggaccaagacgtggagatacaaacgactgtgctgcacatctgtcttcatctcccgcctatctgatatatactntctgagnggctggcacgg

SEQ ID NO: 288682 - DNA, 665 bp, Homo sapiens
  misc_feature: GYAE6OF01DJYSZ.44.75.G09.1.454.CMB.1.raw
  modified_base (253)..(253): a, c, t, g, unknown or other
  misc_feature (253)..(253): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaagcccctaagtccctgattctttcnggactcactttgaagagtggagtcccagccaggttcagcggcaggtggtttctgggacactatttcactctcaccatcagcagcctgcagcctaggagtattttcgcgtactttacttactcgaccaaactaattacttttacttttttaactacccgttacttacggttttacgggacccgtaacggggtacctaaggtccgtagggtaacgaagtaaccgaaaaggtaacgttggtacggcctacgtacctaacccgtaattccgttacggttcctttaccgtaccttcccgtttaccccggtaccttaaccgttcttacgttaacttaagtttaaccttaacctttcggttacgttacgggtacgggtccggggtccgttacggggaccgtaacggggtcgacgtaacg

SEQ ID NO: 288683 - DNA, 523 bp, Homo sapiens
  misc_feature: GYAE6OF01BATWO.44.75.G09.1.454.CMB.1.raw
  modified_base (251)..(251): a, c, t, g, unknown or other
  misc_feature (251)..(251): n is a, c, g, or t
  modified_base (520)..(520): a, c, t, g, unknown or other
  misc_feature (520)..(520): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcaggcggcaggtggttcgtgggacacatttcactctcaccatcagcagcctgcagcctggatatttcgcgtacttattactgaccaataattatttctttttataccgttactaggtttggccgtaagggaccaagcgtaggagatacgaaaggtactgtgctgcactatctgtcttcactcctcccgctatctgtatatactactgtctgacggcggtcgtggacgacggcgntag

SEQ ID NO: 288684 - DNA, 568 bp, Homo sapiens
  misc_feature: GYAE6OF01DOOZ8.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttctggatccactttgaagagtggagtcccagccagttcagcggcagtggtctgggacacatttcactctcacatcagcagcctgcagcctaggagtatttcgcgtactttattactgaccctaaacaattattacttttttacgtacccgttacgttaacggtttttcggacccgtaaggggtaacctaagccgtagggagaacgtaacgaaaaggtaaccgttggtacggtctagaccaaccctattccgttaggttcctttcgaacgtttccccg

SEQ ID NO: 288685 - DNA, 584 bp, Homo sapiens
  misc_feature: GYAE6OF01CQKOA.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatcactttgaagagtggagtcccagccaggttcagcggcagtggtctgggacacgatttcactctcaccatcagcagcctgcagcctggagtattttcgcgactttacttactagaccctaaactaaattactttactttttttaacttacccgttaacttacggtttttacgggacccgtaacggggtaaccctaagtacgttgggaacgtagttaacgaaaacggtaacgttgtggcttagccaacctattccgttgttccttactacttccttcccgcctactctagtattatactattgtctgagtcgggtctggacgacggcgctag

SEQ ID NO: 288686 - DNA, 1015 bp, Homo sapiens
  misc_feature: GYAE6OF01DB86M.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctcgtttccccggtgccaggtgtgacatcgagatgacccagtctccgtcctcactgtctgcgtctagttggggacagagtcaccatcacgttgccgggcgagtcgccgactagttaggttacttttttggcccttggttttccaggtcgaagggacgtccgtggaccaaaacggtcccccttaaaggtcccccttaggtaactttcctttttacgtacgggtacttcccgtaaccgtttttggaaaacggtacggttacggggtaaccgtttacccccggacggtaccccgtaaacggggttttccgaaacggggtcccggggttaccgttaaacgggggtttcggggttttacccggttacgggggggtaaaccctaacccggtttaagttttttaccccgaacccgttttaccctaccccgtaaacccctaacgttacccgaacgggtaccctaaccgggtccccgtttacggacccgtaaccgggtccccggttaggggtaaacgttacggtttttaccccggaccggtttaaccgtttttaaccgtttaacccggttaccgtaaccccgttaaaaccgtttaaaactttttaacctttttttaccgtttttttttaaaccggtcccccggtttttaaaaccgtttacggggtttttttaaccggggaccccgggttaaaaccggggggttaaccccgtaaacggggttccggtttaaacgggggaaacgttaaccgggttaaaccggtaaaaaaccgggggtttaaaccggttaccgggtttaacgggggtacccctttaaccggggaaccccttaaaacccggttaacctttacccgggttttaccggttttaacccctttacccggtaacccgttttttcccccccgg

SEQ ID NO: 288687 - DNA, 526 bp, Homo sapiens
  misc_feature: GYAE6OF01DRO7G.44.75.G09.1.454.CMB.1.raw
  modified_base (267)..(267): a, c, t, g, unknown or other
  misc_feature (267)..(267): n is a, c, g, or t
  modified_base (500)..(500): a, c, t, g, unknown or other
  misc_feature (500)..(500): n is a, c, g, or t
  modified_base (523)..(523): a, c, t, g, unknown or other
  misc_feature (523)..(523): n is a, c, g, or t
tcagacagtatatacacgaccggtgctcgatttagtatagacatcaggggaggaatcagacccagtcaggacacagcatggacatgagagtcctcgctcagctcctgggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaagggggngacggccctaaggtcctcgtctctcgtagaaccagactggaaggtagacgtcccgtcaggttcagtcgccagtccaggtggtgggccggagtccactctcacattacgcgacctgcggcctgaagattcgtgactaactttatttctgtcagtcagtatctatgtcgtccccgtttctacgttttggccgtaggggaccaagtcgtagaatacaaacgactgtggctcgcacntctgtcttcactccttcccgctntcg

SEQ ID NO: 288688 - DNA, 637 bp, Homo sapiens
  misc_feature: GYAE6OF01BPEPB.44.75.G09.1.454.CMB.1.raw
  modified_base (631)..(631): a, c, t, g, unknown or other
  misc_feature (631)..(631): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgatcttttctggatccactttgaagagtggacgtcccagccaggttcagcggcagtggttcgtgggacactatttcacttctaccactatcagcagcctgcagcctggacgtatttcgctactttacttactgacctaaataattactttacttttttactcccgttacgttacggttttcggacccgtaacggggtaaccaacggtccgttagggagtaacgtaacgaaaacggtaacgttggtggtcgtacgactaacctattccgttacgttcctttactacctttcccttaccccgacctacttcctacgttaattaacgttacttaccgttcggttcgttacgggacgggtccggggtcgttacggggaccgtaacgggtccgngtaacg

SEQ ID NO: 288689 - DNA, 631 bp, Homo sapiens
  misc_feature: GYAE6OF01ARKGX.44.75.G09.1.454.CMB.1.raw
  modified_base (253)..(253): a, c, t, g, unknown or other
  misc_feature (253)..(253): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggcctggtttcagcaggagcctggcaaagcccctaagtccctgattcttttcnggatccactttgaagagtggagtcccagccaggttcagcggcagtggttctggacactatttcactctcaccatcagcagcctgcagcctggacgtatttcgcgtactttacttactgacctaaataacttatttacttttttactaccgttacttaggttttacggccgtaacggggtaccaacggtcgttagggagtaactaccgaaacgtaactcggtacggtactcggccaaccctaacttcgttcgttccgtttacctacttccccgttacccggaccctaattccgttacgtagttaacttacttaacttggttccgttagggtaacgggtccggggtacgttacgggaccgtaacgggtccgtacgtaacg

SEQ ID NO: 288690 - DNA, 554 bp, Homo sapiens
  misc_feature: GYAE6OF01AD7RQ.44.75.G09.1.454.CMB.1.raw
  modified_base (253)..(253): a, c, t, g, unknown or other
  misc_feature (253)..(253): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgattcttttcnggatccactttgaagagtggagtcccagccaggttcagcggcagtggttctgggacacatttcactctcaccatcagcagcctgcagcctggagtatttcgcgtactttattactgaccaactaattatttacttttttatccgtactagttttcggccgtagggaccaagtcgtaggagatacgaaaggactgtggctgacaccatctgttccttctacttcccttcccgtcctacttcctagtattaacgttacttacttgttctgaggtccgggtcgtcggacgaacgggcgcgtaag

SEQ ID NO: 288691 - DNA, 634 bp, Homo sapiens
  misc_feature: GYAE6OF01BQDNF.44.75.G09.1.454.CMB.1.raw
  modified_base (270)..(270): a, c, t, g, unknown or other
  misc_feature (270)..(270): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggtcttggtttcagcaggagcctggcaaagcccctaagtccctgattctttctggatcctactttgaagngtggagtcccagccaggttcagcgcagtggtcgtggactctatttcactctacaccatcagcagccctgcagccgtaggactacgtttccgacgttacttatttacgacgtaccaaactaatttactttacctttttactccgttacttaggttttcggaccggtaacgggtacgtaagtccgtaggtaagacgtaacgtaaacggtactggtcgacgtacgacctaaccgtacttctcggtttccttaccgtacttaccccgttcccaccgttacttcgttactaaacgttacttaacgtttacgtacgttcgttacgggacggttcgggtcgttacgggaccggtaacggccgtacgtaacg

SEQ ID NO: 288692 - DNA, 592 bp, Homo sapiens
  misc_feature: GYAE6OF01CMDR2.44.75.G09.1.454.CMB.1.raw
  modified_base (255)..(255): a, c, t, g, unknown or other
  misc_feature (255)..(255): n is a, c, g, or t
  modified_base (373)..(373): a, c, t, g, unknown or other
  misc_feature (373)..(373): n is a, c, g, or t
  modified_base (385)..(385): a, c, t, g, unknown or other
  misc_feature (385)..(385): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggttcagcaggagcctggcaaacgcccctaagtccctgtattcttttcnggactccactttgaagagtggacgtcccagcctaggttcaggcggcaggttggttcgtgggacacgtatttcactctcaccatcagcagcctgcacgcctgatgtatttgctaacttnttactgaccaanagtataagtagttattctactagttagtttcggaccgtaagggaccaaggcgtagggacgatacgtaaacgaacgttcggtcggtctacgactaccgtagttcttgttaccttccgtactttcccgtcccgtacctacgtacgttagtaattacttaacttaccgttagttacgtacggtacgggtacgggcgtgggacgtaacggg

SEQ ID NO: 288693 - DNA, 896 bp, Homo sapiens
  misc_feature: GYAE6OF01ADVC8.44.75.G09.1.454.CMB.1.raw
  modified_base (306)..(306): a, c, t, g, unknown or other
  misc_feature (306)..(306): n is a, c, g, or t
tcagacagtatatacacgaccggtgctcgatttagtatagacatcagggacttaggggtctttggggccaggcgtccgtgctcgctctcggtttccccggtgccaggtgtggaccagtcgagatcgaccctacgtcctccgtcctcactgtcgtcgcgtcgtacgttgggggaccagacgtcaccctatccacgttcggccgggcgtacggtgccgacgtattacggtacttttttcggccgttggttcagcaggacgcctaggtaccaaacgtcccctaacggtcccgtagtacttcgttttcgnggtacttccgtacgtttagaagtcggtcggtacgtcccgacgaccgtaacggtccaacggccggacctaaccggttcggttacgtacggtacctaacgttacgtttccgaccttcctaccgtaacccgtaacgtccgaacggtaccgacgtcccgttacgaccgtacggtcccggttagggtaaccgttacgttttacccggtaccgttaaaccgttttaacgttaccgttaccggaaaccccttaaaacgttaaaccgttttaccttttaacccttttttaaccgttacccgtttaaccggtttacggggttttaccgggaaccccggttaaacggggtaaacccgttaacgggtaaccgggttaacgggtaacggttaaacgtttaaaccggtaaaaacgggttaccgttacgggttaccggttaaccgtttaccgtaaaccggtaccgttaccgttaccggtttaccgtttaccgtttcgttaccggtttcccgtacccgtactacgtacgtacgtattaccgttacgtcgtacggtccgtacgggtcggtaccggtccggtacggtacgtaccggtcgtacgtacg

SEQ ID NO: 288694 - DNA, 544 bp, Homo sapiens
  misc_feature: GYAE6OF01AZU3S.44.75.G09.1.454.CMB.1.raw
  modified_base (252)..(252): a, c, t, g, unknown or other
  misc_feature (252)..(252): n is a, c, g, or t
  modified_base (372)..(372): a, c, t, g, unknown or other
  misc_feature (372)..(372): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgatcttttcnggatccactttgaagagtggagtcccagccaggttcagcggcagtggttctgggacacatttcactctcaccatcagcagcctgcagcctggagatttcgcgtacttattactgaccaanaattattctttttactccgttactagttttcggaccgtaggggacctaagcgtaggagatacaaagtaactggtgcgtgcactatctcgttcttcacttccttcccgcctacttctgtattatacttactcggttctggaggtccgggtcgtcggacgacggtcgcgtaacg

SEQ ID NO: 288695 - DNA, 659 bp, Homo sapiens
  misc_feature: GYAE6OF01D7X1V.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccacttttgaagagtgggactccagccgtaggttcaggcggctaggtggttcgtgggacacgtatttccactctccacatcagcacgcctgcacgtccgtggagttactttccggacgtactttaagttactcgacccaaataattacttttactttttacgtaccgttaacgttaggttttcggaccggtaacggggtaaccaagtcgtaggaagtacttaacgaaaaggtaacttggtcggtactcgaccaaccgtattcgttcgttccttactaacttcccgttaccccgaccttactcgttagtaattaactttaacgttaacgttggttaccgtacgggtaacggggtcccggggttacggttacgggaaccggtaaacggggtcccgtaacgtaaacgg

SEQ ID NO: 288696 - DNA, 653 bp, Homo sapiens
  misc_feature: GYAE6OF01BL90K.44.75.G09.1.454.CMB.1.raw
tcagacagtatataacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcaggcggcagtggttctgggacacgtatttcacttctccaccatcagcagcctgcagcctggagtattcgcgtacttattactcgaccaactaattacttacttttttactccgttaacgtagttttcgggaccgtacggggtacctaaggtcgtaggaacgtagtaacgaaaagggtaacgttaggtcggtcctacggtactaaccgtagttccgttcggttacctttcgtaacctttcccgttacccccggaccttacgttaccgttgtaaacgtttacttaactttaacccggttagttcccgttagggtaccgggtccgggggtaccgtacgggaccggtaaccgggccggtacgtaaacgg

SEQ ID NO: 288697 - DNA, 515 bp, Homo sapiens
  misc_feature: GYAE6OF01CVH2Y.44.75.G09.1.454.CMB.1.raw
  modified_base (251)..(251): a, c, t, g, unknown or other
  misc_feature (251)..(251): n is a, c, g, or t
  modified_base (301)..(301): a, c, t, g, unknown or other
  misc_feature (301)..(301): n is a, c, g, or t
  modified_base (455)..(455): a, c, t, g, unknown or other
  misc_feature (455)..(455): n is a, c, g, or t
  modified_base (511)..(511): a, c, t, g, unknown or other
  misc_feature (511)..(511): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattctttcnggatccactttgaagagtggagtcccagccaggttcagcggcagtggtcngggacacattcactctcacatcagcagcctgcagcctggagatttcgcgtactttatactgaccaactaattattctttttataccgttatagttttggccgtaagggtaccaagcgtggagatacgaaagactgtggctgcacatctgtcttnacttcctccgctatcctagtatattatatggtctggacgcggtcgtgagacggcgngtag

SEQ ID NO: 288698 - DNA, 602 bp, Homo sapiens
  misc_feature: GYAE6OF01B01ED.44.75.G09.1.454.CMB.1.raw
  modified_base (269)..(269): a, c, t, g, unknown or other
  misc_feature (269)..(269): n is a, c, g, or t
tcagacagtatatacacgaccggtgctcgatttagtatagacatcaggggaggaatcagacccagtcaggacacagcatggacatgagagtcctcgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgccttggtttacaacgaaaaagggggngaggcccctaaggtcctcgtctctcgtagaaccagactggaaggtagacgtcccgtcaggttcagtgccagtccaggtggtgggccggagtccactctcaccattagcgacctggcggctgaagattctgactaactttactttctgtctagactagtatctatacggtcgtccccgttactacgtttttcggacccgtaagggggtaacccgaaggtaccgtagggtaaactaccgaaaaccggtaacgttaggtacggtacgtcggaccctacccgtacttccgttcgttacccgtttacacctttccctttcccccggcctacgttcccg

SEQ ID NO: 288699 - DNA, 557 bp, Homo sapiens
  misc_feature: GYAE6OF01CPY39.44.75.G09.1.454.CMB.1.raw
  modified_base (314)..(314): a, c, t, g, unknown or other
  misc_feature (314)..(314): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccggggcgagtcgccgacagttaggtacttttttggccttggtttcagcaggagcctggcaaagcccctaagtccctgatcttttctggatccactttgaagngtgacgtccagccaggtcagcgcaggtggtctgggacacatttcactctcaccatcagcagcctgcagctaggatattcgcgtactttacttactgacctaaactaattactttacttttttaactccgttacgttacgttttcggaccgtaacggggaccctaggtacgtagggaacgtaactacgaaacggtacgttggtacggtctcgacaccgtattccttagttccttcgtcttcccg

SEQ ID NO: 288700 - DNA, 533 bp, Homo sapiens
  misc_feature: GYAE6OF01C5W1M.44.75.G09.1.454.CMB.1.raw
  modified_base (253)..(253): a, c, t, g, unknown or other
  misc_feature (253)..(253): n is a, c, g, or t
  modified_base (350)..(350): a, c, t, g, unknown or other
  misc_feature (350)..(350): n is a, c, g, or t
  modified_base (382)..(382): a, c, t, g, unknown or other
  misc_feature (382)..(382): n is a, c, g, or t
  modified_base (469)..(469): a, c, t, g, unknown or other
  misc_feature (469)..(469): n is a, c, g, or t
  modified_base (529)..(529): a, c, t, g, unknown or other
  misc_feature (529)..(529): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaacgcccctaagtccctgattcttttcnggactccacttttgaagagtggatcccagccaggttcagcggcagtggttctgggacacatttcactctcaccatcagcagcctgcagcctgggagntttcgcgtacttagttactgaccaaactaatntttactttttatccgttactagtttggacctagggacaagtctggagatacgaaaggactggtggctgcaaccatcttgtcttactnttcctcccgtctactctgtatatatacttgtctagaggcgggtactgggacaacgggcgngtag

SEQ ID NO: 288701 - DNA, 520 bp, Homo sapiens
  misc_feature: GYAE6OF01DTCVD.44.75.G09.1.454.CMB.1.raw
  modified_base (516)..(516): a, c, t, g, unknown or other
  misc_feature (516)..(516): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagtatttcgcgtacttatactgaccaaactaattatttctttttatccgtactagtttcggacgtagggaccagcgtggagatacgaaagactggtgctgcacatctgttcttcacttcctcccgcctatctagtattatatactgtctgaggcgggtctaggacgacggcgngtag

SEQ ID NO: 288702 - DNA, 799 bp, Homo sapiens
  misc_feature: GYAE6OF01BZEEL.44.75.G09.1.454.CMB.1.raw
  modified_base (262)..(262): a, c, t, g, unknown or other
  misc_feature (262)..(262): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattgggggacagagtcaccatcacttggccgggcgagtgccgactattaggtacttttttggccttggtttcagcagggagcctggacaaacgtcccctaagtcctgtacttctttcgnggactccgtacttttaggaagtaggtcggacgtccccaggcccgtaaggtttccgaagggccgggtacgtacgggtttcgggtttaccgtacgggggtaacctaccttagtttttcccaacctttcctaaccgaacctaacgttccgtaaggcccgtaacgtcccgttacggaccgtaacggcccggttagggtaaccgttagttttcccggacgttaacttttaacgtttacctacggaccttaaaactaaactttacgttttacctttttttaacgtaccccgtttaacgtttacgggttttccgggtaacccgtaacgggggtaaccctaacgggtaccgtagggaacgtaacgtaacggtaaaacggtaccgttagggtcggtacgttacgacctaaccgtacgttcgtcgttaccgttactacgtttcccgtacccgtccttacgttccgtaggttacttacgttacttacgttacgtccggtagtaccgggtacgggtacggtacggtaccggaacgggtccgagttaacg

SEQ ID NO: 288703 - DNA, 605 bp, Homo sapiens
  misc_feature: GYAE6OF01BVX69.44.75.G09.1.454.CMB.1.raw
  modified_base (251)..(251): a, c, t, g, unknown or other
  misc_feature (251)..(251): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggttctgggacactatttcactctcaccatcagcagcctgcagcctggagtatttcgcgtactttatacctgacccaaataattactttcttttttatcccgttacttagttttcggaccgtaggggaacctaaggtcgtaggagtaacgtacgaaacgggtactggtcggtctacgactacccgtattaccgtcgttacctttactacttcccgttacccgacctacttcttacgtaattacttacgttacgttacggttctacgggtacggtccgggtcgttacgggacgaacgggtccgacgtacg

SEQ ID NO: 288704 - DNA, 797 bp, Homo sapiens
  misc_feature: GYAE6OF01BC29Z.44.75.G09.1.454.CMB.1.raw
tcagacagtatatacacgaccggtgctcgatttagtatagacatcagggacttagggctttgccaggctcctgctgctctgtttccccggtgccaggtgtgacatcgagatgacccagtctccgtcctcactgtctgcgtctagttgggacagagtcaccatcacttggccggcgagtcgccgactagttaggtacttttttggccttggtttacagtcgaggcgccgtggacaaacgccctaacgtccctagtacttcttttcgtaggtacttcctacttttaggaaggtagtcggtactacccgagtccgtaacgggttcaggtccggctacgggttcggttcgtcgggactacgttattccaccgtctacaccacgttcacgtacacggtccctacgcctaggcccgtaggagttacgtttcgaccgttactttactacgtaccgtacctaaagtaactttacttttaccgtttttaacctaccggttaacgtttacggttttaccgggtaccgttaaacggggtaacctaacgtacggttacgggtaacttacgttaaaccggtaaacgggttaaccgttacgggtcgtaccgtaccggtccgtaaaccgttaacgttccgttacgtttacccgttacttaacccgtttaccccgttaccccggttacctacgttaccgttacgttaaatttaccgtttaaaccttaccgtttcggttaccgttcggggttaaacccggtccggggttaccgttaccgggtaaccgggtaacgggtcccgtcggttaaaacgg

SEQ ID NO: 288705 - DNA, 744 bp, Homo sapiens
  misc_feature: GYAE6OF01D1ZF8.44.75.G09.1.454.CMB.1.raw
  modified_base (254)..(254): a, c, t, g, unknown or other
  misc_feature (254)..(254): n is a, c, g, or t
  modified_base (306)..(306): a, c, t, g, unknown or other
  misc_feature (306)..(306): n is a, c, g, or t
  modified_base (312)..(312): a, c, t, g, unknown or other
  misc_feature (312)..(312): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaagcccctaagtccctgattcttttcnggatccactttgaagaggtggagtcccagccaggttcagcggcagtggttcngggacncatttcactctcaccatcagccagcctgcacgcctaggagtacttttccgacgtactttataccgtacgaccctaaactaactttacttttacttttttaacttacccgttaaccgttagggtttttacggacccgtaacggggtaacctaacggtaccgtagggaagtaacgttaaccggtaaaacggtaacgttcggttacgggaccgttacgggacctaaacccgtacgtttacccgtttacggtttcccttttaccgttaacccgtttccccgtttccccggtacccttaaccgtttaccgttacggttaaactttaacgttttaaccgtttaaccgtttcggtttacccggttacgggtaaccgggttacccgggggttaccgggtacggggtaacccggtaaacgggtccccggtaacgtaaacgg

SEQ ID NO: 288706 - DNA, 498 bp, Homo sapiens
  misc_feature: GYAE6OF01BS4BX.44.75.G09.1.454.CMB.1.raw
  modified_base (458)..(458): a, c, t, g, unknown or other
  misc_feature (458)..(458): n is a, c, g, or t
  modified_base (487)..(487): a, c, t, g, unknown or other
  misc_feature (487)..(487): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtacttattactgaccaacaattattctttttatccgtactagtttggaccagggaccaagctggagatacaaagactgtgctgcacatctgtcttcatctccgcntctgatatatactgtctgagcggtctggnaaggcgcgtag

SEQ ID NO: 288707 - DNA, 583 bp, Homo sapiens
  misc_feature: GYAE6OF01ACMXG.44.75.G09.1.454.CMB.1.raw
  modified_base (256)..(256): a, c, t, g, unknown or other
  misc_feature (256)..(256): n is a, c, g, or t
  modified_base (376)..(376): a, c, t, g, unknown or other
  misc_feature (376)..(376): n is a, c, g, or t
  modified_base (578)..(578): a, c, t, g, unknown or other
  misc_feature (578)..(578): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaacgcccctaagtccctgtattcttttcnggactccactttgaagagtggacgtccagccaggttcagcggcaggtggttctggacactatttcactctcaccatcagcacgcctgcagcctggatagtttcgcgtaactttattaccngaacctaactaattacttttactttttactcccgttattacggttttggaccgaggggtaccaaggtcgtaggagtaataacgaaaggtaactggtcggtactgacctacctattccgttcgttaccttctacttcccgttcccgctactctgtaatagttactagttcgtcgtacgacggcgggtcgtgggacgacggcgngtacg

SEQ ID NO: 288708 - DNA, 523 bp, Homo sapiens
  misc_feature: GYAE6OF01B82ZH.44.75.G09.1.454.CMB.1.raw
  modified_base (225)..(225): a, c, t, g, unknown or other
  misc_feature (225)..(225): n is a, c, g, or t
  modified_base (259)..(259): a, c, t, g, unknown or other
  misc_feature (259)..(259): n is a, c, g, or t
  modified_base (393)..(393): a, c, t, g, unknown or other
  misc_feature (393)..(393): n is a, c, g, or t
  modified_base (521)..(523): a, c, t, g, unknown or other
  misc_feature (521)..(523): n is a, c, g, or t
tcagacagtatatacacgaccggtgctcgatttagtatagacatcagggacttaggggctttgccaggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaaagggggngaggcccctaaggtcctcgtctctcgtgaaaccngactggaagtagagtcccgtccaggttcagtgccagtccaggtggtgggccggagtccactctcaccattagcgacctgcggcctgaagattctgcaacttattctgtcagcagtatcatagtcgtccccgttntacgttttcggccaggggaccaagtcgtaggaaatacgaaacgacgtggtggctagccactatctgtcttcactccttacccgctatctagatatatactgtctgagcggtctggacaggcgacatgnnn

SEQ ID NO: 288709 - DNA, 798 bp, Homo sapiens
  misc_feature: GYAE6OF01CYIV9.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctcgtttccccggtgccaggtgtgacatcgagatgacccagtctccgtcctcactgtctgcgtctagttggggacagagtcaccatcacgttggccgggcgagtcgccgactagtttaggtactttttggccttggtttccaggcgaaggagccgtggaccaaacgcccctaagtccctgtatttcttttcgtggtacttccgtactttaggaagtaggtcggacgtccccgaggtccgtagggttcacggtccggtcgtaagggttcggttacgtacggggaactacgtacttttaccaccttctacctaacctataccgacgtccgtaacgtcccgttacggacgtaccggtacccgtagggtaacttacgttttaccggaccgtttaaccgtttaacgtttaccgtaccgaacccttaaaacttaaattttaccttttacccgttttttttaacgaccccggtttaacgtttaccgggtttttacgggacccggttaaacggggtaacccctaagggttcccgtaaagggggtaactaaaccggtttaaacggaaaaaccgggttaaccgttaggggtacggttacccgttaccgggtaaccctaaccccggttaacgtttaccggtttaaccgggtttacccttttaccgtaaacccgtttttaccccccggg

SEQ ID NO: 288710 - DNA, 589 bp, Homo sapiens
  misc_feature: GYAE6OF01C194B.44.75.G09.1.454.CMB.1.raw
  modified_base (293)..(293): a, c, t, g, unknown or other
  misc_feature (293)..(293): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgcgggcagtgccgacattaggacttttttggcctggtttcagcaggagcctggcaaagcccctaaggtccctgattcttttcnggtactcctactttgaagtagtggagtccagcaggtcagcggcagtggtctgggacacatttcactctcaccatcagcagcctgcagccgtggatactttcgcgtaactttaattacctcgaccaaactaatttattactttttttaactacccgttactagggtttttacggaccgtaacggggaaccaacggtcgtaggtaacgtaagttaaccaaaagggtaacgttaggtcgggcgttccgacggtaaacccctacgttaccgttagtttccgtttcctaacgtttcccccg

SEQ ID NO: 288711 - DNA, 678 bp, Homo sapiens
  misc_feature: GYAE6OF01DKTA2.44.75.G09.1.454.CMB.1.raw
  modified_base (320)..(320): a, c, t, g, unknown or other
  misc_feature (320)..(320): n is a, c, g, or t
  modified_base (332)..(332): a, c, t, g, unknown or other
  misc_feature (332)..(332): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcaggcaggagcctggacaaagcccctaagtccctgtattctttctggatcctactttgaagtagtggacgtcccaggcctaggttcagcggcaggttggtctgggaccanatttcacttccncacatcagcagctgcagcgtggagtacttcgaccgtacttaacgttactagtaccctaaataacgtttacttacctttttttaacgacccgtttaacgttacggtttttacgggaccgtaaacgggggtaacctaaacggtcgttacgggaagtaacgttaaccgaaaagggtacccgttaggtacggtctacggtacctaccgtaagttccttacggtttcttacctacgtttcccgttaccccggacccttacttcgtaccgtaagttaacttacgttacccgttgttcccgttaggtacggtaccgggtacggttacgaaccggaacgggtccggactaacgg

SEQ ID NO: 288712 - DNA, 564 bp, Homo sapiens
  misc_feature: GYAE6OF01A8HSA.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacactatttcactctcaccatcagcagcctgcacgcctgggagtatttcgcgtacttatacctgacctaacattactttctttttatccgttactagttttcggaccgtacgggacctaagtcgtaggagtagtacgaaaggtactgtggctgacacctatctcgttccttactacttccgttcccgacctacttcctagtattactacttacgttgtcgtggacggtcgggtcgtacgggaccgacgggtcgcgtacg

SEQ ID NO: 288713 - DNA, 610 bp, Homo sapiens
  misc_feature: GYAE6OF01DIGCB.44.75.G09.1.454.CMB.1.raw
  modified_base (270)..(270): a, c, t, g, unknown or other
  misc_feature (270)..(270): n is a, c, g, or t
  modified_base (352)..(352): a, c, t, g, unknown or other
  misc_feature (352)..(352): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaagcccctaagtccctgattcttttctggatccactttgaagngtggagtcccagccaggttcagcggcaggtggttctgggacacgtatttccactctcacatcagcagctgcagcctggactntttcgcgtacttattactcgacctaaataattacttttacctttttaactcccgttaacgttacggttttcggacccgtaacgggaacctaaggtcgtaggaagtactaacgaaacggtacgtggtacggctacgacctaccgtattccgttcgttccgttactactttcccgttcccgacctacttcctagtaacttacgttacttacgttacgttcgtaggacggtccgggtcgtaggaccgaggccgtacgtacg

SEQ ID NO: 288714 - DNA, 515 bp, Homo sapiens
  misc_feature: GYAE6OF01AQRRT.44.75.G09.1.454.CMB.1.raw
  modified_base (324)..(324): a, c, t, g, unknown or other
  misc_feature (324)..(324): n is a, c, g, or t
  modified_base (373)..(373): a, c, t, g, unknown or other
  misc_feature (373)..(373): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccntcagcagcctgcagcctggagatttcgcgtacttattactgaccctaanaattattctttttatccgtactagtttggcctaggggtacaagctggagtatacaaaggactggtgctgacaccatctgttcctcacttccttccgcctatctagatactatactgtcttgagcgggtctggacaggcgcag

SEQ ID NO: 288715 - DNA, 546 bp, Homo sapiens
  misc_feature: GYAE6OF01CMDJB.44.75.G09.1.454.CMB.1.raw
  modified_base (252)..(252): a, c, t, g, unknown or other
  misc_feature (252)..(252): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgatcttttcnggatccactttgaagagtggagtcccagccaggttcagcggcagtggttctgggacacatttcactctcaccatcagcagcctgcagcctggatatttcgcgtactttattactgaccctaaactaattactttcttttttactcccgttaactacggtttttcggcccgtaggggtaccaagtcgtggagatacgaaaggactggtcgctgcacctatctgttcttcacttccttcccgcctatctgtatatactactgtctgacggcgggtcgtacggacgaacggcgctag

SEQ ID NO: 288716 - DNA, 512 bp, Homo sapiens
  misc_feature: GYAE6OF01D8ZWU.44.75.G09.1.454.CMB.1.raw
  modified_base (501)..(501): a, c, t, g, unknown or other
  misc_feature (501)..(501): n is a, c, g, or t
  modified_base (507)..(507): a, c, t, g, unknown or other
  misc_feature (507)..(507): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtacttattactgccaaacaatattcttttttatccgtactagttttggcctaggggaccaagtcgtaggagatcgaaaggtactgtaggctgcaccatctgtcttcatcttccgccatctgatatatactgtctgagcgggctcgganaacggncgtag

SEQ ID NO: 288717 - DNA, 650 bp, Homo sapiens
  misc_feature: GYAE6OF01C164Q.44.75.G09.1.454.CMB.1.raw
tcagacagtatatacacgaccggtgctcgatttagtatagacatcagggaaagggggaatcagtcccactcaggacacagcatggacatgagggtccccgctcagctcctggggctcctgctgctctggttcccaggtgccaggtgtgacatccagatgacccagtctccatctgccatgtctgcatctggtaggagacagagtcaccatcacttggcgggcgagtcgaggctatagactaattagttacgtcttggttcagacaacgaacgaggaactacctaacgctagtactctattctgtacctactaacgttaacgaaaggtcggtaccttaagaaacgttcgaggcgtacgtaggtacggtactcggtagggaactaagtaacttcactctacaactaactcgaagcacgtccagacacgtaccgtaaggtaagttacgtttcgaaacttaactttacgttacttacgttaactaactaaatttacgaaccgtaccgttaacccgttacccggtacgggttaccggttaccgggaaccgggtaaccgggtaacgaacggggtaaacgtaaactaaaccggtaaacggtaagttcggtacggtcgtacgaccctaacttattccgttcgttacttccgttacccg

SEQ ID NO: 288718 - DNA, 569 bp, Homo sapiens
  misc_feature: GYAE6OF01EDJ0R.44.75.G09.1.454.CMB.1.raw
  modified_base (563)..(563): a, c, t, g, unknown or other
  misc_feature (563)..(563): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggacgtatttcgacgtactttattactcgaccaaactaattatttctttttactcccgttactagttttcggacccgtaggggaacctaacggtcgtaggagtatacgaaaggtactggtcggctcgacacctactctgttccttactacttccttcccgcctactctagtattagtacttactggttcctggaggccgggtctacgggaccgaagggccgngtaacg

SEQ ID NO: 288719 - DNA, 587 bp, Homo sapiens
  misc_feature: GYAE6OF01ASOMJ.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggacgtcccagccaggttcagcggcaggtggttctgggacacatttcactctcaccatcagcagcctgcagcctggacgtatttcgcgtactttacttactgaccctaaataatttactttaccttttttactcccgttaacttacggttttcggacccgtaaggggacctaacggcgttagggagactacgaaaggtaacgtggtcggctgacacctatcgtcgttccttctacttcctcccgtcctattcctagtatagttacttacgttgttctaggacgtccgggtcgttacgggacgtaacggccgcgtaacg

SEQ ID NO: 288720 - DNA, 545 bp, Homo sapiens
  misc_feature: GYAE6OF01C0OA6.44.75.G09.1.454.CMB.1.raw
  modified_base (254)..(254): a, c, t, g, unknown or other
  misc_feature (254)..(254): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaacgcccctaagtccctgattcttttcnggatccacttttgaagagtggagtcccagccaggttcagcggcagtggttctgggacacatttcactctcaccatcagcagcctgcagcctggatattttcgcgtactttactactgacctaactaattatttcttttttatcccgttactagttttcggaccgaggggaccaagcgtggagatacgaaaggactgtggctgcaccatctgttcttctacttccttcccgcctactctgtatagttactattgttctggacggcgggtcgttggacgaacgggcgcgtaag

SEQ ID NO: 288721 - DNA, 633 bp, Homo sapiens
  misc_feature: GYAE6OF01BQNS1.44.75.G09.1.454.CMB.1.raw
  modified_base (252)..(252): a, c, t, g, unknown or other
  misc_feature (252)..(252): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtcccctgatcttttcnggatccactttgaagagtggacgtcccagccaggttcagcggcagtggttctgggacactatttcactctcaccatcagcagcctgcagccgtggagtatttcgtacgtactttattacctgacctaaactaatttactttacctttttttaactacccgtttaacgttaggtttttcgggacccgtaacgggggaacctaacggtccgttagggaacgtaacgtaacgaaaacgggtaacctaggtacgggtcttacgacctaacctagttccgttcgttcctttacctacttacccgttccccgcctacttcgtagtacttaatacttacttcggtctagggacggcgggtcgtacgggacgaacgggtcgacgtaacg

SEQ ID NO: 288722 - DNA, 567 bp, Homo sapiens
  misc_feature: GYAE6OF01D3T5G.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgtattcttttctggactcctactttgaaagagtggacgtccccagccaaggttccagcggcaggttggttctggggacactatttcactctcaccatcagcagcctgcagcctggatatttcgcgtactttatactgaccaaataatatttctttttactccgttacgtagttttcggaccgagggtaccaagcgtacggagatacgaaagtacgtgtggtctcgcacctatctgttcttctcttccctcccgactactctgtattactattacgtgttcgaggtacggccgggtcgtacgggacgtaagggccgaagtacg

SEQ ID NO: 288723 - DNA, 536 bp, Homo sapiens
  misc_feature: GYAE6OF01A0EVO.44.75.G09.1.454.CMB.1.raw
  modified_base (531)..(531): a, c, t, g, unknown or other
  misc_feature (531)..(531): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagtatttcgcgtacttattactgacccaactattactttctttttatcccgttacttagttttcggccgtaaggggaccaaggcgtaggagtagtacaaaggtactgtgctgcacatctgtcttcacttccttcccgctatctgatattactacttgtcttaggcgtcgggtctacggacgacggcgngtacg

SEQ ID NO: 288724 - DNA, 633 bp, Homo sapiens
  misc_feature: GYAE6OF01B3TTS.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttctggactccactttgaagagtggagtcccagccaggttcagcggcaggtggttctgggacactatttcactctcaccatcagcagcctgcagcctggagtatttcgcgtacttattactcgaccaaactaattactttcttttttaactccgttaacttacgttttcggaccgtaacgggtaacctaagtcgtagggaacgtagtacgaaaaggtaacgtaggttacgggtcttacggacctaaccgtaattccgttacgttaccgtttacctactttcccgttccccgtaccctacgttcctacgtaacttaacgttacttaccgttcgttccgtaggtaacggtccggggtacgttcgggaccgaacgggtccgcgtaacg

SEQ ID NO: 288725 - DNA, 516 bp, Homo sapiens
  misc_feature: GYAE6OF01BF773.44.75.G09.1.454.CMB.1.raw
  modified_base (461)..(461): a, c, t, g, unknown or other
  misc_feature (461)..(461): n is a, c, g, or t
  modified_base (493)..(493): a, c, t, g, unknown or other
  misc_feature (493)..(493): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagccctgcagccctggagattttcgcgtactttattactgacccaactaattattcttttttatccgttactagttttggccagggaccaagctggagatacaaaggactgtggctgcaccatctgtcttcntccttcccgcactctgattatattactgttcngaggcggctggacaggcgcgtag

SEQ ID NO: 288726 - DNA, 714 bp, Homo sapiens
  misc_feature: GYAE6OF01DJ4WH.44.75.G09.1.454.CMB.1.raw
  modified_base (258)..(258): a, c, t, g, unknown or other
  misc_feature (258)..(258): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcgaggagccgtggacaaacgcccctaagtccctgacttcttttcgnggactcctactttggaagtaggtggatcccagccaggttccaggcggctaggttcggttcgtgggacctactactttcacctctccacctatcagcacgcctgccagccgtagggatacgtttcgactacgtttatacgtcgacctaataattacgttttactttttacgtacccgttagttacggttttccggacccggtaacgggtaacctaaggtccgtagggtaacgtaacgttaacggaaaacgggttacgtggttacggtccgtagtacccgtaaccgttacgttccgttacgtttacccggtttcctaacccgtttccccgttaccccggtacccttaaacgtttcccgttaggttaaactttaacgttaaaccgtttcgtaacggtttcgtaacgggtacgggtccggggtacgttacggggacccgttaacgggcccgtagtaacgg

SEQ ID NO: 288727 - DNA, 598 bp, Homo sapiens
  misc_feature: GYAE6OF01DKO0G.44.75.G09.1.454.CMB.1.raw
  modified_base (356)..(356): a, c, t, g, unknown or other
  misc_feature (356)..(356): n is a, c, g, or t
tcagacagtatatacacgaccggtgctcgatttagtatagacatcagggacttaggggctttgccaggctcctgctgctctgtttccccggtgccaggtgtgacatcgagatgaccccagtctccgtcctcactgtctgcgtctattgggggacagagtcaccatcacttgccgggcgagtgccgacattaggtacttttttggccttggtttcagcaggagcctggaccaaacgcccctaagtccctgattcttttctggactctactttgaagagtggagtcccagccaggttcagcggcagtggttctgggacatatttcactctcacatcagcagcctgcacgcctggagtntttcgacgtacttatctgacctaaataattatttcttttactccgttacgttagttttcggaccggtaacggggtaccaaggtcgtagggaacgtagtaacgaaagggtaacgttggtggctagccaactacttaccgttcgttcttaccgtacttcccgttccgacctacgttctagtacttatacttacgttcgttcgtaggacggtcggggtacgtacgggacgtaacgggcgcgtaag

SEQ ID NO: 288728 - DNA, 555 bp, Homo sapiens
  misc_feature: GYAE6OF01B23IM.44.75.G09.1.454.CMB.1.raw
  modified_base (251)..(251): a, c, t, g, unknown or other
  misc_feature (251)..(251): n is a, c, g, or t
tcagacagtatatacacgaccggtgctcgatttagtatagacatcagggacttaggggctttgtcaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggtctgggacacatttcactctcaccatcagcagcctgcagcctggatatttcgcgtacttatactgacctaaactaattactttctttttactccgttacgtaggttttcgaccgtagggacctaagtcgtaggagataacgaaaggtacgtgtacggctcgactacctatccgttgttccttctacgttcccttccgacctatctagtacttatacttactgtctggacggcggtcgtcggacgaacggcgcgtaag

SEQ ID NO: 288729 - DNA, 658 bp, Homo sapiens
  misc_feature: GYAE6OF01DT0XD.44.75.G09.1.454.CMB.1.raw
  modified_base (408)..(408): a, c, t, g, unknown or other
  misc_feature (408)..(408): n is a, c, g, or t
tcagacagtatatacacgaccggtgctcgatttagtatagacatcagggacttaggggctttgccaggctcctgctgctctgtttccccggtgccaggtgtgacatcgagatgacccagtcctccgtcctcactgtctgcgtctattggggacagagtcaccatcacttgccgggcgagtcgccgacattaggtacttttttggcctggtttcagcaggagccgtggacaaacgtcccctaagtccctgtacttcttttcgtaggactcctactttggaagtaggtggacgtcccaggtccaggttccagccggctaggttggttcgtgggacctactactttcactcctacaccatcagcagcctggctaggcctggagtactttccggacgtaactttattaccgngtaaccctaaactaaatttacttttaccgttttttacgtaccgtttaaccgttaggttttcgggacccgtaaggggtaaacccaaggtccgtagggaacgtagtaaacggtaaaacggaacttggtacggtcgttacgaccctaccgacttccgtgtttacctaccgtacttcccctcccgactacgtctacgtaattactacgtattggtcctaggcggtcgggtcgtacggagaacggcgacggtaag

SEQ ID NO: 288730 - DNA, 524 bp, Homo sapiens
  misc_feature: GYAE6OF01CORI9.44.75.G09.1.454.CMB.1.raw
  modified_base (323)..(323): a, c, t, g, unknown or other
  misc_feature (323)..(323): n is a, c, g, or t
  modified_base (362)..(362): a, c, t, g, unknown or other
  misc_feature (362)..(362): n is a, c, g, or t
  modified_base (383)..(383): a, c, t, g, unknown or other
  misc_feature (383)..(383): n is a, c, g, or t
  modified_base (393)..(393): a, c, t, g, unknown or other
  misc_feature (393)..(393): n is a, c, g, or t
  modified_base (440)..(440): a, c, t, g, unknown or other
  misc_feature (440)..(440): n is a, c, g, or t
  modified_base (442)..(442): a, c, t, g, unknown or other
  misc_feature (442)..(442): n is a, c, g, or t
  modified_base (452)..(452): a, c, t, g, unknown or other
  misc_feature (452)..(452): n is a, c, g, or t
  modified_base (472)..(472): a, c, t, g, unknown or other
  misc_feature (472)..(472): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagtggggacagagtcaccatcacttggccgggcgagtgccgactattagggtacttttttgggccttggtttcagcgaggagcctggaccaaacgcccctaaagtcccctgtattcttttcgtggatcacgtttgaagagtggatcccagcaggttcagcgctagtggtctgggacactnttcactctcaccatcagcagctgctagctggatattcgngtatattactgccaataattnttccttttanctactgtttggctagggacctaagcgtagagtatacgaaaggtctgngntcgactaccngtctgtcttactgtcctccnccatctagtatactatattcgctggcgcggtctagggacaaggcgtgtaacg

SEQ ID NO: 288731 - DNA, 857 bp, Homo sapiens
  misc_feature: GYAE6OF01CKAF6.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgacagttaggtacttttttggccttggttcagcaggagccgtggaccaaacgccccttaagtccctagtacttcttttcgtggacttcctaacgttttggaaaggtaggttcggacgtcccaggtccgtagggtttaccgaaggccggtcgtaagggttcgggtttacgtacggggaacctaacgttacttttacccaacttccttacccaaaccctagttccgaacgccgtaacggcccttacggacaacgggtcccgttagggtaacgtacgttttaccggaccgttaacttttaacgtttacccgacggtaaccctaaaactaactttacgttttaccttttttaacgtacccggtttaacgttacggttttacgggacccggtaacggggtaaccgtaaacggtacgttagggtaacgtaacgtaacggaaaacgggtaacgttacgggtacggtacgtacggtaccctaccgtaacttccgttacgttaccgtttaccttaacgtttccccgtttaccccggtacccttaacggttaccgttaacggttaactttaaccggtttaacctttaacggtttaccggtttaccggttaccggggtaacgggttacccgggggttccgtaacggggtaacccggtaacggggtacccggtaacggttaacggg

SEQ ID NO: 288732 - DNA, 674 bp, Homo sapiens
  misc_feature: GYAE6OF01EBRSD.44.75.G09.1.454.CMB.1.raw
  modified_base (262)..(262): a, c, t, g, unknown or other
  misc_feature (262)..(262): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtcgccgactagttaggtacttttttggccttggtttcagcaggagcctggacaaacgcccctaagtccctgtacttcttttcnggtacttcctacttttgaagtagtggacgtcccagccgtaggttcaggcggctaggttcggttcgtgggacactatttcactctcaccatcagcagcctgccagccgtggactagtttccgacgtactttattactcgacctaaactaatttactttactttttactccgttacttaggttttcggaccgtaacggggacctaaggtcgtaggaacgtacgtaacgaaacggtacgtggtacgtcgtacggactaaccgtattccgttacgttcctttaccgtacccttcccgttccccgtaccttagttacccttagtaacttaacgttactttaaccgttcggttccgttacgggtaccgggtacccggggtaccgtacggggtaacccgtaacgggccgtacgtaacgg

SEQ ID NO: 288733 - DNA, 608 bp, Homo sapiens
  misc_feature: GYAE6OF01BNOR2.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtcccctgattcttttctggatccactttgaagagtggacgtcccagccaggttcagcggcagtggttctgggacacatttcactctcaccatcagcagcctgcagcctggagtatttcgcgtactttattactgacctaaacaaatttactttacttttttaactcccgtttaacgttagttttcgggaccgtacggggtaacctaacgtcgtagggacgtaagtaaccgaaaagggtaactggtcggtcgtacgctacctattcgtcgtttccttctacttcccttaccccgcctacttaccgtagtaactttatacttacttgttctgtacgggcgggtcgtacgggacgaacgggtcgacgtaag

SEQ ID NO: 288734 - DNA, 707 bp, Homo sapiens
  misc_feature: GYAE6OF01DN012.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgaccccagtctccgtcctcactgtctgcgtctattggggacagagtcaccatcacttgccgggcgagtgccgacattaggtacttttttggcctggtttcagcaggagcctggcaaagcccctaagtccctgattcttttctggatccactttgaagagtggatcccagccaggttcagcggcaggtggttctgggacactatttcactctcaccatcagcagcctgcagcctggagtattttcgcgtactttatactgacctaaactaattactttcttttttaactacccgtttacgttaacggtttttcgggacccgtaagggggtaaccctaaaggtacgttacgggtaagtaacgttaaccggtaaaaagggtaaaccgttagggtttacgggaccgttacggacccgtaaaccctacgtttaccgtttacgtttacccgttttacctaacgtttccccgtttacccccggtacccttaaccgttcccgttaggtaactttaactttaacttaacccgtttcggtttccgttacgggtacgggtcccggggttcgtacggggtaccgaaacgggtccggtaccgtaaagg

SEQ ID NO: 288735 - DNA, 748 bp, Homo sapiens
  misc_feature: GYAE6OF01A9K55.44.75.G09.1.454.CMB.1.raw
  modified_base (259)..(259): a, c, t, g, unknown or other
  misc_feature (259)..(259): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtcgccgactattaggtacttttttggccttggtttcagcaggagcctggcaaacgccctaagtccctgtattcttttcgnggtactcctactttgaagtggtaggacgtcccagcctagggttcaggccggctaggtcggttcgtagggaccacgtactttcaccttccgtctaccatccgaacgctaacgccttcgccgtagtcccgttaggaacgttacgttttcgaccggttaatttacgttaccgtcggtaaaccctaaactaaacgtttacttttaccttttttaacgttacccgtttaacgtttacggttttacgggtacccggtaaacggggtaaccgtaaacggtcgggttaacgggtaacgtaaccggttaacgtaaaacggttaccggttagggttagggtaccgttaccggacccgtaaccgtaacgtttccgtaacgtttcccgtttacttacctttcccgtttacccccgaccttacttccgtaaggttaacttaacgttaccttagtcggttccgaggtacgggccggtcgtaccggtagaacggtcgacgtaag

SEQ ID NO: 288736 - DNA, 525 bp, Homo sapiens
  misc_feature: GYAE6OF01CCFO1.44.75.G09.1.454.CMB.1.raw
  modified_base (346)..(346): a, c, t, g, unknown or other
  misc_feature (346)..(346): n is a, c, g, or t
  modified_base (519)..(519): a, c, t, g, unknown or other
  misc_feature (519)..(519): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggtctgggacacatttcactctcaccatcagcagcctgcagcctggagtntttcgcgtacttatactgacaactattatttctttttatccgtactgtttggccgtagggaccaaggtctggagagtacaaaggtactgtgctgacacattctgttccttcacttccttcccgctatccgtgtatatatacttgtctggaggcgggtcgtacggacaaggcgngtaacg

SEQ ID NO: 288737 - DNA, 650 bp, Homo sapiens
  misc_feature: GYAE6OF01DR3ZN.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttggccgggcgagtcgccgactagttaggtacttttttggccttggttcagcaggacgcctggacaaacgcccctaagtccctgtattctttctggactcctactttgaagagtggactccagccgaggttcacggcggctaggttggttcgtagggactacgtatttccacttcctacaccatccgaacgcacgtcctggccacggccgtggacgttacgttttccgaccgttacttagtttacctacgaacctaaagtaatttacttttacttttttactccgtttaacgttacggtttcggaccggtaacggggtaacctaacgggtacgttaggaagtaacgtaacgtaaacgtaacgtggtcgtctcgactaacctatccgttgttccttctacttccttcccgactctctagtattaacgttactacgttcgtcgtacggacggtcgggtacgtacgggacggtaacggcgtcgtag

SEQ ID NO: 288738 - DNA, 694 bp, Homo sapiens
  misc_feature: GYAE6OF01BKWMH.44.75.G09.1.454.CMB.1.raw
  modified_base (254)..(254): a, c, t, g, unknown or other
  misc_feature (254)..(254): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggacaaagccctaagtccctgacttcttttcnggatccactttgaagagtggagtcccagccaggttcagcggcagtggttctgggacacatttcactctacaccatcagcagcctgccagccgtggacgtatttcgcgtaactttattactcgaccaaactaattatttaccgttttttaactacccgttaacttacggtttttcggaccggtacggggtaaccctaaggtccgtagggacgtaagtaacgtaaaagggtaaacctagggtttagggaccgtacggtaccctaaccgtaacgtttcgttccggtttaaccctttcctaaccctttcccgttacccccgtacccgttacttacccgttaggtaactttaacgtttaaccttaaccggtttcggtttaacgtccgggtaagggtcccgggggtacccggttacgggtaaccggaacgggtccgtacgtaacgg

SEQ ID NO: 288739 - DNA, 599 bp, Homo sapiens
  misc_feature: GYAE6OF01CI765.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgatcttttctggatccactttgaagagtggagtcccagccaggttcagcggcagtggttctgggacacatttcactctcaccatcagcagcctgcagccgtggagtatttcgcgtacttattactgaccaactaattactttcttttttaactaccgttacttagttttcggaccgtacggggaaccaaggtctgggaagatacgtaaaggtacttggtacggctacgcctaacctattcctcgttccttctacttcccttccccgtacctacttcctagtaattacttacgttaccttcgttccgttggtaacggccggggttaccgtcgggtaccgtaacgggccgtaccgtaag

SEQ ID NO: 288740 - DNA, 566 bp, Homo sapiens
  misc_feature: GYAE6OF01CR5X0.44.75.G09.1.454.CMB.1.raw
  modified_base (262)..(262): a, c, t, g, unknown or other
  misc_feature (262)..(262): n is a, c, g, or t
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
  modified_base (372)..(372): a, c, t, g, unknown or other
  misc_feature (372)..(372): n is a, c, g, or t
  modified_base (402)..(402): a, c, t, g, unknown or other
  misc_feature (402)..(402): n is a, c, g, or t
  modified_base (564)..(566): a, c, t, g, unknown or other
  misc_feature (564)..(566): n is a, c, g, or t
tcagacagtatatacacgaccggtgctcgatttagtatagacatcagggacttaggggctttgccaggctcctgctgctctggctcccaggttcgagatgtgacatcgagatgaccaagtctccttccttcctgtcttcttctgttggaggcagcgtcaccatcacttgccgggcgagtcaggtcgttttcggtgctgttgcctggtttacaaacgaaaaagggggagacggcccctaaggtcctcgtctctcgtgaaaccngactggaaggtagagtcccgtcaggttcagtgccagtccagggtggtgggccggagtccactctcaccattagcgacctgcggcctgaagattcngactaactttnttcngtcagctagtatcagtagtcgccccgtttntacgttttcggccgagggaccaagtactaggaaactacgaaacgacgtgtgctcgccacctatctcgttccttactacgttccttcccgacctacttacctgtaacttattaacttacgttgttcgtggacggccgggtcgtcggacgacggcgacatacgnnn

SEQ ID NO: 288741 - DNA, 653 bp, Homo sapiens
  misc_feature: GYAE6OF01DJBKH.44.75.G09.1.454.CMB.1.raw
  modified_base (259)..(259): a, c, t, g, unknown or other
  misc_feature (259)..(259): n is a, c, g, or t
  modified_base (312)..(312): a, c, t, g, unknown or other
  misc_feature (312)..(312): n is a, c, g, or t
  modified_base (363)..(363): a, c, t, g, unknown or other
  misc_feature (363)..(363): n is a, c, g, or t
  modified_base (374)..(374): a, c, t, g, unknown or other
  misc_feature (374)..(374): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctagttggggacagagtcaccatcacttggccggcgagtcgcgactagttaggttacttttttggccttggtttcngcgaggagccgtaggaccaaacgtcccctaacgtccctgtactttcttttcgnggtactcctacgtttgaagtagtgacgtcccgagcgtaggtcgaggcggtnaggtgggttcngggtacactactttcacctctacaccatcacgcacgtcctcgacgacgtcgtacggtagttacgtttaccgaccgttaactttacgttacctacgtaaccctaaattaatttaacttttacgttttttactacccgtttacgttacggttttacgggacccggtaaggggtaaccctaaggtcgtaggtaagaacgttaacggaaacgggttacgttaggcggttaccgtcgtaacctaccgtacttacgttaccgttctttccgtccgtttacccccg

SEQ ID NO: 288742 - DNA, 721 bp, Homo sapiens
  misc_feature: GYAE6OF01BQLZV.44.75.G09.1.454.CMB.1.raw
  modified_base (186)..(186): a, c, t, g, unknown or other
  misc_feature (186)..(186): n is a, c, g, or t
  modified_base (317)..(317): a, c, t, g, unknown or other
  misc_feature (317)..(317): n is a, c, g, or t
  modified_base (407)..(407): a, c, t, g, unknown or other
  misc_feature (407)..(407): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccganattaggtacttttttggccttggtttcagcaggagcctggacaaaagcccctaaagtccctgtacttcttttcgtggacttcctacttttaggaaagtaggtcggagtccccgagccaggttcaggccggnaggttggttcgtagggacactatttcacttccacaccatccagcagcctgccagcctaggagtactttcggactaactttatttaaccgngaaccaaactaaatttactttacttttttaacgtaccgttaacgttacggttttcgggacccgtaacgggggaaaccctaaagggtccgttaagggaagtaacgttaaaccggaaaaagggtaaaccgttgggtacggtacgttacgaacctaacccgtaacgttacgttcggtttaccctttacgtaacctttcccgttaccccggtaccctaattaccgttagtaaacgtttaacgttaacttaacgttcggttaccgttacgggaacgggtccggggtcgtacgggaaccggaaacgggccgacgtaaagg

SEQ ID NO: 288743 - DNA, 738 bp, Homo sapiens
  misc_feature: GYAE6OF01B7GZE.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggacaaaacgcccctaaagtccctgtacttcttttctaggtactcctactttagaaaggtaggtaggacgtcccagtccgtaaggttccgaggcggcgtaggttgggtttcgagggaccactatttcactcctacaccatcagcagcctgcacgccgtggagtagtttccgacgtacttattactcgacctaaactaattatttacttttttacgtaccgtttaacgttacggtttttacggaccggaacggggtaacccgtaaggtaccgtagggtaagtaacgttaaccggtaaaaacggtaacgttagggtacggtacctacggtacctaacccgtaacttcctttacggttaccctttacctaaccttttccccgttacccccgacccttacgttaccgttacggttaaacttaacgttaaactttaaccgttacggttccgttaacggggttacgggaccggggggttaccgttacggggaacccggtaacgggacccggtaacgtaaggg

SEQ ID NO: 288744 - DNA, 518 bp, Homo sapiens
  misc_feature: GYAE6OF01CMEBJ.44.75.G09.1.454.CMB.1.raw
  modified_base (250)..(250): a, c, t, g, unknown or other
  misc_feature (250)..(250): n is a, c, g, or t
  modified_base (266)..(266): a, c, t, g, unknown or other
  misc_feature (266)..(266): n is a, c, g, or t
  modified_base (388)..(388): a, c, t, g, unknown or other
  misc_feature (388)..(388): n is a, c, g, or t
  modified_base (443)..(443): a, c, t, g, unknown or other
  misc_feature (443)..(443): n is a, c, g, or t
  modified_base (493)..(493): a, c, t, g, unknown or other
  misc_feature (493)..(493): n is a, c, g, or t
  modified_base (507)..(507): a, c, t, g, unknown or other
  misc_feature (507)..(507): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagngtggagtcccagccaggttcagcggcagtggttctgggacactatttccatctcaccatcagcagctgcagcctgggatatttcgcgtaacttattactgaccaaataattattctttttanccgttactagttttggaccagggtaccaagctggagatacgaaaggaactgtggntgcacgatctacgtcttcattcctcccgcatctcgattatactactgtcnggaggcggctgganaacggcactag

SEQ ID NO: 288745 - DNA, 792 bp, Homo sapiens
  misc_feature: GYAE6OF01CEVIO.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagtggggacagagtcaccatcacttgccgggcgagtgccgactattaggtacttttttggccttggtttcagcaggacgccgtggaccaaacgcccctaagtccctgtacttctttcgtggtactcctactttgaagtaggtggacgtcccagcctaggttccaggcggacgtaggtcggttcgtagggactacgtatttccaccttcacacctatcagtccagtcctagctacggtcctagggatacgttttccggacgttaactttacttaccgtacgtaaccctaaaacttaactttactttttacttttttaacgtacccgtttaacgttacgggtttttaccgggaacccggtaacggggtaaaccctaacgggtccgtaaggggtaacgtaacggtaaaccgtaaaaacgggtaccgttacgggttacgggtaccttaccggaacccgttaaccgttaaccgtttacgtttccggttttacccttacccgtttacccgttttacccccgtttacccccgtaaccttaacgtttccgttaacgttaacgtttaaacgtttaaccgttaccgtttcggttaaccggttacgggtaccgggtccggggttaccgtacgggaaccggaaccgggtccgtagtaacgg

SEQ ID NO: 288746 - DNA, 625 bp, Homo sapiens
  misc_feature: GYAE6OF01CIR4G.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgtattcttttctggatccactttgaagagtggagtcccagccaggttcagcggcagtggttctgggacacgtatttcactctcaccatcagcagcctgcagcctggatagtttcgacgtactttattacgtgacccaaactaattactttccttttttaactcccgttaacttacggttttcggacccgtaacggggtaacctaagtcgtaggagtagtacgaaaggtacgtggtcggctcgactacctattcgttcgttccttactacgttcccttccccgtacctactctacgtattaacgttacgttaccgttagttcgtacgggtaacgggtccggggtacgttcgggaaccggtaacgggtcccggtagtaacgg

SEQ ID NO: 288747 - DNA, 610 bp, Homo sapiens
  misc_feature: GYAE6OF01BUIH3.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaacgcccctaagtcccctgtacttcttttctggactccactttggaagagtggagtcccagccaggttcagcggcagtggttctgggacactatttccactctcaccatcagcacgcctgcagccgtgggatagtttcgacgtacttattactgaccaaactaattactttctttttactccgttacttagttttcggaccgtaggggacctaaggcgtaggtagtaacgtacgaaaaggtaacgttggtacggtctcgaccacctattcgtgttcttctacttccttccccgtacctacttccgtacgtaattacgttacttacgttagttccgtaggtacgggaccggggtcgtacgggtacgaaacgggtcgtacgtaacgg

SEQ ID NO: 288748 - DNA, 675 bp, Homo sapiens
  misc_feature: GYAE6OF01CKYGG.44.75.G09.1.454.CMB.1.raw
  modified_base (305)..(305): a, c, t, g, unknown or other
  misc_feature (305)..(305): n is a, c, g, or t
tcagacagtatatacacgaccggtgctcgatttagtatagacatcaggggacttaggggctttgccaggctcctggctgctctgtttccccggtgccaggtgtgacatcgagatgacccagtctccgtcctcactgtctgcagtctgtgggagacagagtcaccatcacttggccgggcgagtcagggcagttagctaattatttagcctggtatcagacaagaaaaccgagggaaagctacctaagcctcctgatctaatgaaacatccattttgcaatcagggtccatctcggttcagcggcngtgatcgtgggactagtattcacttcgtaccaccgttacacgcagcctgccgtacgtcctaggaaactagttcggttacgtactaacgtttaatttaaccgtacgttacgtaaaaagttactaaaaccgtacgttcgacccccttacgtaccgttaccgtttcccgggaccccgttacgggaacccaaccgttaggtacggtaactttaacgtaccgaaacggaccgtaacgttcggttacgggtacctacgtacctaaccctagttacccgttcgttaccgtttacgttaacccgttcccgtttaaccccgcccttaagttacccgtaggtaacgttattaaccgttaccgttacgttcgttaacgggg

SEQ ID NO: 288749 - DNA, 533 bp, Homo sapiens
  misc_feature: GYAE6OF01BE27L.44.75.G09.1.454.CMB.1.raw
  modified_base (529)..(529): a, c, t, g, unknown or other
  misc_feature (529)..(529): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacactatttcactctcaccatcagcagcctgcagcctggagtatttcgcgtacttattactcgcctaaacaattacttcttttttactccgttactagttttcggccgtaaggggtaccaagctaggagtatacgaaaggtactgtgctgcacatctcgtcttctacttcctcccgcctatctcgattatacttactgtctgacgcgggtctggacgacggcgntacg

SEQ ID NO: 288750 - DNA, 599 bp, Homo sapiens
  misc_feature: GYAE6OF01D6SXO.44.75.G09.1.454.CMB.1.raw
  modified_base (550)..(550): a, c, t, g, unknown or other
  misc_feature (550)..(550): n is a, c, g, or t
  modified_base (590)..(590): a, c, t, g, unknown or other
  misc_feature (590)..(590): n is a, c, g, or t
tcagacagtatatacacgaccggtgctcgatttagtatagacatcagggacttaggggctttgccagggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctaggcaaacgcccctaagtcccctgtacttcttttctggactcctactttgaagtgtcggacgtcccagcctaggttcaggcggactaggttcgggttcgtggggacactatttcactctcacatcagcagcctgcagcctggatacgtttcgcgtaactttatactcgaccaaatattatttctttttactccgttactggtttacgccgtaagggaccaaggtcgtaggatataacgaaaggtacgtggtaggctgactaacgtcttcgtcgttcttcctatcccgtttcccgactacgttcgtatattacttaacttaccgttnttcgttacggacgggtacgggtcgtacgggacggtacggngtactaagg

SEQ ID NO: 288751 - DNA, 743 bp, Homo sapiens
  misc_feature: GYAE6OF01EHNP6.44.75.G09.1.454.CMB.1.raw
tcagacagtatatacacgaccggtgctcgatttagtatagacatcagggggaggaatcagacccagtcaggacacagcatggacatgagagtcctcgctcagctcctggggctcctgctgctctgtttccccggtgccaggtgtgacagtcgagatgacccagtctccgtcctcactgtctgcgtctagttggggacagagtcaccatcacgttcggccgggcgagtcgccgtactagtttaggtacttttttcggccttggtttcaggcgaggacgcctggacaaacgccctaagtcccctgtactttcttttcgtggtactccgtacgtttagaaggtggtggacgtcccaggtcctaggttccgaggtcggcgtaggttcggttcgtagggactaactacgtttacacctcctaccaaccctatcacggtcctacgtcccgtagacctacggtcccgtagggtaacgttagtttcccgtacgttactttaacgttaactccggtaaccctaaactaacgttttacttttacgttttttaaccgttaccggtttaacgtttacgggttttaccggaccgggttaaacggggtacccgtaaacggttcggtaacgggtaaacggtaccgttaaaacggttaaacggggtaaacgttcggggttaacggttcccgtacgggtaacccttaaccggttaacgtcccgtttacggttttacccttccgttaccgtttaccccccg

SEQ ID NO: 288752 - DNA, 532 bp, Homo sapiens
  misc_feature: GYAE6OF01DQQZC.44.75.G09.1.454.CMB.1.raw
  modified_base (371)..(371): a, c, t, g, unknown or other
  misc_feature (371)..(371): n is a, c, g, or t
  modified_base (528)..(528): a, c, t, g, unknown or other
  misc_feature (528)..(528): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtcccctgatctttctggatccactttgaagagtggagtcccagccaggttcagcgggcagtggttctgggacacatttcactctcaccatcagcagcctgcagcctggagatttcgcgacttatactgaccaaanattattcttttttatccgtactagttttcggccagggaccaagctggagatacgaaaggactgtggctgcaccatctcgttcttctacttccttcccgccattctgtattagttacttacttgttctcgtaggccgggtcgtacggcgaacgggcgngtag

SEQ ID NO: 288753 - DNA, 720 bp, Homo sapiens
  misc_feature: GYAE6OF01C06XE.44.75.G09.1.454.CMB.1.raw
  modified_base (256)..(256): a, c, t, g, unknown or other
  misc_feature (256)..(256): n is a, c, g, or t
  modified_base (678)..(678): a, c, t, g, unknown or other
  misc_feature (678)..(678): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtactttttggcctggttcagcaggagcctggacaaaacgcccctaaagtccctgtattcttttcnggtactccgtaacttttggaaagtaggtgggaacgtccccgaagcccgtagggtttccaaggtccggcgtagggttcgggtttccgtggggaacctacgtacttttaccaccttcctaccaccctaattccgagtaccgacgccctacggccgaacggtcccgttagggacgttactttcggtacgtaaccttttaacttaccgtcgaacctaaacttaaattactttacttttttactaccgttacgttaaggttttcggacccgtaacggggtaacctaagtaccggtaggagtaacgtaacgaaacggtaaacgttgggtacggtcgtacgaccaacctacttacgttcgttcttcctacgttcccttaccccgtaccgtacttcctacgtaacttaacttacttaccgttgttaccgnggttacgggccgggtcggtacggacgaacgggtcgagtaacg

SEQ ID NO: 288754 - DNA, 762 bp, Homo sapiens
  misc_feature: GYAE6OF01B8C9O.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgtacttcttttctggactcctactttgaagaggtggacgtcccagccaggttcagcggcaggtggttcgtcgggcactatttccacttctcaccatcagcacgcctagcacggcctgggagtacttttccggacgttaacctttaacttaccgtacgtaacccctaaaacttaaactttactttttacctttttttaaccgtaccccggtttaacgttacgggttttttaccgggacccgggtaaacgggggtaaacccgtaacggtaccgttaggggaacgtaacgttaaacggtaaaacggttaaccggtttacggttagggtaccgttacgtacccgtaacccgttaacgttccgtttaccgtttacctttaccgttacccgtttacccgtttacccccggtaccttaaccgtttccgtagttaaactttaacgttaaccttaccgttacggttaccgtacgggtaacggtcccggggtacgttacgggacgtaaccgggtcgtaccggtaacg

SEQ ID NO: 288755 - DNA, 601 bp, Homo sapiens
  misc_feature: GYAE6OF01BWNV8.44.75.G09.1.454.CMB.1.raw
  modified_base (327)..(327): a, c, t, g, unknown or other
  misc_feature (327)..(327): n is a, c, g, or t
  modified_base (596)..(596): a, c, t, g, unknown or other
  misc_feature (596)..(596): n is a, c, g, or t
tcagacagtatatacacgaccggtgctcgatttagtatagacatcagggacttagggggctttgccaggctcctgctgctctgtttccccggtgccaggtgtgacatcgagatgacccagtctccgtcctcactgtctgcgtctattggggacagagtcaccatcacttgccgggcgagtgccgacattaggtactttttttggccttggtttcagcaggagcctggcaaacgcccctaagtccctgattcttttctggactccactttgaagagtggagtcccagccaggttcagcggcaggtggttctgggacacatttcactcncaccatcagcagcctgcacgccgtaggacgtacttttcggcgttaactttacttaccgtgaccctaaataactttattttacttttttaactccgttacgttaggttttcggaccgtacggggaacctaaggtcgttaggagtaacgtacgaaaggtactggtcggctcgctacctatctacgttccttacgtcttccgttccccgactactcgttagtacttagtacttcgttgtcgttggcggtacgggtcgtacggacgacggcgngtacg

SEQ ID NO: 288756 - DNA, 624 bp, Homo sapiens
  misc_feature: GYAE6OF01EE99O.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctagttggggacagagtcaccatcacttggccgggcgagtgccgactagttaggtacttttttggccttggtttcagcaggacgcctggacaaacgcccctaagtccctgtattcttttcgtggactcctactttgaagtagtggacgtccagccaggttcagcggctaggtgttcgtgggacactattcactctcacatcagcagcctgacacgtcctggacgtagttcgcgttacttagttacctgaaccctaaacttaattactttacgttttttacacccggtttaacgtacgggttttacggacccggtaacgggtaaccctaaggtcgttagggaactacgtaaacggtaaaacgggtacgttagggtacgggtacctacgggtaccctaacccgtattacccgttagtttacccttccgtaaccgtttcccccg

SEQ ID NO: 288757 - DNA, 627 bp, Homo sapiens
  misc_feature: GYAE6OF01CG3W5.44.75.G09.1.454.CMB.1.raw
  modified_base (251)..(251): a, c, t, g, unknown or other
  misc_feature (251)..(251): n is a, c, g, or t
  modified_base (364)..(364): a, c, t, g, unknown or other
  misc_feature (364)..(364): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcatcactgtctgcgtctattggggacagagtcaccatcacttgccgggcgagtgccgacattaggtactttttggccttggtttcagcaggagcctggcaaagcccctaagtccctgatctttcngatccactttgaagagtggagtcccagccaggttcagcggcagtggttctgggacacatttcactctcaccatcagcagcctgcagcctggagtatttcgcgtacttattacncgtaccaataattacttcttttttagtacccgttacttacgttttcgggacccgtaaggggtacccgtaaaggcgttagggaagtaacgtaaccgtaaagggaaccgttggtacgggacgttcggacctaaccctaagtccgtttcgttcctttaccgtacttacccgttccccgacccgtacttcctaggtaacgtttaacttacttaacttcgttacgttagggacgtccggggacgtacgggccgtaaacgggcgtaacg

SEQ ID NO: 288758 - DNA, 610 bp, Homo sapiens
  misc_feature: GYAE6OF01EC4S7.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcgcagtggttctgggacacatttcactctcaccatcagcagcctgcagcctggatatttcgcgtactttattactcgaccaaactaattactttacttttttactacccgtttaacttacggtttttcggacccgtaacggggaaccctaagtcgttagggaacgtaagttaaccgaaaagggtaacctggttacggcttcggacctacctagttcctcgttacctttctacttcccttccccgcctacttctagtaattattacttacttaggttcgtaggacggtccggggtctacgggacgaacgggtccgcgtaacg

SEQ ID NO: 288759 - DNA, 718 bp, Homo sapiens
  misc_feature: GYAE6OF01CTLRN.44.75.G09.1.454.CMB.1.raw
  modified_base (218)..(218): a, c, t, g, unknown or other
  misc_feature (218)..(218): n is a, c, g, or t
  modified_base (250)..(250): a, c, t, g, unknown or other
  misc_feature (250)..(250): n is a, c, g, or t
  modified_base (266)..(266): a, c, t, g, unknown or other
  misc_feature (266)..(266): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggancctggcaaagccctaagtccctgatcttttcnggactcactttgaagngtggagtcccagccaggttcagcggcagtggtctgggactactatttcactctacactatcagcagcctgctagccgttagggacgtacttttccggacgttaactttacgtttacctacgtacccctaaaacttaatttacttttacctttttttaacgttacccggtttaacgttaacggttttttacgggacccggtaacgggggtaaccctaacgggtaccgttagggaacgtaacgttaaccgaaaagggtaaccgttgggttacggtacgtacggacctaaccgtacgttccgttcggttacctttaccgtacctttacccgtaccccggtacccgttaacttccgttacggtaacttaacttaacgtttaaccgttcggttaccgtacgggtaaccgggtacgggtaccgttacgggaaccgaaacggggtccgtaccgtaaagg

SEQ ID NO: 288760 - DNA, 670 bp, Homo sapiens
  misc_feature: GYAE6OF01CVHM2.44.75.G09.1.454.CMB.1.raw
  modified_base (220)..(220): a, c, t, g, unknown or other
  misc_feature (220)..(220): n is a, c, g, or t
  modified_base (254)..(254): a, c, t, g, unknown or other
  misc_feature (254)..(254): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgactattaggtacttttttggcctggtttcagcaggancctggcaaagcccctaagtccctgattcttttcnggatccactttgaagtagtggacgtcccagccaggttcagcggctaggtggttctgggactactactttcacttctcaaccatcagcacgcctgcacgtccgtggagtactttcgcgtactttactactcgaccaactaattactttcttttttactccgttacttacggttttacggacccgtaaggggtaccctaaggtccgtaggtacgtagtaacgaaaggtaaccgttaggttacgggccttacgggactaaccccgtaagtttcccgtacggttcctttacgttacttccccggtttacccgacccgttacgttcctacggttaacttacgtttaaacttacgtttacggttcgtaacgggttacgggaccggggttcctacggggaccggtaacgggccgtacgtaagg

SEQ ID NO: 288761 - DNA, 712 bp, Homo sapiens
  misc_feature: GYAE6OF01C1WS8.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaacgcccctaagtccctgtacttcttttcgtggactcctacttttgaagtagtggaacgtcccagccaggttcagcggcagtggtctgggactacgatttcactctcaccatcagcagcctgcagccgtggagtattttcggacgtaactttaacgttacctggaccctaaaactaaactttaagtttcctttttttaacttcccggtttaaccttaaggttttttcgggaccgtaacgggggtaaccctaaaggtaccgtagggacgtaacgttaccgtaaaacgggtaactacggtcggtactacgggtacctaacccgtaacttccgttacggtttacctttacgtaacctttcccgtttaccccgacccgttaacttaccctaggttaacttaacgttaacttccgtttacggttccgttacggtaacgggtacccgggggtacgttacggggaccgttaaacggggcccgtacgtaaacgg

SEQ ID NO: 288762 - DNA, 555 bp, Homo sapiens
  misc_feature: GYAE6OF01D57RV.44.75.G09.1.454.CMB.1.raw
  modified_base (310)..(310): a, c, t, g, unknown or other
  misc_feature (310)..(310): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaacgcccctaagtccctgatcttttctggatccactttgaagagtggagtcccagccaggttcagcggctagtggtctgggacncatttcactctcaccatcagcagcctgcagcctggagtatttcgcgtacttatactgaccaaataattatttctttttactccgttactagttttcggaccgtacgggaccaagtcgtaggagtatacgaaaggtactgtcggctgacacctatcgttgtcttacgtacttcctacccgctacttcgtagtattacttactacgttgttcgtgacggcgggtcgtagggaccgaaggcgcgtaag

SEQ ID NO: 288763 - DNA, 761 bp, Homo sapiens
  misc_feature: GYAE6OF01C3JOE.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacgttcggccgggcgagtgccgactattaggtacttttttggccttggttcagcgaggagcctggacaaacgtcccctaacgtccctgtacttcttttcgtggactcctaacgtttggaagtaggtaggacgttccccgaagtccgtagggttaccaaggcggtacgtaggttacgggtttcgtacgggactacgttaattttccaaccttcctaccaacctattacccaggacccgaggtccccttaggcctaaggtcccgtagggacgttacgttttaccgaccggtaacttttaacttcgtaccgaacccctaaattaactttactttttacctttttaacgttacccggttaacttaacgggtttttccgggacccggtaacggggtaacctaaggtacggtacgggtaacgtaacgttaacggaaaaggtacgttacggtacggtctacggactaaccgtaacgtttccgttacgttccttacgttacttcccgtttcccgacccttaagttcctagtacttaactacgttacttacggttcgtacggtacgggtccgggttacgtacgggacgtaaacgggctaacgtag

SEQ ID NO: 288764 - DNA, 638 bp, Homo sapiens
  misc_feature: GYAE6OF01C1CWA.44.75.G09.1.454.CMB.1.raw
  modified_base (255)..(255): a, c, t, g, unknown or other
  misc_feature (255)..(255): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggacaaagcccctaagtccctgtattcttttcnggactcctactttgaagagtggagtcccagcaggttcagcggcagtggttctgggacactattcactctcaccatcagcacgctgcagcctaggacgacactgactaacttattactcgaccaacactatagtattcggtttcttccgtaccgttacttaccgttttacgggaccgtaagggggacgtaacggtccgttaggaacgtaactaaccgaaaacgtaacgttcggtacggtaccgttacgacctaccgtacttcgttcgttaccttacctaccgttcccgttaccccgtacctaacgttcgttacgttaacttaacttaacgtttaaccgttggttaccgttacggtacggtaccggggtcgttacgggaaccggg

SEQ ID NO: 288765 - DNA, 570 bp, Homo sapiens
  misc_feature: GYAE6OF01DFBI7.44.75.G09.1.454.CMB.1.raw
  modified_base (304)..(304): a, c, t, g, unknown or other
  misc_feature (304)..(304): n is a, c, g, or t
  modified_base (567)..(567): a, c, t, g, unknown or other
  misc_feature (567)..(567): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggacaaagcccctaagtccctgattctttctggactccactttgaagagtggagtcccagccaggttcagcggcagtggttcngggacactatttcactctcaccatcagcagcctagcagcctaggacgtatttcgcgtactttattactcgaccaaataattacgtttacttttttatcccgttactagttttcggaccgtaaggggaccaaagccgttaggacgaagtacgaaaagggtacgtagtcggactagtcaacctagtcttagttcttcgacttccgttcccgcctactctcgtatactaactactgttctcggagcggtcgtaggacgaacggcgntag

SEQ ID NO: 288766 - DNA, 651 bp, Homo sapiens
  misc_feature: GYAE6OF01CNZJP.44.75.G09.1.454.CMB.1.raw
  modified_base (307)..(307): a, c, t, g, unknown or other
  misc_feature (307)..(307): n is a, c, g, or t
  modified_base (350)..(350): a, c, t, g, unknown or other
  misc_feature (350)..(350): n is a, c, g, or t
  modified_base (645)..(645): a, c, t, g, unknown or other
  misc_feature (645)..(645): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgacattaggtactttttttggccttggtttcagcaggagcctggacaaacgcccctaaagtccctgtattcttttctggactcctactttgaagagtggagtccctagccaggttcaggccggngtagttggtcgtggacactacttcactctcacatcagcagctncacgctaggatacgttcgcgtaacttattactcgacctaaataacttattttctttttactccgttaacgttcgttttacgggaccgtaaggggtacctaaggtccgtaggaagtacttaacgtaaaggtactacggttaggccttacgacctaaccgtaattccgttaccgttacgttaccttaccgttaccccgttcccgacccgtttactaccgttacgttaaacttacttaaacgttcctacggtttccttagggaccggtccggggtacgtacgggtacggaacggtcgnggtaac

SEQ ID NO: 288767 - DNA, 731 bp, Homo sapiens
  misc_feature: GYAE6OF01C2RMR.44.75.G09.1.454.CMB.1.raw
  modified_base (298)..(298): a, c, t, g, unknown or other
  misc_feature (298)..(298): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaacgcccctaagtcccctgattcttttctggatccactttgaagagtggagtcccagccaggttcagcggnagtggtctgggacactatttcactctcaccatcagcacgcctgcacgccgtaggagtatttcgcgtaacttattactgaccaaactaattacttttacttttttacttaccgttacgttaggtttttcggacccgtacggggtaacctaaggtccgttagggaacgtaagtaaccggtaaaaacgggtaaccgttagggttacgggtaccgttacgggtacccgtaaacccgtaaccgtttaccgtttacgtttaccctttaccgttaacccttttaccccgttttcccccgggtacccttaaccgtttaccgttaccgggttaaactttaaacgtttaaacctttaaccgtttacggttccggttacgggtacgggtacccgggggttacccgttaacggggaccgtaaaccgggggccgtaccggtaaagg

SEQ ID NO: 288768 - DNA, 611 bp, Homo sapiens
  misc_feature: GYAE6OF01BEJ95.44.75.G09.1.454.CMB.1.raw
  modified_base (414)..(414): a, c, t, g, unknown or other
  misc_feature (414)..(414): n is a, c, g, or t
tcagacagtatatacacgaccggtgctcgatttagtatagacatcaggggaggaatcagacccagtctaggacgacaggcatggacatggagagtcctcgctacagcctcctggggctcctgctgctctgtttccccggtgccaggtgtgacgatcgagtatgacccagtctccgtctcactgtctgcgtctagttggggacagagtcaccatcacttgccggcgacgtcgaccgacattacggtactttttcggccttggtttccagccaggagcctggacaaacgcccctaagtcccctgattccgttttcgtgggactccgtacgtttggaagtaggtcggtacgttccccagccctaaggttccacggcggcgtaggtcggttcgagggacacgtatttcactctcaccntcagcagcctgcagcctggacgtatttcgactactttatacgtgaccaataattactttactttttactaccgttacttaggttttcggaccgtaaggggaccaaggtcgtaggagtacgtaacgtaaaggtaaccttggtacggtcgtacggacctaaccgtacttccgttacggttcctttcgtaacgttccccg

SEQ ID NO: 288769 - DNA, 515 bp, Homo sapiens
  misc_feature: GYAE6OF01AHSXD.44.75.G09.1.454.CMB.1.raw
  modified_base (463)..(463): a, c, t, g, unknown or other
  misc_feature (463)..(463): n is a, c, g, or t
  modified_base (496)..(496): a, c, t, g, unknown or other
  misc_feature (496)..(496): n is a, c, g, or t
  modified_base (513)..(513): a, c, t, g, unknown or other
  misc_feature (513)..(513): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacactatttcactctcaccatcagcagcctgcagcctggagatttcgcgtacttattactgaccaactaattacttctttttactccgttactagttttggccgtagggtaccaagcgtaggagactacgaagtactgtgctgcacgatctgtcttcncttcctcccgctatctgtatatatactgtctgngcggtcgtggacagcgnag

SEQ ID NO: 288770 - DNA, 565 bp, Homo sapiens
  misc_feature: GYAE6OF01BBTZP.44.75.G09.1.454.CMB.1.raw
  modified_base (313)..(313): a, c, t, g, unknown or other
  misc_feature (313)..(313): n is a, c, g, or t
  modified_base (331)..(331): a, c, t, g, unknown or other
  misc_feature (331)..(331): n is a, c, g, or t
  modified_base (378)..(378): a, c, t, g, unknown or other
  misc_feature (378)..(378): n is a, c, g, or t
  modified_base (559)..(559): a, c, t, g, unknown or other
  misc_feature (559)..(559): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgattcttttctggatccactttgaagaggtggatcccagccaggttcagcgcagttgtctgggacacntttcactctcaccatcancacgcctgcagccgtggagtactttcgctacttattctagaccaaanattacttctttttatccttacgtagtttcggacgtacgggaccaagtcgtaggagtactacgaaaggtacgtgtcggctagacacgtagttctcgttacctctacttccttcccgctactcgtcgtaatacgttacttcttggttctcggacggtcgggtcgttacgggacgtacgggcgngtacgg

SEQ ID NO: 288771 - DNA, 599 bp, Homo sapiens
  misc_feature: GYAE6OF01AVT4X.44.75.G09.1.454.CMB.1.raw
  modified_base (357)..(357): a, c, t, g, unknown or other
  misc_feature (357)..(357): n is a, c, g, or t
  modified_base (447)..(447): a, c, t, g, unknown or other
  misc_feature (447)..(447): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccgggcgagtcgccgacattaggtacttttttggccttggtttcagcaggagcctggacaaagcccctaagtccctgtattcttttctggactcctactttggaagagtggacgtcccagcctaggttcagcggcaggtggttcgngggacatatttcactctcaccatcagcagcctgcagcctggagtattcgctacttattactcgacctaataacttactttctttttaacnccgttacttacgttttcgggacccgtaaggggtacctaaggtcgtagggaacgtaacgtaaccggaaaacgggtacgttacggtacgggtaccttccgggaccctacccgttaacttccgttacggtttacctttcccgtactttacccccg

SEQ ID NO: 288772 - DNA, 740 bp, Homo sapiens
  misc_feature: GYAE6OF01DFBU2.44.75.G09.1.454.CMB.1.raw
  modified_base (220)..(220): a, c, t, g, unknown or other
  misc_feature (220)..(220): n is a, c, g, or t
  modified_base (326)..(326): a, c, t, g, unknown or other
  misc_feature (326)..(326): n is a, c, g, or t
  modified_base (338)..(338): a, c, t, g, unknown or other
  misc_feature (338)..(338): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtcgccgactattaggtacttttttggccttggttcagcaggngcctggacaaacgcccctaagtccctgtacttcttttcgtggactcctacgttttgaaagtagtggacgtcccaagccaggttcagcggcagtggtctgggacacnttcactctcacntcagcagcctgcacgcctaggagtattttccgacgtactttactacgtgaccctaaacgtaatttactttcttttttaacttacccgttacgttacggtttttcgggaccgtaacggggtaacctaaggtcgtacgggaagtaacgttaacgaaaacgggtaaccgttggttacgggtaccgttacggaccctaaacccgtaacgtttccgtttacgggtttaccctttaccgttaaccgttttccccgtttaccccccggacctttaaccgtttacgttacggttaaactttaaaccttaacgttaaccggtttacggtttaccggttacgggtaacccggggtaccggggttcccgttaacggggacccggtaaaacgggggtcccgtaacggtaaacgg

SEQ ID NO: 288773 - DNA, 870 bp, Homo sapiens
  misc_feature: GYAE6OF01DEOG0.44.75.G09.1.454.CMB.1.raw
tcagacagtatatacacgaccggtgctcgatttagtatagacatcagggacttaggggctttgccaggctcctgctgctctcgtttccccggtgccaggtgtgacatcgagatcgacccagtcctccgtcctcactgtctgcgtctagttggggacagagtcaccatctacgttcggccgggcgagtcgccgaacttagtttacggttcttttttcggccttggtttacacgacgaggacgcctacgggaccaaaccgtccccgttaacgtcccgtagttctttccgttttacgtacggtacttaccgttacgtttacggaaggtacggtacgggtaaccgttcccacggtccggtacggttacgacggtccggtacggtacggtttcgggtttaccggtacggggtaaccttaccgttaacgttttacccgtaacccttccgtaaccctaaccgtaccgttaccgaacggaaccgtacggtccccgttaaggcccggttaacggtacccggttagggaaccgtttaccgtttaccggaccggtttaactttaacgttaccgtaaccgtaaaccttaaacgtaacgtttttactttttaaccgtttttacgtacccgtttaacggtttccggtttacgggaaccgttaacggggtaacctacggttccggtaagggtaacttaacggtaaaccgtaaacggtcgtttcgtacggactccgaacttaccgtacgtttcgtccttacccgtacttaccgttacccgttccccgtaatagtttccgaacgtttaacttacgtacttaccggttcggttaccggttaggacccgggtcggtacggtacggtaccggaaacgtccgaagtaacgg

SEQ ID NO: 288774 - DNA, 852 bp, Homo sapiens
  misc_feature: GYAE6OF01C3803.44.75.G09.1.454.CMB.1.raw
  modified_base (230)..(230): a, c, t, g, unknown or other
  misc_feature (230)..(230): n is a, c, g, or t
  modified_base (266)..(266): a, c, t, g, unknown or other
  misc_feature (266)..(266): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctagttggggacagagtcaccatcacttggccgggcgagtgaccganagttaggtactttttggccttggtttcagctaggancctggcaaacgcccctaagtcccctgtacttcttttcgtggtattccctaacttttggaagtagttcgggacgttaccccagtaccgtaacggttcacggtccggcgtaaggttcgggtttaccgtggggtaacctaccgtattttcccaactttccgtaccctaacctacgttacccgaacggtaccctaacgggtccccgtttcggacccgtaaaccgggcccggttaggggtaacggttaaccggtttttaccccgggaccggtttaaacctttttaaccgtttaaaccgtttcccgggtaaacccctttaaaaccgtaaacgttttttaaacgtttttacccgtttttttttttaaaccgtacccggtttttaaaccggttttacgggtttttttaaccggggacccggttaaacgggggggtaaccccttaacgggttaccgggttaaccgggtaaacggtaaacgttaaccggtaaaacggggttaaaccggttcgggtttacgggtccctttacgggtacccgtaacccgttaacgttacccgttacggtttaccctttcgttaacccgttttaccccg

SEQ ID NO: 288775 - DNA, 686 bp, Homo sapiens
  misc_feature: GYAE6OF01DABPL.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggttcagcaggagcctggacaaaacgcccctaagtccctgtattcttttctggtactcctaacttttgaaagtaggtggacgtcccagccaggttcagcggcagtggttctgggacactatttcactctcaccatcagcagcctgcagcctggagtactttcgctacttattactcgaccaaactaatttactttctttttaactccgttacgttacgttttacgggaccgtaacggggtaacctaaggtacgtaggaacgtaagtaaccgtaaaagggtaacgttggttacggtaccgttacgtaaccgtaaccctacgttaccgtttcgttacctttaccgtaacctttcccttacccccggtaccttaccgttaccttacggtaacttaacgttaacttaaccgttacggttaccgttacgggtacgggtccggggtacggttacgggaccggtaaacgggcccggtaacgtaacgg

SEQ ID NO: 288776 - DNA, 559 bp, Homo sapiens
  misc_feature: GYAE6OF01BZGTZ.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagtatttcgcgtacttatactgaccaacaattattctttttatccgttactagttttcggaccgtaggggaccaaggtctaggagatacgaaagtacgtgtggctcgacacctatcttcgtcttctacttccttccccgtcctatccttgaactttacgtacttaacgttgttcgtaggtacggccggggtcgtacgggacgaacgggcgctaagg

SEQ ID NO: 288777 - DNA, 581 bp, Homo sapiens
  misc_feature: GYAE6OF01AS11Y.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagtatttcgcgtacttattactgaccaacaattattcttttttactccgttactagttttggtcgtaggggtacaacgtcgtaggatactacgaaacggtacttggtggtctcgacctaacctaacgttcctacgttctttcgtacttcccgttccccgcctacttctaggtaacttacgttcgtacctcgggtacggcccggggtccgtcgggtacgacgggccgacgagttcggag

SEQ ID NO: 288778 - DNA, 533 bp, Homo sapiens
  misc_feature: GYAE6OF01ASB41.44.75.G09.1.454.CMB.1.raw
  modified_base (485)..(485): a, c, t, g, unknown or other
  misc_feature (485)..(485): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggttttcagcaggagcctggcaaagcccctaagtccctgattcttttctggatccactttgaagagtggagtcccagccaggttcagcggcagtggttctgggacactatttcactctcaccatcagcagcctgcagcctggatatttcgtgtacttattactgccaactattattctttttactccgttactagttttggccaggggacctaagctggagatacgaaaggtactgtcgctgaccacctatcgtcgttcttctacttccttccccgacctntcctagtatacgttatactgttctgagcgggtctggacacggcgctag

SEQ ID NO: 288779 - DNA, 662 bp, Homo sapiens
  misc_feature: GYAE6OF01ED26A.44.75.G09.1.454.CMB.1.raw
  modified_base (260)..(260): a, c, t, g, unknown or other
  misc_feature (260)..(260): n is a, c, g, or t
  modified_base (657)..(657): a, c, t, g, unknown or other
  misc_feature (657)..(657): n is a, c, g, or t
tcagacagtatatacacgaccggtgctcgatttagtatagacatcagggacttagggggctttgccaggctcctgctgctctgtttccccggtgccaggtgtgacatcgagatgacccagtctccgtcctcactgtctgcgtctagttggggacagagtcaccatcacttggccgggcgagtgccgactattaggtacttttttggccttggtttcagcaggagcctggacaaacgcccctaagtccctgattcttttcnggactcctactttgaagagtggacgtcccagccaggttcaggcggcaggtggttcgtgggacactatttcactctcacatcagcacgcctgccacgccgtagggagtattttccggacgttaactttaacttaccgtacgaccctaaaactaaactttacttttaccttttttttaacgtacccgtttaacgtttacggtttttaccgggacccggtaaacgggggaaccctaaagggtccgtagggaacgtactaacgtaaaacgggtacttgggtacggtactggaccacctattccgttcgttccttactacttcccttcccgacctactcctagtacttatacttcgttcggttcgtcggacgggtcgggtccgtagggaccgaacgggccgngtaag

SEQ ID NO: 288780 - DNA, 703 bp, Homo sapiens
  misc_feature: GYAE6OF01CF0KN.44.75.G09.1.454.CMB.1.raw
  modified_base (346)..(346): a, c, t, g, unknown or other
  misc_feature (346)..(346): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggaccaaacgcccctaaagtccctgacttcttttctggtactccactttgaagtaggtggacgtcccagccgtaggttcaggcggctaggtggttcgtagggactacatttccactctcacctntcagcacgtcctgcagtccgtggacgtactttcgaccgtaactttacttaacctcggaaccctaaaactaaactttaatttttacccttttttaactacccgtttaacgttacgggtttttcggaccggtaacggggaacctaaaggtcgttaagggacgtaactaaccggtaaaacgggtaacgttggtacggcgttacggaccttaacccgtattcccgttagttccctttactaacctttcccgtttaccccaccttacgttcttacgttaattacttaacgttacgttcggttcgttacgggtaacgggtccggggttaccgtacgggaccgtaaacgggtccgacgtaaacg

SEQ ID NO: 288781 - DNA, 702 bp, Homo sapiens
  misc_feature: GYAE6OF01BLLYG.44.75.G09.1.454.CMB.1.raw
  modified_base (332)..(332): a, c, t, g, unknown or other
  misc_feature (332)..(332): n is a, c, g, or t
  modified_base (374)..(374): a, c, t, g, unknown or other
  misc_feature (374)..(374): n is a, c, g, or t
tcagacagtatatacacgaccggtgctcgatttagtatagacatcaggggaggaatcagacccagtcaggacacagcatggacatgagagtcctcgctcagctccgtggggctcctgctgctctcgtttcccggtgccaggtgtgacatcgagatcgaccctagtcctccgtcctcactgtctgcgtctagtgggacagacgtcacatctacgttcggccgggcgagtcgccgtaatagtttacggttacgttttttcggtccgttggtttcaggtcgagggacgtccgtacggaccaaaccgtcccctaacgtccctgtactttctttcgngtactcctattagagagtgacgtccagcgtaggtcgaggcgngtaggttcggtcgtacggaactactacgttccacttcctacctacctactaccgacgtacgtaccgtccgtacgaccgtacgtacccggtagggtacgttacgttccggacgttaactttactaccgtactaaccttaaacttaagtttacttttaccgttttaacgtaccggtttaacgttacgggttttaccggaaccggtaacgggtaacccgaggtacggtaggtaagtaaccgtaaacgggtaaacggttaccggtagggttccggtacgtaccgtacctaccgttacttccggttacgtttccttccgtccgtttacccccg

SEQ ID NO: 288782 - DNA, 723 bp, Homo sapiens
  misc_feature: GYAE6OF01C8T2G.44.75.G09.1.454.CMB.1.raw
  modified_base (337)..(337): a, c, t, g, unknown or other
  misc_feature (337)..(337): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgactattaggtacttttttggccttggtttcagcaggagcctggacaaaacgcccctaagtccctgtattcttttctggactcctactttgaagagtggacgtcccagaccaggttcagcggcagtggttcgtagggacacgtatttcaccttcncacctatcacgaccacgtcccgtgccaggcctagggtaacgtattttccggacgttacgttttaacttaccgttacgaacccctaaaacttaaactttacttttactttttttacgtacccgtttaacgttagggtttttcggacccggtaaacgggggtacctaaacgggtccgtagggtaacgtaacgttaaccgtaaaaagggtaccgttaggttacggaccgttacgcctaaccctagttccgttacgtttaccgttacctacctttaccccgtttccccgacccttacgttacctagttaaattacgttaacgttaccgttacgttacgttgggtaacggtccgggtcggttaacgggtacggaacgggccgtaggtaacg

SEQ ID NO: 288783 - DNA, 550 bp, Homo sapiens
  misc_feature: GYAE6OF01BH84G.44.75.G09.1.454.CMB.1.raw
  modified_base (309)..(309): a, c, t, g, unknown or other
  misc_feature (309)..(309): n is a, c, g, or t
  modified_base (511)..(511): a, c, t, g, unknown or other
  misc_feature (511)..(511): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttctggatccactttgaagagtggagtcccaagccaggttcagcggcagtgttctgggacncgatttcactctcaccatcagcagcctgcacgcctggagtactttcgcgtactttattactgaccaactaattactttctttttactaccgttactagttttcgggccgtacgggaccaagcgtaggagactacgaaacggtactggtgctgcacactcgtgtccttcacttcctcccgctactcgtatacttatacttacngtcttacggacggcgggtcgacggacgacggcgtgtacg

SEQ ID NO: 288784 - DNA, 581 bp, Homo sapiens
  misc_feature: GYAE6OF01DIQFU.44.75.G09.1.454.CMB.1.raw
  modified_base (272)..(272): a, c, t, g, unknown or other
  misc_feature (272)..(272): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttgggggcctggtttcagcaggagcctggcaaagcccctaagtccctgatcttttctggactccactttgaagngtggagtcccagccaggttcagcggcaggtggttctgggacacatttcactctcaccatcagcagcctgcagcctggagtatttcgcgtactttattactcgaccaaactaattatttacttttttatcccgttacttacggttttcggaccgtaacggggacctaaagtccgtagggaagtagttaacgaaaaggtactggtcggctcgcaacctattccgttgttcttcctacttcccgttcccgcctattcctagtacttatattacgtgttctaggagtcgggtcgtacggacgtaggcgcgtag

SEQ ID NO: 288785 - DNA, 752 bp, Homo sapiens
  misc_feature: GYAE6OF01C1OJA.44.75.G09.1.454.CMB.1.raw
  modified_base (261)..(261): a, c, t, g, unknown or other
  misc_feature (261)..(261): n is a, c, g, or t
  modified_base (292)..(292): a, c, t, g, unknown or other
  misc_feature (292)..(292): n is a, c, g, or t
  modified_base (746)..(746): a, c, t, g, unknown or other
  misc_feature (746)..(746): n is a, c, g, or t
tcagacagtatatacacgaccggtgctcgatttagtatagacatcagggacttaggggctttgccaggctcctgctgctctgtttccccggtgccaggtgtgacatcgagatgacctagtctccgtcctcactgtctgcgtctagtggggacagagtcaccatcacttggccgggcgagtgccgacattaggtacttttttggccttggtttcagcgaggacgtcctggacaaacgtcccctaagtcctgtacttctttcngactcctactttagaagtgtggactcccganccgtaggtcaggcgcaggttggtctagggactactatttcaacctctaccaccgtactcacggtaccacggtcctgaccgacggtcccgtagggtacgttagtttccggaccggttaactttaacgtttacctaacgtacccaaaacttaacttaactttttacctttttttaaccgaccggttttaacgttacgggtttttaccggaaccgggtaacgggggtaaaccctaaggtccggtaagggtaacgtaacgtaacggtaaaacgggtacttcgggtacggtcgtaacggaccctaaccgtagtttaccgttcggttacccttaccgttaccgtttcccgttacccgtacccttcgtacgttacggtaacttaacgtttaacgtttaccgtcggttacgtacgggtaccgggtaccggttacgggttacgggacggaacgggtacccgtntaacgg

SEQ ID NO: 288786 - DNA, 653 bp, Homo sapiens
  misc_feature: GYAE6OF01DNFDV.44.75.G09.1.454.CMB.1.raw
  modified_base (320)..(320): a, c, t, g, unknown or other
  misc_feature (320)..(320): n is a, c, g, or t
tcagacagtatatacacgaccggtgctcgatttagtatagacatcagggacttaggggctttgccaggctcctgctgctctgtttccccggtgccaggtgtgacatcgagatgacccagtcctccgtcctcactgtctgcgtctagttggggacagagtcaccatcacttgccgggcgagtgccgacattaggtacttttttggccttggtttcagcaggacgcctggacaaacgcccctaagtccctgtacttcttttctggactcctacttttgaaagtaggtggacgtcccagccaggttcagcgctaggtggttcngggacactatttcactctcaccatcagcagcctgcagcctaggagtatttcgcgtacttactactgaccaactaattatttcgtttttactaccgttacttacggttttgggacccgtaaggggtaccaaggtacgtagggtaacgactaacggaaacggtaacgttggtacggtaccgtcggtaccaacctagttccgtttcgttcctttacctactttccccttcccggtaccttaacttcctacggtaactttaattaacgttaacctttggttaccgtagggtaacggtccgggtacgttacggggaccgtaaacgggccgtacgtaag

SEQ ID NO: 288787 - DNA, 580 bp, Homo sapiens
  misc_feature: GYAE6OF01B687M.44.75.G09.1.454.CMB.1.raw
  modified_base (365)..(365): a, c, t, g, unknown or other
  misc_feature (365)..(365): n is a, c, g, or t
  modified_base (573)..(573): a, c, t, g, unknown or other
  misc_feature (573)..(573): n is a, c, g, or t
tcagacagtatatacacgaccggtgctcgatttagtatagacatcagggacttagggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgacttctttctggactcctactttggaagtagtggacgtcccagccgtaggttcaggcggctaggtggttcgtgggacactattcactctcaccatcagcacgcctgcagcctggagtnttcgctacttatactcgactaactagtataagtattacttctagtagttacggtttggaccggaagggaaccaggtcgtaggagtactaaccgaacgtacgtgtacgtcgtcgtaccgactacgttcttcgttcttactaccttcccgtacccgactatcgtagtaactattacgtcgtgtacgtaggtacgggcgtacgtcggacgnggtaccg

SEQ ID NO: 288788 - DNA, 616 bp, Homo sapiens
  misc_feature: GYAE6OF01A6V5N.44.75.G09.1.454.CMB.1.raw
  modified_base (257)..(257): a, c, t, g, unknown or other
  misc_feature (257)..(257): n is a, c, g, or t
  modified_base (383)..(383): a, c, t, g, unknown or other
  misc_feature (383)..(383): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgacattaggtacttttttggcctggtttcagcaggagcctggacaaacgcccctaagtccctgacttcttttcnggtactccatttgaagtagtggacgtcccagccaggttcagcggctaggtggttcgtgggaccacgtatttccactctcaccatcagcagcctgcacgctggatagtttcgacgttacttattacncgacctaactaagttactttactttttacgtaccgttacgttagttttacggaccgtaacgggaacctaagtcgtaggagtacgtaacgaaaggtacgtggtacgtcgtacgactacctagttcgtcgttctttacgtacttcccgttacccgccttacgtcgttacgtaacttagtacttacgttcggtcgttggaacggtccggtcgtacggacgacggtcgtcggtaacg

SEQ ID NO: 288789 - DNA, 550 bp, Homo sapiens
  misc_feature: GYAE6OF01DPF0Y.44.75.G09.1.454.CMB.1.raw
  modified_base (308)..(308): a, c, t, g, unknown or other
  misc_feature (308)..(308): n is a, c, g, or t
  modified_base (544)..(544): a, c, t, g, unknown or other
  misc_feature (544)..(544): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaacgcccctaagtccctgattcttttctggatcctactttgaagagtggacgtcccagccaggttcagcggctagtggttcngggacactatttcactctcaccatcagcagcctgcagcctggatatttcgcgtactttatactgaccctaaataatttatttctttttacgtaccgttacttaggttttcggaccgtagggtaccaagtcgtaggaagatacgaaaggtactggtcgctgcactatctgtcttacacttccttccgctactctagtattatactacttgtctggaggcgggtctacggacaacggngactag

SEQ ID NO: 288790 - DNA, 579 bp, Homo sapiens
  misc_feature: GYAE6OF01BKUQ4.44.75.G09.1.454.CMB.1.raw
  modified_base (256)..(256): a, c, t, g, unknown or other
  misc_feature (256)..(256): n is a, c, g, or t
  modified_base (575)..(575): a, c, t, g, unknown or other
  misc_feature (575)..(575): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgattcttttcnggatccactttgaagagtggagtcccagccaggttcagcggcagtggttctgggacactatttcactctcacatcagcagcctgcagcctgggagtatttcgacgtactttattacctcgtaccaaactaattactttacttttttactccgtttacttacggttttcggacccgtaacgggggtaaccaaggtccgtagggaagtaacgttacgaaaaggtactggtcggtcgtcgacaccattccgtgtccttcacttccttcccctatctctattatatacttgtcgtggacgcgggtcgtcggacgaggcgacgntacg

SEQ ID NO: 288791 - DNA, 507 bp, Homo sapiens
  misc_feature: GYAE6OF01A9J7F.44.75.G09.1.454.CMB.1.raw
  modified_base (442)..(442): a, c, t, g, unknown or other
  misc_feature (442)..(442): n is a, c, g, or t
  modified_base (445)..(445): a, c, t, g, unknown or other
  misc_feature (445)..(445): n is a, c, g, or t
  modified_base (460)..(460): a, c, t, g, unknown or other
  misc_feature (460)..(460): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
  modified_base (488)..(488): a, c, t, g, unknown or other
  misc_feature (488)..(488): n is a, c, g, or t
  modified_base (505)..(505): a, c, t, g, unknown or other
  misc_feature (505)..(505): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagccctgcagcctggactagtttcgcgtactttactactcgaccaaacaattacttctttttatccgttatagtttcggacagggtaccaagcgtggagatacgaaagactgngcngcacatctgtcttcntcctccncntntgtatatatatgtctgngcggtctggagaggcgnag

SEQ ID NO: 288792 - DNA, 698 bp, Homo sapiens
  misc_feature: GYAE6OF01DIONC.44.75.G09.1.454.CMB.1.raw
  modified_base (250)..(250): a, c, t, g, unknown or other
  misc_feature (250)..(250): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggttcagcaggagcctggcaaagcccctaagtccctgatcttttcnggatccactttgaagagtggactcccagccaggttcagcggcagtggttctgggacacatttcactctcaccatcagcagcctgcagcctaggagtatttcgacgtactttactacgttcgacctaaactaattacttttcttttttaacgttacccgttaacgttaaggttttttcggacccgtaacgggggtaacccgtaaaacggtccgttaggggtaacggtaactttaaccggaaaaacggggtaaacgttcggggtttacggggaacccgttcgggacctaaccccgttacgtttaccgtttacgtttcccgtttacttacccgtttccctttacccccggtacctaccgttaccttaggtaattacttaactttaccgttcggttacctgggtacgggtcccggggtacggttcgggtaccgaaaggggtccgcgtaaagg

SEQ ID NO: 288793 - DNA, 688 bp, Homo sapiens
  misc_feature: GYAE6OF01BXC4Y.44.75.G09.1.454.CMB.1.raw
  modified_base (335)..(335): a, c, t, g, unknown or other
  misc_feature (335)..(335): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgactattaggtacttttttggccttggtttcagcaggagcctggcaaacgcccctaagtcccctgattcttttctggactccactttgaagtagtggacgtcccagccaggttcaggcggcagttggtctgggacactatttcactctcaccntcagcagccctgcacgccgtaggacgtattttccggacgtactttatttacctgaccctaaactaatttactttacttttttaacgtaccgttacgttacggttttcggaccggtacggggaacctaaggcgtagggagtacgtaaccgaaacggtaactcggtacggtcctcggaccgtaaccgtaacgttccgttacggtttccctttacttaaccttcccgttaccccgtacccgttaacgttccgttacgtaaacttaacgttacgtttaacccgttcggttacgttacgggtaacgggtccggggtaccggtttacgggaccggtaaacgggtccggaccgtaaacgg

SEQ ID NO: 288794 - DNA, 776 bp, Homo sapiens
  misc_feature: GYAE6OF01CYMFV.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgacagttaggtacttttttggccttggtttcagcaggacgcctggacaaacgcccctaagtccctgtattcttttcgtggtacttcctaacgttttggaaacgtagtacggtacgtacccgaggccgtaggttaccacggccggtacgaggttcgggtttcgtagggacctaacgttatttccaccttctaccacctaactcgaacgcgtaacgccctaggaccacggtacccgttagggaacgttacgttttacccgaccgttaaccgttttaatttacccgtacgtaaacccctaaaaacttaaacttttactttttaacccgttttttttaacgtaaccccgttttaacgtttaacgggttttttacgggacccggttaaacggggtaacccgtaacggtacggtacggtaacgtaacgtaaaccggtaaaacggtaacgttggtacgtacgtacgtacctaactacttccgtttacgttaccttactaccgtttcccgttaccccgacttacgtccgtagttaacttaacgtacttacttcggttcgtacggtacgggcggttcgacgggtacgacggcgacgtaacgg

SEQ ID NO: 288795 - DNA, 631 bp, Homo sapiens
  misc_feature: GYAE6OF01A2C0E.44.75.G09.1.454.CMB.1.raw
  modified_base (485)..(485): a, c, t, g, unknown or other
  misc_feature (485)..(485): n is a, c, g, or t
  modified_base (525)..(525): a, c, t, g, unknown or other
  misc_feature (525)..(525): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggacgcctggacaaacgcccctaagtccctgtattcttttctggacttcctacttttggaagtaggtggacgtccccagtccgaggttcacggcgggctaggttgggtttcgtgggaccactatttccactctcaccatcagcagcctgacacgcctggagtatttcgacgtactttaattacctcgaccaaactattacttttccttttttactaccgttacgttaggttttcggacccggtaaggggaacctaaggtcgtagggtaanacgttaacgaaacggtacgtggtacgggctcgaccacctntccgttcgttccttcctacttcccgttccccactacgtctagtattacgtacttaccgtgttaccgtggtacggtccgggtctagggaccgaaaggtcgtacgaag

SEQ ID NO: 288796 - DNA, 540 bp, Homo sapiens
  misc_feature: GYAE6OF01CWEAV.44.75.G09.1.454.CMB.1.raw
  modified_base (304)..(304): a, c, t, g, unknown or other
  misc_feature (304)..(304): n is a, c, g, or t
  modified_base (312)..(312): a, c, t, g, unknown or other
  misc_feature (312)..(312): n is a, c, g, or t
  modified_base (477)..(477): a, c, t, g, unknown or other
  misc_feature (477)..(477): n is a, c, g, or t
  modified_base (483)..(483): a, c, t, g, unknown or other
  misc_feature (483)..(483): n is a, c, g, or t
  modified_base (494)..(494): a, c, t, g, unknown or other
  misc_feature (494)..(494): n is a, c, g, or t
  modified_base (511)..(511): a, c, t, g, unknown or other
  misc_feature (511)..(511): n is a, c, g, or t
  modified_base (534)..(534): a, c, t, g, unknown or other
  misc_feature (534)..(534): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattgggggcagagtcaccatcacttgccgggcgagtgccgacattaggacttttttggtctggtttcagcaggagcctggcaaagccccctaagtccctgattcttttctggatccactttgaagagtggagtcccagccaggttcagcggcagtggttcngggacacntttcactctcaccatcagcagcctgcagcctggagtactttcgcgtactttattactcgaccaaataacttactttccttttttacgtcccgttacgtaggttttcggaccgtaggggaacctaaggcgtcggagagtacgaaagacgtgtcgctcgcacatctntcttcnctcctccgccntctgatatactatcgtntggacgcggtcgtcggacacggngcgtag

SEQ ID NO: 288797 - DNA, 637 bp, Homo sapiens
  misc_feature: GYAE6OF01ENKEY.44.75.G09.1.454.CMB.1.raw
  modified_base (311)..(311): a, c, t, g, unknown or other
  misc_feature (311)..(311): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggacaaacgcccctaagtccctgattcttttctggactccactttgaagagtggagtcccagcctaggttcagcggctaggttggttcnggggacactatttcacctctacacatcagccagtccctgcagccgtggacgtacgttttcgacgtactttattacctgaccaaactaattactttacttttttactaccgttactaggttttcgggacccgtaacggggtaaccaaggtccgttagggaagtaacgtacgaaaaggtacgttggtggtcctagaccgaacctacgttctacgttccttacctaccgttcccttccccgacctacttccgtacgtaattacgtacttaaccgttgtcgttacggacggtccggggtacgtacgggacgtaacgggccgtacgtaacg

SEQ ID NO: 288798 - DNA, 570 bp, Homo sapiens
  misc_feature: GYAE6OF01D8NBA.44.75.G09.1.454.CMB.1.raw
  modified_base (255)..(255): a, c, t, g, unknown or other
  misc_feature (255)..(255): n is a, c, g, or t
  modified_base (306)..(306): a, c, t, g, unknown or other
  misc_feature (306)..(306): n is a, c, g, or t
  modified_base (332)..(332): a, c, t, g, unknown or other
  misc_feature (332)..(332): n is a, c, g, or t
  modified_base (565)..(565): a, c, t, g, unknown or other
  misc_feature (565)..(565): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaacgcccctaagtccctgattcttttcnggatccactttgaagagtggagtcccagccaggttcagcggcagtggttcngggacacatttcactctcaccatcancagcctgcagcctggagtatttcgacgtacttattactcgacctaaactaattactttcttttttaactccgttaacttaggttttcggaccgtaacggggaaccaaggtcgtaggtagtaagttacgaaaggtactggtacggctgcacctactctcgttcttctacttccttcccgcctactctagtattatactagttgtctaggacggcgggtcgtggacgacgggcgngtacg

SEQ ID NO: 288799 - DNA, 583 bp, Homo sapiens
  misc_feature: GYAE6OF01EEVDK.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctagttggggacagagtcaccatcacttgccgggcgagtcgccgacagttaggtacttttttggccttggttcagcaggagcctggcaaagcccctaagtcccctgtacttctttcgtggtactcctactttgaagtagtggacgtccagtccgaggttcagcggctaggtcggtcgtgggactacgtactttcactctcacctatcgagcagtcctgcacgccgtggactagtttcgacgtacttatctagaccctaataatttactttacttttttacgacccgtttacgtagggttttaccggaccggtaacggggtacctaaggtcgtaggaacgtagtaccggaaaggtacttggtggctcgaccaacctattccttaggtcttcgtcttccccg

SEQ ID NO: 288800 - DNA, 549 bp, Homo sapiens
  misc_feature: GYAE6OF01EVEL0.44.75.G09.1.454.CMB.1.raw
  modified_base (543)..(543): a, c, t, g, unknown or other
  misc_feature (543)..(543): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagccctgcagcctggagtatttcgcgtactttattacctgaccaactaaattactttctttttttactcccgttaactacggttttggcccgtaaggggtaacccaaggtctagggacgattacgaaaggtaactgtggctgaccacctatctgttcttcacttcctcccgccatctagatatactactgtctgagcgggtctcggacgacggngcgtag

SEQ ID NO: 288801 - DNA, 667 bp, Homo sapiens
  misc_feature: GYAE6OF01DH0Z5.44.75.G09.1.454.CMB.1.raw
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (378)..(378): a, c, t, g, unknown or other
  misc_feature (378)..(378): n is a, c, g, or t
  modified_base (660)..(660): a, c, t, g, unknown or other
  misc_feature (660)..(660): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagtggggacagagtcaccatcacttgccgggcgagtgccgactattaggtacttttttggccttggtttcagcgaggagccgtggacaaaacgcccctaagtccctagtattcttttcgtggactcctactttgaagaggtggactccagccaggttcagcggcagtggttcgtgggacacatttcactcncacatcancacgctgcngctggatntttcgcgtaacttattacncgtaaccaaataatttacttttacctttttaactcccgtttaacgttaggttttacggacccggtaaggggtaaccctaaggtcgtagggaagtacgtaacggaaaaggtaccgttggtggccttacggacctaaccctagttaccgtttcgttacctttaccgtacctttcccgtttacccccgaccgttacttaccgttacgtaaacgtttaactttaaaccgttaccgttaggttcccggttagggtacggtcgggtcggttacggaacgaacgggtcncggtaag

SEQ ID NO: 288802 - DNA, 581 bp, Homo sapiens
  misc_feature: GYAE6OF01D1JQB.44.75.G09.1.454.CMB.1.raw
  modified_base (256)..(256): a, c, t, g, unknown or other
  misc_feature (256)..(256): n is a, c, g, or t
  modified_base (298)..(298): a, c, t, g, unknown or other
  misc_feature (298)..(298): n is a, c, g, or t
  modified_base (306)..(306): a, c, t, g, unknown or other
  misc_feature (306)..(306): n is a, c, g, or t
  modified_base (575)..(575): a, c, t, g, unknown or other
  misc_feature (575)..(575): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgacattaggtacttttttggccttggtttcagcaggagcctggcaaacgcccctaagtccctgattcttttcnggatccactttgaagagtggagtcccagccaggttcagcggnagtggtcngggacacatttcactctcaccatcagcagcctgcagcctggagtatttcgacgtactttactactcgacctaaactaattattttctttttactacccgttacttacggttttcggaccgtagggtaacctaaggtcgtaggagtataacgaaaggtacttggtcgactcgaccaactcttcgtcgtcttcacttccttcccgctactacgtgtattacgtacttacgttcgtcgtacggacggccgggtactacgggagaacgggcgngtaacg

SEQ ID NO: 288803 - DNA, 549 bp, Homo sapiens
  misc_feature: GYAE6OF01DJCP9.44.75.G09.1.454.CMB.1.raw
  modified_base (367)..(367): a, c, t, g, unknown or other
  misc_feature (367)..(367): n is a, c, g, or t
  modified_base (532)..(532): a, c, t, g, unknown or other
  misc_feature (532)..(532): n is a, c, g, or t
  modified_base (539)..(539): a, c, t, g, unknown or other
  misc_feature (539)..(539): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggaccaaagccccctaagtccctgacttcttttcgtggactcctacttttggaaagtggtaggacgtcccagcctaggttccaggcggctaggtggtctgggaccactatttcactctcaccatcagcagcctgcagcctgganatttcgcgtacttattactgccaactagtaataagtattattctactagtagtttcggccgagggaccagcgtaggagatacaacggtactgtgctgcactatctgttcttcacttcttcccgctactctagtattaatattactgtctacggtacggacgggtntacgggngtacgggacg

SEQ ID NO: 288804 - DNA, 611 bp, Homo sapiens
  misc_feature: GYAE6OF01EK653.44.75.G09.1.454.CMB.1.raw
  modified_base (309)..(309): a, c, t, g, unknown or other
  misc_feature (309)..(309): n is a, c, g, or t
  modified_base (365)..(365): a, c, t, g, unknown or other
  misc_feature (365)..(365): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaagcccctaagtccctgatcttttctggatccactttgaagagtggagtcccagccaggttcagcgcagtgtctgggacacntttcactctcacatcagcagcctgcagcctggacgtatttcgacgtacttattacngaccaataattacttcttttttactccgttactagtttcggaccgtaacgggtaccaaggtcgtaggagtaacgtacgtaaaagggtaacttggtggcgtcgacaaccgtatccgttacgttccttactacttcccttaccccgtacctacttcgtagtaatttaacttacgttaacgttgttaccgttcggtaacgggtccggggtacgttacggggaaccggtaacgggtccgtacgtaacggg

SEQ ID NO: 288805 - DNA, 774 bp, Homo sapiens
  misc_feature: GYAE6OF01ES48I.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttggccgggcgagtgccgacattaggtacttttttggccttggtttcagcaggagccgtggacaaacgcccctaagtccctgtattcttttcgtggtactcctactttaggaagtagtgggactcccagcctaggttcaggcggctaggttggttcgtcggggaactaccgtattttccaccttcctacaaccctatacagcacgcctgaccaggtcctgggaacgtacgtttcgaccgtaacttttaagttacctacgaaccctaaactaattactttttacttttttaacgttacccgtttaacggttaacggtttttcgggacccgggtaacggggtaaacccgtaaggtaccggttaggtaacgtaacgttaaaccgggtaaaacgggtaacgttacgggtacggtaccgtacggtaaccctaacccgttacgttaccgtttacgttaccgtttaaccttaacgtttccccgttaccccggtaccctaacgtttccttaggtaaactttaaccgtttaacttaaccgtttcggttaccggttacgggtacggggtaccggggtaccgttacggggaaccgtaacggggtcccgtcgttaaacgg

SEQ ID NO: 288806 - DNA, 707 bp, Homo sapiens
  misc_feature: GYAE6OF01DLRDT.44.75.G09.1.454.CMB.1.raw
  modified_base (259)..(259): a, c, t, g, unknown or other
  misc_feature (259)..(259): n is a, c, g, or t
  modified_base (700)..(700): a, c, t, g, unknown or other
  misc_feature (700)..(700): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttccagcaggagcctggacaaacgcccctaaagtccctgtattcttttcgnggactccgtacgttttgaaaggtaggtcggacgtcccaggtcctaggttcaggcgcgtaggttggttcgtgggacacgtatttccactcctcaaccactacacgacacgcctacgccgtacgtccgtacgggtagtacgtttacgtaccgtaactttacttacgtcgaaccctaaattaacgtttacttttactttttaaccgttaccgtttaacgttaacgggttttcggtaacccggtagggtaacccgtaaggtacgtagggacgtaactaacggaaacgtacgttaggtggtaccttcgactaaccgtacgttacttcgttaccttactacccgttctacccccgtacttacctcgttacgtaacttacgttaaacttacgttgttcggtacgggtaacgggttccggtacggtacgggaccggtaacgggtaccgngttaacg

SEQ ID NO: 288807 - DNA, 588 bp, Homo sapiens
  misc_feature: GYAE6OF01D5LNC.44.75.G09.1.454.CMB.1.raw
  modified_base (226)..(226): a, c, t, g, unknown or other
  misc_feature (226)..(226): n is a, c, g, or t
  modified_base (296)..(296): a, c, t, g, unknown or other
  misc_feature (296)..(296): n is a, c, g, or t
  modified_base (395)..(395): a, c, t, g, unknown or other
  misc_feature (395)..(395): n is a, c, g, or t
  modified_base (418)..(418): a, c, t, g, unknown or other
  misc_feature (418)..(418): n is a, c, g, or t
  modified_base (580)..(580): a, c, t, g, unknown or other
  misc_feature (580)..(580): n is a, c, g, or t
  modified_base (585)..(586): a, c, t, g, unknown or other
  misc_feature (585)..(586): n is a, c, g, or t
  modified_base (588)..(588): a, c, t, g, unknown or other
  misc_feature (588)..(588): n is a, c, g, or t
tcagacagtatatacacgaccggtgctcgatttagtatagacatcagggacttaggggctttgccaggctcctgctgctctggctcccaggttcgagatgtgacatcgagatgaccaagtctccttccttcctgtcttcttctgttggaggcagcgtcaccatcacttgccgggcgagtcaggtcgttttcggtgctgttgccttggtttcaacgaaaaagggggngacggtcccctaaggtcctcgtctctcgtagaaaccagactggaaaggtgagtcccgtccaggttcagtnccagtccgaggtggtgggccggagtccactctcaccattacggcgaccctggcggcctaggaagtacttctgactaaactttatttctgtcagcaagtntcagttacgtcgtcccccgtttntacgttttcggcccgtaaggggaccaaggtcgtagggaaactacgaaaccgtaacgtggtcgcgtgcctaacctacttctcgttcttcgtaactttcccgttcccgcctaactcgtgtacttatacttactgtcgtggaggcgggtcgtcggcgaacggcanagtgnngn

SEQ ID NO: 288808 - DNA, 685 bp, Homo sapiens
  misc_feature: GYAE6OF01EQFK9.44.75.G09.1.454.CMB.1.raw
  modified_base (679)..(679): a, c, t, g, unknown or other
  misc_feature (679)..(679): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttggccgggcgagtcgccgacattaggtacttttttggccttggtttcagcaggacgccgtggacaaacgcccctaagtccctgtattctttcgtcgtactaccgtactttaggaacgtaggttcggactcccgaagtccgtaaggttaccgaacggtccggaccgttaaggttcgggtttccggtacggggaacctaccgttacgttttccaaccttcttaccaaccctactacgacgcacggtcctcgactacgcgtaggacgtatttccggactatttacgtactcgtaacctaaactatttacgtttacctttttactaccgttacgtttacggtttccggaccgacgggtaacctaagtcgtaggtactacgtacgtaaagtacgtgtcggtacgtacgtacctacctattcgtacttcttacctcttaccttccgaccctattacctagttattagttactcgttagtcgtacgggacgtccgggtcgtaggaaccgtcggtacgntaacgg

SEQ ID NO: 288809 - DNA, 685 bp, Homo sapiens
  misc_feature: GYAE6OF01E25XG.44.75.G09.1.454.CMB.1.raw
  modified_base (253)..(253): a, c, t, g, unknown or other
  misc_feature (253)..(253): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtactttttggccttggttcagcaggagcctggcaaacgccctaagtccctgtattctttcgngatcctacttagaagagtggagtcccagcgaggttcagcggcagtggttcgtgggacacgtatttcactctcacatacagtagcctgcacgtcctagggtacgtattttccggacgtaactttaacttactacggaacctaaaactaatttaattttaccttttttaaccttacccgttaactttacgggttttacggacccggtaagggggtaacccctaaaggtcgtaaggtaagaacgttaacggtaaaacgggtaaacgtggttacggcttacggacctaacgtaactttccgtaacgtttctttaccgtaactttcccgttaccccgtccgtaacttcgtacgtaattaacttaacgttaacgttcgttacgttacgggacgggttaccgggacggttcgggaacggaagggtacgccgtaaagtag

SEQ ID NO: 288810 - DNA, 710 bp, Homo sapiens
  misc_feature: GYAE6OF01DR46A.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgacattaggtacttttttggccttggtttcagcgaggagcctggacaaacgcccctaagtcccctgtacttcttttcgtggacttcctacttttaggaaagtaggtcggacgtccccaggtccagggttccaggccggcaggttggtttcgtggggactacgtatttccacttcctcacctatcagcacgcctgcagccgtaggacgtacgtttcgacgtactttactactcgaccaaactattactttactttttacgtaccgttacgttacggttttcggaccggtaacggggtacctaaggtacgtagggtaacgtaagttaaccggtaaaacgggtaacgttgggtcggtcgttcgtaccgtaacctagtttccgttacggtttaccttaccttaaccgtttccccgtaccccgttacctacgttccgtacggttaatttaacgttaactttaccggtgttccgttaacgggtacgggtccggggttaccgtacgggaccgtaacgggtccgtaacgtaacgg

SEQ ID NO: 288811 - DNA, 723 bp, Homo sapiens
  misc_feature: GYAE6OF01DG3EC.44.75.G09.1.454.CMB.1.raw
  modified_base (259)..(259): a, c, t, g, unknown or other
  misc_feature (259)..(259): n is a, c, g, or t
  modified_base (313)..(313): a, c, t, g, unknown or other
  misc_feature (313)..(313): n is a, c, g, or t
  modified_base (321)..(321): a, c, t, g, unknown or other
  misc_feature (321)..(321): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgacattaggtacttttttggccttggtttcagcaggagccgtggacaaacgcccctaagtccctgtacttctttcnggactcctactttgaagagtggacgtcccagccaggttcagcggcagtggttcngggacatntttcactctcaccatcagcagcctagcacgccgtggacgtacgtttcgcgtaactttattacctacgaccctaaataatttacgttttaccttttttaacttacccgttaacgtttagggtttttacggaccccgggtaagggggtaaccctaaaggtccgttaggggaacgtaacgttaaccggaaaaagggtaaccgttgggttacggggaccttacgggaacctaacccgtaagtttcccgtttaggtttaccctttaccttaaccgtttccccgtttacccccggtacccgttaactttcccgttaggttaactttaattaaccgttaacgtttcggttccgtagggtacgggtccggggtacggttacgggaccgtaaacgggccgtacgttaacgg

SEQ ID NO: 288812 - DNA, 648 bp, Homo sapiens
  misc_feature: GYAE6OF01CFEO7.44.75.G09.1.454.CMB.1.raw
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (317)..(317): a, c, t, g, unknown or other
  misc_feature (317)..(317): n is a, c, g, or t
  modified_base (344)..(344): a, c, t, g, unknown or other
  misc_feature (344)..(344): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgactagttaggtccttttttggccttgggtttcagacagggacgcctggacaaaacgcccctaaagtccctntacttcttttcnggactctactttgaagagtgagtcccagtccaggtcagcgcgagtggtcngggacacattcactctcacatcagcancctgcacgcgtgagtatttcgcgtacttagtactacgacctaaactaaatttactttacttttttaacgtacccgtttaacgttagttttaccggtaccgaacgggggtaacctaaacggtccgtagggaacgtaactaaccgtaaaacgtaacgtcggtaggacgttacgaaccacctaattccgtacggttcttacttaccgttacccgttcccggactcttacgttacaattaacttacgttacgttcgttactacgggtacggaccgggttcgacgggtacgaacgggtccgtagtaacg

SEQ ID NO: 288813 - DNA, 764 bp, Homo sapiens
  misc_feature: GYAE6OF01DCEGS.44.75.G09.1.454.CMB.1.raw
  modified_base (347)..(347): a, c, t, g, unknown or other
  misc_feature (347)..(347): n is a, c, g, or t
tcagacagtatatacacgaccggtgctcgatttagtatagacatcagggacttaggggctttgccaggctcctgctgctctgtttccccggtgccaggtgtgacatcgagatgacccagtcctccgtcctcactgtctgcgtctagttggggacagagtcaccatcacttgccgggcgagtcgccgactagttaggtacttttttggccttggtttcagcaggcgcctggacaaacgcccctaagtccctgtacttctttcgtggacttacctactttggaagtaggttcggaacgtccccgaaggtcctagggttccgaacggcgggacgtaggtttgggtttcgnggggaacctacctaagtttccaacttcctaccgaaccacttcgaacgacgacgtcctgaccgacgtccgtaggacgttacgtttaccggacttaactttaacttaccgacgtaaccctaaactttaaactttacttttttaaccgttttaccgttacccgttagtttaccgggttttacgggaaccgggttaaaccgggtaaccgtaaggttccgggtaaggtaaaccgttagtaaaccggtaaaggttaccgttgggtacgtacgtaccgaccgtaaccgttacttccgtttcgttaccttacgtacctttcccgtacccgtaacttacttcgtaacgttataacgttacgtttacgtacgttcggtaaccggcgggttaccggtacggttaggacggtaaccgcggttaagtacg

SEQ ID NO: 288814 - DNA, 884 bp, Homo sapiens
  misc_feature: GYAE6OF01DOO38.44.75.G09.1.454.CMB.1.raw
  modified_base (876)..(876): a, c, t, g, unknown or other
  misc_feature (876)..(876): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacgttggccgggcgagtcgccgacagtttaggtacttttttggccttggtttcagcaggagcctggaccaaacgtccccttaagtccctgtactttccttttcgacgggtacttcccgtaacgttttaggaaacggtacggttacgggacgttcccccgaacggtacccgtaagggttttccaacggggccgggtaccgttaagggttttcggggttttaccggtaacgggggtaacctaaccgttaacttttttcccgaaccttttcctacccgaaaccctaacgttccgaacggacccgtaaccggtcccgttacggcccgtaaacgggtcccggtttaggggtaaactttaaccggtttttcccggaacccggtttaaacctttttaacgtttaaccggttaccgtaaacccccttaaaatttaaacgttttaacttttttaccgtttttttaaccgttacccgtttaacggtttacgggttttaccggacccggttaacggggaacctaacggtcgtagggtaacgtaacgtaacgtaaaggtaccgttgggtacgtcgtacgacgtaaccgtacgttctcgtttaccttctaccgttacccgtttcccaccgttacttaccgtacgttaattacgttaacgtttaccgttacggttcgtacggtaccgggtaccggggttccgtacgggaaccgtacggggtaccncgtaaagg

SEQ ID NO: 288815 - DNA, 515 bp, Homo sapiens
  misc_feature: GYAE6OF01AOGZV.44.75.G09.1.454.CMB.1.raw
  modified_base (471)..(471): a, c, t, g, unknown or other
  misc_feature (471)..(471): n is a, c, g, or t
  modified_base (512)..(512): a, c, t, g, unknown or other
  misc_feature (512)..(512): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagtatttcgcgtactttattactgccaactaatattctttttactccgttactagttttggccgtagggaccaagctaggagatacaaaggtactgtcgctgcacctatctgtcttcacttcctcccnctatctgtatatactatgtctgagcggtctggacgaggcgntag

SEQ ID NO: 288816 - DNA, 503 bp, Homo sapiens
  misc_feature: GYAE6OF01E3GXO.44.75.G09.1.454.CMB.1.raw
  modified_base (472)..(472): a, c, t, g, unknown or other
  misc_feature (472)..(472): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctgggagatttcgcgtacttattactgccaaacaattacttcttttttatccgttactagttttggccaggggaccaagtctggagatcaaaggactgtggctgcacatctgtcttcatcctcccgctatctnatatatatgtcngngcggctggcaggngnag

SEQ ID NO: 288817 - DNA, 550 bp, Homo sapiens
  misc_feature: GYAE6OF01C69AC.44.75.G09.1.454.CMB.1.raw
  modified_base (215)..(215): a, c, t, g, unknown or other
  misc_feature (215)..(215): n is a, c, g, or t
tcagacagtatatacacgaccggtgctcgatttagtatagacatcagggacttaggggctttgccaggctcctgctgctctgtttcccggtgccaggtgtgacatcgagatgacccagtctccgtcctcactgtctgcgtctattgggacagagtcaccatcacttgccgggcgagtgccgacattaggacttttttggcctggtttcagcaggngcctggcaaagcccctaagtccctgattctttctggatccaactttgaagagtggagtcccagccaggttcagcggcagtggttctgggacacgatttcactctcacatcagcagcctgcagcctggagtactttcgcgtactttactactcgaccaactaattatttctttttactaccgttactagttttcggaccgtagggtaccgaagtcgtaggagatacgaaaggacgtggtgctgcaacattctagtcttcacttccttcccgactactactgtatagtacttactgttctacggtcgcgggtctagggaccgaacggcgtcgtaacg

SEQ ID NO: 288818 - DNA, 728 bp, Homo sapiens
  misc_feature: GYAE6OF01D2461.44.75.G09.1.454.CMB.1.raw
  modified_base (180)..(180): a, c, t, g, unknown or other
  misc_feature (180)..(180): n is a, c, g, or t
tcagacagtatatacacgaccggtgctcgatttagtatagacatcagggacttaggggctttgccaggctcctgctgctctgtttccccggtgccaggtgtgacatcgagatcgacccagtcctccgtcctcactgtctgcgtctagttggggacagagtccaccatcacttggccgggngagtgccgactattaggtacttttttggccttggttcagcgaggacgtccgtggacaaaccgtcccctaacgtccctgtacttcttttcgtaggtacttacctacttaggggggggggggaataggtcggacgtcccacggccgtaggttcgaggcggacgttagggttgggttccgtacgggaacctacgtactttaccgtaccttcctacctaacctacgtacacgtaccacgtcctggaccgacggtccgtaggtacgttacgtttacgtaccgttactttacttacctacgaacctaaattaactttaacttttactttttaccttaccgttacgttaggtttccgggacggtaacgggtaaccgaagtacgtacggtaagtaacgtaacgaaacggtacgttggtcggtacctacgaccaacctacgttccgttacgttccttaccgtaccttacccgttcccgtactacttcgtagtaattaacgttacttagttcgtacgtacgggtacggtccggtcggtacggacggacgtcgacgtag

SEQ ID NO: 288819 - DNA, 674 bp, Homo sapiens
  misc_feature: GYAE6OF01BXGYU.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctatggggacagagtcaccatcacttgccgggcgagtgccgacattaggtacttttttggcctggtttcagcaggagcctggacaaacgcccctaagtccctgtattcttttctggactcctactttgaagtagtggacgtccagccaggttcaggcggctagtcggttcgtgggactactatttcactctacaccatcagcagcctgcagcctggagtactttcgacgtactttattactgtacttaaactaatttactttactttttacgtccgttacgttacggttttcggacccggtaaggggtaacctaaggtcgtagggtaacgtaacgtaacgtaaaacgggttactttcggacttacgtacctaccgtaacgttccgttcggttaccttaccgtacctttcccttaccccggtacctaacgttccttagttaacttaacgtttaacgttaccgttagttccggttacgggtaccggttaccggggccgttacgggaccggtaacgggtccgtaacgtagtaacgg

SEQ ID NO: 288820 - DNA, 659 bp, Homo sapiens
  misc_feature: GYAE6OF01EYZR9.44.75.G09.1.454.CMB.1.raw
  modified_base (386)..(386): a, c, t, g, unknown or other
  misc_feature (386)..(386): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtactttttttggccttggtttcagcaggagcctggacaaacgccccctaagtcccctgtattcttttctggactcctactttgaagagtggacgtcccagccaggttcaggcggctaggtggttctggggacacgtatttcactctcaccatcagcagcctgcagcctggagtactttcgcgtacttacttaccncgtaccaaataattacttttcttttttaactaccgttaacttacggttttcggaccgtaacggggtaacccaaggtcgtagggagtacgtaaccgtaaaggtaacgttggtacggtactcgactaaccgtacttccgttgttccttacgtaccttcccgttacccgacccttacgtaccgttacgtaactttacgttaacgttaacttcggttccgtagggtaccgggtccggggtaccggttcgggaccgtaacgggtcccgtacgtaacgg

SEQ ID NO: 288821 - DNA, 825 bp, Homo sapiens
  misc_feature: GYAE6OF01EIV6N.44.75.G09.1.454.CMB.1.raw
tcagacagtatatacacgaccggtgctcgatttagtatagacatcagggacttaggggctttgccgggctcctgctgctctgtttccccggtgccaggtgtgacatcgagatgacccagtctccgtcctcactgtctgcgtctagttggggacagagtcaccatcacgttgccgggcgagtcgaccgactagttaggtactttttcggccttggtttcagcaggacgcctaggaccaaacgtccccgttaacgtccctagtacttcttttcgtaggtacttaccgtacgttttaggaaggtaggtacgggtacgttacccgacggtacccgtagggttacgacggtccgggtacgtacgggttcgggtttaccgtacggggacctacgttactttaccaccgttcctaccgtaacctactaccaacgccgtaacgtcccgtggacctacggtccgtagggtaacgttaccgtttacggtaccgttaaccttttaacgttaccgtaacgtaaccctaaaactttaacgttttactttttacctttttaacgttaccggtttaacgtttacggttttaccgggaccggtaaacggggtaacctacggtacggttaagggtaacgtaacgtaacggtaaacgggttacgttacggtccggtacgtccgaacctaccttacgttaccgttacgttacctttacctacccgtttacccgtacccctacgttacgttaccgttaagttacttaactttaagtacgtttacggttacggtacgggtaccgggtccgggacggttacggaaccggtaggccgtacgtaagtcg

SEQ ID NO: 288822 - DNA, 612 bp, Homo sapiens
  misc_feature: GYAE6OF01CF929.44.75.G09.1.454.CMB.1.raw
  modified_base (252)..(252): a, c, t, g, unknown or other
  misc_feature (252)..(252): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggacaaagcccctaagtccctgattctttcnggactccactttgaagagtggagtcccagccaggttcagcggcaggtggttacgtgggacactagtttcacctctacaccatacagcagccctagccagtcctgggagtactttcgcgtaactttatactgacctaaacaattactttctttttaactccgttaacttaggttttcggaccgtaaggggacctaaggtcgtaggaagacttacgaaaggtaactcggtggtctagaccactaacttcgtagttcctttactaccgttccttcccgacctacttcctagtaattaattacttacgttgttcccgttggtaccggcgggtacgttacgggaccgaacgggccgtcgtaacgg

SEQ ID NO: 288823 - DNA, 740 bp, Homo sapiens
  misc_feature: GYAE6OF01CH04Y.44.75.G09.1.454.CMB.1.raw
  modified_base (249)..(249): a, c, t, g, unknown or other
  misc_feature (249)..(249): n is a, c, g, or t
  modified_base (286)..(286): a, c, t, g, unknown or other
  misc_feature (286)..(286): n is a, c, g, or t
  modified_base (512)..(512): a, c, t, g, unknown or other
  misc_feature (512)..(512): n is a, c, g, or t
tcagacagtatatacacgaccggtgctcgatttagtatagacatcagggggggggtctcaggaggcagcgctctcaggacgtcaccaccatggcctggctctgctcctcctcaccctcctcactcaggacacgagggtcctgggcccagtctgccctgactcagcctcctcgcgtcggtctgtcggtcagtcagtcacatctcctgcacgtggaaccagactaatttcattacggtaatcagtgaactntcgtcttcgtacgtaacaacactaccaccgagcaacnccgccccagtacgttgtattagttttacggacggttactaaacgtacggcccgtccccgtacggtaccgggggtcccgtacgttccggttctaccggtcggtaccgtacgtaacggtcgtacggaactaaccgtcggtccctaccgtacgtaccgttcgtcggtccgggtcctacggcggtcgtaggtaccgtgtacgggtacgtcgttaattacgttacgttacngccgtaacgtcgtaccgtaggtacgggctaaccgtaacttagtacggttttacgtttcggttccgggtttacggggacgggtaacgggtaccctacgggttaccgtaccgggttaacccggttacggttaaccgggccttaacccgggaaccccggtaacgggtttcccctacccccgggttcccccgttaaggttccccgttaccgttccccggtttaaccccccgg

SEQ ID NO: 288824 - DNA, 693 bp, Homo sapiens
  misc_feature: GYAE6OF01EX8VI.44.75.G09.1.454.CMB.1.raw
  modified_base (302)..(302): a, c, t, g, unknown or other
  misc_feature (302)..(302): n is a, c, g, or t
  modified_base (329)..(329): a, c, t, g, unknown or other
  misc_feature (329)..(329): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggttcagcaggagcctggacaaagcccctaagtccctgtattcttttctggatcctactttgaagagtggatccagccaggttcagcgcagtggtngggacactatttcactctcaccatcancacgctgcagcgtggagtactttcgcgtacttattaccgtgaccctaaataagtttactttctttttttaacgtacccgtttaacgttaggtttttacggcccggtaaacgggggtaccctaaacggtccgttaggggaacgtaaggttaaaccggtaaaaacgggtaacgtttacgggttacgggtaccgttacggacccgtaaccgtaacgttaccgttacgtttaccctttccgtaacgtttaccccgttaccccggtaccttaacttccgttaagtaacgtttaacgttacttaacgttacggttcgttacgggtacggtacgggtccggtaggtaaccggacgggtaccggtctaaagg

SEQ ID NO: 288825 - DNA, 756 bp, Homo sapiens
  misc_feature: GYAE6OF01CV2DE.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctcgttccccggtgccaggtgtgacatcgagatcgacccagtcctccgtcctcactgtctgcgtctagtgggacagagtccacatctacgttggccgggacgagtcgaccgtactagttacggttcgttttttcggccgttggtttaccgagacgtacggacgtcccgtacggacctaaaccggtacccccgttaacgttcccgttacgtaaccttttccgtttttaccgtcgggtaacctttacccgtaacgttttagaaacggtacggttacggaaccgttaccccgacggtaccgtaacggttcctagggcggtcgtacgggtttcggtacgttacggggaacttaccgtatttacctacctacgttaccaccgactccgaacgtccgtacgccgtacgcgacgtacgtaggaacgtactttcgacgttactttaagtacctacgtaaccgtaacttaacgtttaacttttctttttaacggccctttaagtttacgtttaccgggaccgttaaggaaccgtaacgaccgttaaggacgtaaactaaccggtaaaggtaccgttaggtccggtaccttacggaccttaacccttacgtaccgttacgtttaccttccgttacgttacccccg

SEQ ID NO: 288826 - DNA, 827 bp, Homo sapiens
  misc_feature: GYAE6OF01D0SNY.44.75.G09.1.454.CMB.1.raw
  modified_base (253)..(253): a, c, t, g, unknown or other
  misc_feature (253)..(253): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacgttgccgggcgagtgccgacattaggtactttttggccttggttcagcaggagctggcaaacgccctaagtccctgacttcttttcnggactcctactttaggaagtgttacggacgtcccaagtccgtaggttacaggcggactaggttggttccgtagggaacctacgtacttttaccacttccgtcctaacctatacgaacgtccgtaacgtccgtcgtaccgacgtccggtaggaacgttagtttcccggaccgttaacttttaacttaccgtaccgaacctaaaattaacttttacgttttacttttttaaccgtcccggttttaacgttacgggtttttacgggaacccgggtaaccggggtaacctaaacgggttacgttacggggtaacgttaaagtaaaccgggttaaaacggtaacgttacgggttacgggtaaccgttaccgggaaccttaacccgtaacgtttccgtttaaccgggttttaccctttaaccgtaccgttttacccccgttacccgtaacccgttaactttaccgtaacggttaaacttaaacggtttacctttacccggtttacggttaccggttacggggtaacgggttacccgggtaccggtacgggtaaaccgtaccgggtaacgacgttaaacgg

SEQ ID NO: 288827 - DNA, 645 bp, Homo sapiens
  misc_feature: GYAE6OF01D169Q.44.75.G09.1.454.CMB.1.raw
  modified_base (256)..(256): a, c, t, g, unknown or other
  misc_feature (256)..(256): n is a, c, g, or t
  modified_base (353)..(353): a, c, t, g, unknown or other
  misc_feature (353)..(353): n is a, c, g, or t
tcagacagtatatacacgaccggtgctcgatttagtatagacatcagggacttaggggctttgccaggctcctgctgctctgttccccggtgccaggtgtgacatcgagatgacccagtctccgtcctcactgtctgcgtctattggggacagagtcaccatcacgttgccgggcgagtgccgacattaggtactttttggcctggtttcagcaggagcctggacaaacgccctaagtccctgtacttcttttcgnggatccctactttgaagtagtggacgtccagccaggttcagcgctaggttgtcgtgggactactatttcacttcactacctatcagcacgcctgacncgacctggagtatttcgacgtacttaatactacgaccctaaagtacttacgttttaccttttacgtaccgttacgttacggtttacggacccgttaaggggacctaaggtcgtaggactaagtaacgaaacggtactggtcgtattcgactaccgtactcgtacgttaccttacgtaccttccgttcccgtactaacgttccgtagttaacgttacttaacgttaacctcggttcgtacgggtaaccgggtcgggtaccggtacgggaaccgtaacgggtccgtagtaacgg

SEQ ID NO: 288828 - DNA, 553 bp, Homo sapiens
  misc_feature: GYAE6OF01E0TVF.44.75.G09.1.454.CMB.1.raw
  modified_base (352)..(352): a, c, t, g, unknown or other
  misc_feature (352)..(352): n is a, c, g, or t
  modified_base (371)..(371): a, c, t, g, unknown or other
  misc_feature (371)..(371): n is a, c, g, or t
  modified_base (493)..(493): a, c, t, g, unknown or other
  misc_feature (493)..(493): n is a, c, g, or t
  modified_base (521)..(521): a, c, t, g, unknown or other
  misc_feature (521)..(521): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaacgtccctgtacttcgtttttctggtactcctacttttggaagtaggtggacgtcccagtccaggttcaggcggctagtggttcgtgggacactatttcactctcacatcagcngcctgcacgcctaggactntttcgcgtacttatactgaccaataattactttctttttactccgttatgtttcggaccgtacgggaacagcgtaggactatacgaagactgtcgctgcactatctgtcttctcttcctccnctgtctagacttatactacttcggtcgngtacgcgggtacgtcgacgtagggccgtgtag

SEQ ID NO: 288829 - DNA, 597 bp, Homo sapiens
  misc_feature: GYAE6OF01BXI1Y.44.75.G09.1.454.CMB.1.raw
  modified_base (260)..(260): a, c, t, g, unknown or other
  misc_feature (260)..(260): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgactattaggtacttttttggccttggtttcagcaggagccgtggacaaacgcccctaagtccctgacttcttttcnggatcctactttgaagtagtggacgtcccagcctaggttcaggcggctaggtggttcgtagggacacgtatttcactctcacctatcagcagcctgcacgtcctgggagtatttcggcgtaactttattactcgaccaaataattattttaccttttttactaccgttacttacggttttcggacccggtacggggaaccagtcgtaggacgtatacgaaaggtacgtggtcggtactcgacacacttcgtacgttcttctacttccctcccgctactctgtattatactcgttacgtctggacggtcggtcgtaggtaccgaaggtccgacgtaag

SEQ ID NO: 288830 - DNA, 651 bp, Homo sapiens
  misc_feature: GYAE6OF01CEWCT.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaaacgcccctaagtccctgacttcttttctggatccactttgaagagtggacgtcccagccaggttcagcggcagtggttctggacacatttcactctcacatcagcacgcctgcagcctggagtatttcggacgtaacttacttacgtcgaacccaaactaatttacttttcttttttaacgttcccgtttaacgtttaggttttacgggaccgtaacggggtaaccgtaaacggtcgtaggaagtaagtaaacggtaaaacggtaacgttaggtacggcgtacgacctaaccaacttacgtacggttcctttaccgtactttacccgttcccgtaccctacgttactacggtaattaacttaacttacttacgtccgtaggtaacggcgggtacgttacgggacggtaacgggacgtactaag

SEQ ID NO: 288831 - DNA, 563 bp, Homo sapiens
  misc_feature: GYAE6OF01DOZQ2.44.75.G09.1.454.CMB.1.raw
  modified_base (255)..(255): a, c, t, g, unknown or other
  misc_feature (255)..(255): n is a, c, g, or t
  modified_base (307)..(307): a, c, t, g, unknown or other
  misc_feature (307)..(307): n is a, c, g, or t
  modified_base (370)..(370): a, c, t, g, unknown or other
  misc_feature (370)..(370): n is a, c, g, or t
  modified_base (519)..(519): a, c, t, g, unknown or other
  misc_feature (519)..(519): n is a, c, g, or t
  modified_base (557)..(557): a, c, t, g, unknown or other
  misc_feature (557)..(557): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggtaaacgcccctaagtccctgacttcttttcnggatccacttttgaagagtggagtcccagccaggttcagcggcagtggttcngggacacatttcactctcacatcagcagcctgcagcctggagtactttcgcgtacttattacngaccaaactaattactttacttttttactaccgttactaggtttttcggccgtaacggggacctaaggcgttagggacgtaatacgtaaagggactggtaggcgtgaccacctattcgtgttcttctacttccttcccgctactcgtanattactagtactgtctgacggtcggcgtcggacaggcngtgtag

SEQ ID NO: 288832 - DNA, 570 bp, Homo sapiens
  misc_feature: GYAE6OF01A83BX.44.75.G09.1.454.CMB.1.raw
  modified_base (364)..(364): a, c, t, g, unknown or other
  misc_feature (364)..(364): n is a, c, g, or t
  modified_base (564)..(564): a, c, t, g, unknown or other
  misc_feature (564)..(564): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtacttattacngtaccaaacaattattcttttttatccgttactagttttggaccgtaaggggtacccaagccgttagggagtacgtacgaaaggacctaggtcgggcttggcaccgtattccgtacgttcttcacttcctcccgcctacttctacgattactattacttcgttctacggtacggccgggtcttacggggaccaaggccgngtaacg

SEQ ID NO: 288833 - DNA, 920 bp, Homo sapiens
  misc_feature: GYAE6OF01BTEV9.44.75.G09.1.454.CMB.1.raw
tcagacagtatatacacgaccggtgctcgatttagtatagacatcagggacgttaggggctttgccaggctcctgctgctctgtttccccggtgccaggtgtgacatcgagatgacccagtctccgtcctcactgtctgcgtctagttggggtacagagtcacctatcacttgccgggcgagtgcagactagtttacggtacttttttggccgttggtttcaggcagggacgtccgtggaccaaaacgcccccgtaacgtcccctagtactttccgttttacgtcgggtacttcccctacttttaggaaacgtaacggttcgggtaacggttcccccgaaggtaccccgtaacggggttttccaacggggcccggggtaccgtaacggggtttcgggttttacccgtacgggggtacccaaacgttaacgtttttacccgaaaccgttttcccgtaccgtaaccccgtaacgtttcccaaacgggtcccgtaaaccggtcccctttaccggaccgtaaacgggcccccgtttaggggtaaacggtttaaccgtttttccgggaccggttaacctttttaaacgtttaacccgttacggtaacccctaaaacgtaacgtttaactttttccgttttttttaaaccgttcccggtttaaccgtttacgggttttttaccgggaccccggtaaggggtaaccaaacggtaccgtacgggaagtaacgtaaacggtaaacggtaacgttaaggttacgggtactcgggaacctacccgtacgttaccgtttacgttccgtttacgtaaccgttcccgttacccccgtaccctacgttaccgtacggttaacgttacttaacgttacgtacggttacgtggaacccggtccgggtacgttggggaccgtaagggcccgtaacggg

SEQ ID NO: 288834 - DNA, 702 bp, Homo sapiens
  misc_feature: GYAE6OF01BU4Q7.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtcctccgtcctcactgtctgcgtctattggggacagagtcaccatcacttgccgggcgagtgccgacattaggtacttttttggccttggtttcagcaggagcctggcaaacgcccctaagtccctagtacttcttttcgtggtacttcctacttttaggaagtaaggttcgggaacgttccccaggcctaaggttcgaaggtcggcgtaggttggttcgtaggggacctactatttccactcctaccaccatcagcacgcctgcagcccgtggacgttacgtttcggtacgtaactttattacctacgtacccaaacgtatttacttttacgttttttaacgtacccgtttaacgtttacggttttacggacccgggtaacggggtaacctaacggtcgtagggaagtaacgtaacggaaacggtactgggtacggtctacggtacaccgtaattccgttcgttaccgtttactaccttcccgttccccgtaccttacgttacctagtaacttacgttaacttacgttcgtcgttacggacggtccgggtacggtacgggacgaacgggtccgaacgtaacg

SEQ ID NO: 288835 - DNA, 816 bp, Homo sapiens
  misc_feature: GYAE6OF01A7Z4Y.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccggcgagtgccgacagttaggtacttttttggccttggttcagcgaggagcctggacaacgcccctaacgtccctgtacttcttttcgtaggactcctacgtttggaaacggtaggttacgggacgtcccgagtaccgtagggtttaccaacggtccgggacgtagggttacgggtttcgtacggggtaacctaccttaacttttccctaacctttccgtacctaaacccgtaacttccaaacgggaccaaccgggtcccctagggacccacgggtaccccgtttagggaacggtttaacctttccggaacccggttaaactttttaaccgttaaccgtccgtaaccctaaaacgttaaacttttaacgtttttccttttttaacgtacccgtttaacgttacggttttaccgggacccggtaacggggtactaacggtccgtaggtaacgtacgttaacggaaacggtaacgttaggggcgtaccgtcggacctaacccgttatccgttaccggttacctttaccgttaaccgttccccgtttacccgaccttacggttacctacggttaattactacgtttacgtacggttacctaggtaccggacgggtcttacgggacccgggttaaggccgtaccgtaag

SEQ ID NO: 288836 - DNA, 659 bp, Homo sapiens
  misc_feature: GYAE6OF01EQZG6.44.75.G09.1.454.CMB.1.raw
  modified_base (257)..(257): a, c, t, g, unknown or other
  misc_feature (257)..(257): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagtggggacagagtcaccatcacttgccgggcgagtgccgacattaggtactttttggccttggttcagcaggagcctggacaaacgcccctaagtccctgtacttcttttcgnggactccctactttggaacgtggtggtacgtcccagcctaggttccaggccggctaggttggttcgtgggactactagtttccactctcacctatccagcacgcctgcagccgtggactagtttcgacgttacttaactacgtacgacctaaataactttactttctttttaacgtccgttacgttagtttacggacccgtagggaacctaagtcgtaggacgtacgtaacgaaaggtactggtgcgtcgacaccgtacttcgtcgttaccttcctacgtttcccgttacccgtacctacgttaccgtacgtaaactttacgttacgtttacgttacggttcgtacgggtccgggtaccggggttccgtacgggtaaccggttacgggacgtacgtaaacgg

SEQ ID NO: 288837 - DNA, 619 bp, Homo sapiens
  misc_feature: GYAE6OF01AYV2Q.44.75.G09.1.454.CMB.1.raw
  modified_base (305)..(305): a, c, t, g, unknown or other
  misc_feature (305)..(305): n is a, c, g, or t
  modified_base (518)..(518): a, c, t, g, unknown or other
  misc_feature (518)..(518): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttggccgggcaagtcagggcataaacagtgcgtttggcctggtatcagcaagaaaccagggaaaactctagaactcctgatctatgatcgcctcgtaggtttaggaaagtggactcccatacgtaaggttcaggcggngaggtggatcgtaggggactaggtactttcgaccttctaccacctataccagccagcctgcacgctaggtaagttctttagaccttaacttattacgtgtacagtactttaagtttaacctaccgtttacccttacgtaccgttacgttacgggaccgggtacgggtacgtaagggtgtaacgtacgtaacgaacgtagtggtcgtacgtacncgtactagttcgttctccttcgtcgttccctccccgtactctccgttagtacttaacgttactacgttcgtaccgtcggtacgggcgtcggtggtaaccgg

SEQ ID NO: 288838 - DNA, 831 bp, Homo sapiens
  misc_feature: GYAE6OF01EF6KQ.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgatagttaggtacttttttggccttggtttcaggcaggacgcctggaccaaacgtcccccttaagtcccctgtacttcttttcgtggacttcctaacgttttaggaaaggtaggtcggacgttccccgagccgtaggttcacggccggcgtaggttggttcggtgggaacctacgtactttccgacttcctaccacctatcaagtccgacgtccctagccgacgtccgtagggtaacgtacgttttccgaaccgttaacgttttacgttaaccgtacggtaaacccctaaaacgttaaacttttacctttttacctttttttaaccgtacccggttttaaccggtttacggtttttaccgggacccggttaaacggggaaaccctaacggtagttaacgggaacgtaacgttaaacgaaaacgggttcgttacgggtcggaccgttaccgacctaaccgttacgttccgtttaccgtttacctttacccgttacgtttcccccgttaccccgaaccgttacgtttaccgttaacgtaaaccgtttaacgtttacccgtttaacgttccggtttaccgttacggggtaaccggggttcccggtaacgggttacgggaaacccggttaacgggtacccgtaccgtaaagg

SEQ ID NO: 288839 - DNA, 621 bp, Homo sapiens
  misc_feature: GYAE6OF01B4SQ0.44.75.G09.1.454.CMB.1.raw
  modified_base (259)..(259): a, c, t, g, unknown or other
  misc_feature (259)..(259): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacagttaggtacttttttggccttggtttcagcaggacgcctggacaaacgcccctaagtcccctgattcttttcnggatcctactttgaagagtcggacgtcccagccgtaggttcagcggcaggtggttctagggactacgtatttcactctacaccatcagcacgcctgcagccgtaggactatttcgacgtacttattacgcgacctaaactaattacttttactttttactccgttaacgttacgttttcgggaccgtacgggaacctaaggtcgtaggaagtaagtaacgaaacggtacgtgtacggctacgaccgtactacttcgttcgttaccttcgtaccttccgttacccgctacgttcctagtacttacgtaacgttacgtcgttcgtaggacggtcggtcgtacgggacgtacggcggtcgtaacg

SEQ ID NO: 288840 - DNA, 690 bp, Homo sapiens
  misc_feature: GYAE6OF01D7FEW.44.75.G09.1.454.CMB.1.raw
  modified_base (327)..(327): a, c, t, g, unknown or other
  misc_feature (327)..(327): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgacattaggtacttttttggccttggtttcagcaggagcctggaccaaacgcccctaagtcccctgtattcttttcgtggatcctactttggaagtaggttggacgtcccagcccgaggttcaggccggcgtaggttggttcgngggacactgtttcactcacaccatcagcagtccgtgcgacgccgtggagttacgttcgacgtaactttacttaccgtcgaccaacgtaaatttaacttttcttttttacgtccgtttaacttacggttttcggaacccggtaacggggacctaaaggtccgtaggtaaggaacgtaacgtaaacggtaacgttggtacggtactcgaccctaaccgtattccgtttacgttcctttacctactttaccccgtttcccccgactttacgttacgtaacttaacttacgtttaccgtaggttccggttacggacgggtcccggggtacggttccggaacggtaaccgggtcctaacggtgtaacg

SEQ ID NO: 288841 - DNA, 653 bp, Homo sapiens
  misc_feature: GYAE6OF01D7F4E.44.75.G09.1.454.CMB.1.raw
  modified_base (378)..(378): a, c, t, g, unknown or other
  misc_feature (378)..(378): n is a, c, g, or t
  modified_base (575)..(575): a, c, t, g, unknown or other
  misc_feature (575)..(575): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaacgcccctaagtccctgacttctttctggatcctactttgaagagtggacgtcccagcaggttcagcggctagtggttcgtggacacgtatttcactctcaccatcagcagcctggcacgcctggagtatttccgcgtacttactttaccncgacctaaactaattattttaccttttttaacgtcccgtttaacgttagttttacggaccgtaggggtaacctaacggtcgttaggacgtaacgttaacgtaaacgttaacgtcggtggtaccgtcgaccgtaacctaacgttcccttagttccttacgttaccttccccgttacccgtaccttacgttacccgttntaaactttagttaacttaacgtttcgttcgttaggacgggtaccgggtgttaccgggaaccggtcggtcgacgttaag

SEQ ID NO: 288842 - DNA, 581 bp, Homo sapiens
  misc_feature: GYAE6OF01ATZ7Y.44.75.G09.1.454.CMB.1.raw
  modified_base (194)..(194): a, c, t, g, unknown or other
  misc_feature (194)..(194): n is a, c, g, or t
  modified_base (225)..(225): a, c, t, g, unknown or other
  misc_feature (225)..(225): n is a, c, g, or t
  modified_base (380)..(380): a, c, t, g, unknown or other
  misc_feature (380)..(380): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
tcagacagtatatacacgaccggtgctcgatttagtatagacatcagggacttaggggctttgccaggctcctgctgctctggctcccaggttcgagatgtgacatcgagatgaccaagtctccttccttcctgtcttcttctgttggaggcagcgtcaccatcacttgccgggcgagtcaggtcgttttcggngctgttgcctggtttcaacgaaaaagggggnacggcccctaaggtcctcgtctctcgtagaaaccagactggaaggtagagtcccgtcaggttcagtgccagtccgaggtggtgggccggagtccactctcacctattacgccgtacctggccggcctaggaaagtatttccgtgcctaaactttntttctgtccagctaggtactcaagttcgtcgtccccgtttatacgttttcggccgacggggaccaacgtcgtaggtaaactacgaaacgtacgtggtagctagccactatcttcgtcttctactccttcccgcctatctagtactatacttacgtgttcgtcggtaggcggtcgtcggacgaacggtcgacagtcgngnac

SEQ ID NO: 288843 - DNA, 570 bp, Homo sapiens
  misc_feature: GYAE6OF01E0H0E.44.75.G09.1.454.CMB.1.raw
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaacgcccctaagtccctgatcttttcnggatccactttgaagngtggagtcccagccaggttcagcggcagtggttctggacacatttcactctcaccatcagcagcctgcagcctggagtatttcgcgtactttatacctgaccaaactaattactttcttttttaactccgttactagttttcggacccgaggggaccaagtcgtaggagtatacgaaaggactgtggtctgacaccattccttagttcctttactaacttcccttcccgcctacttccgtagtaacttaactacttaactgttcgtggacggtccgggtctcgggacgacggccgcgtaacg

SEQ ID NO: 288844 - DNA, 938 bp, Homo sapiens
  misc_feature: GYAE6OF01C9P27.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattgggacagagtcacatcacttgccgggcgagtcgaccgactagttaggtacttttttcggccttggtttccagtcgaggacgcctaggacctaaaacgcccccttaaagtccctagtacttcttttcgtggtacttcccgttaacgttttcggaaaggtacggttacgggtaccgttaccccgtaaggcccgtaacgggtttaccgaacggccgggtccgttaagggttcggggtttaccgtcggggaaccctaccgttaagttttccgaaccgttcctacctaaccctacggttaccaaaccggtccgtaacggtcccgttacggtacctaaccggtacccggttaggggtaaacgtttaccgttttacccgggtaccgtttaaaccgttttaaccgttacgtttaccggaaaacccttaaacgttaacgtttaacctttttaccgttttttaaccgtacccgtttaagtttaccgggttttaccgggaccggttaacggggtaacctaaggtaccgtacgggtaacgtaaccggttaaacgtaaccgggttaaacggttcggttacgggtaccttaacggtacccggtaaaccgttaaccgtttccgtttaacccgtttcgtttaacccgttcccggtttacccctttaccccgtacccgtttaacggttacccgttaggttacgttaaaaccgtttaacggttaacctttcggttaaccgttacgggtaaaccgggttcccgggttaacgggttacccggtaacgggtacgggtaaccgtacggtaaacg

SEQ ID NO: 288845 - DNA, 749 bp, Homo sapiens
  misc_feature: GYAE6OF01A7KH4.44.75.G09.1.454.CMB.1.raw
  modified_base (224)..(224): a, c, t, g, unknown or other
  misc_feature (224)..(224): n is a, c, g, or t
  modified_base (268)..(268): a, c, t, g, unknown or other
  misc_feature (268)..(268): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttggccgggcgagtgccgactattaggtacttttttggccttggtttcagcaggacnccgtggaccaaaacgtccccttaagtccctgtacttcgttttcncggtacttcctacttttaggaaaggtagttcgggacgtcccacggtccgtaaggttcaaggtccggctaggttcgggtttcgtcggggactactactttcaacttcctcacctatccagcaacgtcctgccgtagcctagggtacgtatttccggacttaacgtttacttaccgtacgacctaaacttaaatttactttactttttactaccgttacttacggttttacgggaccgtaacggggtaacctaacggtcgtacgggaacgtaacgtaacggtaaaacggtacgttaggtacggacgtagtacccgtaaccttaacgttcgttacgtttaccgttaccttacttccccgggttacccctaccgttaacgtttccgtaacgttaacttaacgtttaccgttaacgtttcggttaccggtacggtacgggtccgggtaccgtacgggtaaccggtaacgggtacgtacgtaaacgg

SEQ ID NO: 288846 - DNA, 520 bp, Homo sapiens
  misc_feature: GYAE6OF01BWZPV.44.75.G09.1.454.CMB.1.raw
  modified_base (346)..(346): a, c, t, g, unknown or other
  misc_feature (346)..(346): n is a, c, g, or t
  modified_base (480)..(480): a, c, t, g, unknown or other
  misc_feature (480)..(480): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagaaggagcctggcaaagcccctaagtcccctgatcttttctggatccactttgaagagtggagtcccagccaggttcagcggcagtggttctgggacacatttcactctcaccatcagcagcctgcagcctgganatttcgcgtacttattactgacctaaacaattattcttttttatccgttactagttttcggccgtaggggacccaagctaggagatacaaaggactgtggctgcaccatctgtcttcattccttcccgcatctnatatactactgtctgacgcgggctcggacaggcgcagtag

SEQ ID NO: 288847 - DNA, 573 bp, Homo sapiens
  misc_feature: GYAE6OF01ELJXV.44.75.G09.1.454.CMB.1.raw
  modified_base (251)..(251): a, c, t, g, unknown or other
  misc_feature (251)..(251): n is a, c, g, or t
  modified_base (301)..(301): a, c, t, g, unknown or other
  misc_feature (301)..(301): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggtcngggacacatttcactctcaccatcagcagccctgcacgcctggactagtttcgactacttattactacgaccaactaattactttcttttttaactcccgttacgtacggttttcggacccgtacgggtaaccaaggtcgtaggagtaatacgaaagactggtcgcttgaccgacctagtccttcgttaccttctacttccgttcccgtcctactctagtacttagtacttacttggtcgtggacgcgggtacgtcggagacgggcgcgtag

SEQ ID NO: 288848 - DNA, 635 bp, Homo sapiens
  misc_feature: GYAE6OF01D7FOX.44.75.G09.1.454.CMB.1.raw
  modified_base (373)..(373): a, c, t, g, unknown or other
  misc_feature (373)..(373): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtcgccgacagttaggtacttttttggccttggtttcagcaggagcctggacaaacgcccctaagtccctgtattcttttctggactcctactttgaagtagtggacgtcccagccaggttcaggcggctaggttcggttcgtggggacacgtattttccactctcaccatcagcagccctagcacgcctggagtntttcgacgtactttatacgtcgacctaaataatttactttcttttttaatacccgtttacttacggtttttcggaccgtaagggggaacctaaggtacgtacgggaagtaagttaaccgaaaagggtaacgttggtaggtctcggcctaacctattccgttcggttctttactacttcccgttaccccgtctacttactgtaacttagtaacttacgttgttcgtaggacgggcgggtctacgggacgaacggcgtctaagg

SEQ ID NO: 288849 - DNA, 709 bp, Homo sapiens
  misc_feature: GYAE6OF01D7LLY.44.75.G09.1.454.CMB.1.raw
  modified_base (266)..(266): a, c, t, g, unknown or other
  misc_feature (266)..(266): n is a, c, g, or t
  modified_base (709)..(709): a, c, t, g, unknown or other
  misc_feature (709)..(709): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttggccgggcgagtcgccgactattaggtacttttttggccttggtttcagcgaggacgccgtggacaaacgcccctaagtcccctagtacttcttttcnggacttccctatttaggaaggagtcgggacgtccccagccgtaaggttccaggccggacgtaggttgggttcgtggggactacgttctttaccacttcctaccaccatcacgccacgtcctgcacgtccgtgggacgttacgtttccggaccttaacgtttaactttacgtacgtaacctaaaacttaactttacgttttacttttttacgtaccgtttacgttaggttttacgggacccgggttaacggggtacctaacggtacggttaggacgtaacgtaacgtaaagggtacgttggtacggtcgcgtacgaccctagttccttacgttccgtttactccgtttacccgtccccgtacctacgttacttacggtatttacgtttaccggttcggtacggtcgggtcgggtccgtacgggtccgacggtaccgactgtcgn

SEQ ID NO: 288850 - DNA, 678 bp, Homo sapiens
  misc_feature: GYAE6OF01EZFFN.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgattcttttctggatcctactttgaagtaggtggacgtcccagccaggttcagcggcaggtggttctgggacactatttcacttctccaccatcagcagcctgcacgcctgggatatttcgccgtacgtttattactcgaccaaataacttattttacctttttttaatacccggtttaacgttacggttttacgggacccgtaaggggtaacctaaggtcgtaggagtactaacgaaaggtacctggtgggaccttcgggacctaaccgtattaccgttggttacctttaccgtacgtttccccgttaccccggtacccctacgtttccgttaacggtaacctttaagttaacgtttactttaccgggttcgttacgggaacgggtcccggggtacgttacggggaacgtaaaccggggcgtaacggtaacg

SEQ ID NO: 288851 - DNA, 684 bp, Homo sapiens
  misc_feature: GYAE6OF01EA02D.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccggcgagtgccgactattaggtacttttttggccttggtttcagcgaggacgcctggacaaacgcccctaagtcccctgacttcttttctggtactcctaactttggaaagtaggtggacgtcccgagtcctaggttcaggccggcgtaggtcggttcgtacggggactactacgtttcaccttctcctaccactcacgcacgcctcgcgtacgcgtggtacgtagtttacgacgttacgttacttacgtacgaccgaaactaatttacttttactttttaacgtaccgtttacgttaacggtttcggtaccggtaacggggtaaccaacggtagtacgggtaagtaacgtaacgaaacggtaagttcggtacggcttacggcctaacccgtatttccgtagtttaccttacctacgtttaccccgttcccgtctacgttctaccgtaattacttacttacgttcgtacgtcggtacgggaccggtcggtaccggtagaaccgtggtctaacgg

SEQ ID NO: 288852 - DNA, 720 bp, Homo sapiens
  misc_feature: GYAE6OF01DJVDP.44.75.G09.1.454.CMB.1.raw
  modified_base (177)..(177): a, c, t, g, unknown or other
  misc_feature (177)..(177): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttggccgggngagtgccgacattaggtacttttttggccttggtttcagtcgaggacgccgtacggacaaacggtcccctaacgtcccttgtacttcttttcgtggtactccgtactttagaagtagtggacgtcccgagcctaggttacacgcggacgtaggttcggttcgtcgggactacgtactttcgactcctacaccgtatcagccacgtcctgacacgcgtaggagttactttccgacgttaactttacttaccgtacgaaccctaaattaaattactttttacctttttaacgtcccgttacgttacggttttcggacccggtaaggggtaaccaacggtcgtaggtacgtacgtaaccgaaaagggtactggttacgacgtccgaccctaacgtacgttccctttgttaccttcgtaccttacccgttcccccggtactaccgttcttagtaacttaactttaccgttaaccgtttggtaccgtttaggggaacccgggttccggggtaccgttaggggacccgtaacgggccggtaagtaccgg

SEQ ID NO: 288853 - DNA, 605 bp, Homo sapiens
  misc_feature: GYAE6OF01A4OH3.44.75.G09.1.454.CMB.1.raw
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaacgcccctaagtccctgatcttttctggatcctactttgaagagtgagtcccagccgaggttcagcgnagtggttctcgggacnctagtttcaactcgtcaccatcacgctagcctgcagcctggatatttccgcgtactttacgtactcgacctaaataattactttacttttttacgccgttacgttacgttttcggaccgtacggggtaaccgtaaggtctacggtaacgtagtacgaaaggtaacgtggtcggtactacgctaccgtaactcgtgttccttacgtacttccttcccgactacttcgtacgtacttaagtacttactcgttcttacggaggtcggtccgtcggaccgtaagggccgtacgtaacg

SEQ ID NO: 288854 - DNA, 767 bp, Homo sapiens
  misc_feature: GYAE6OF01C2GKC.44.75.G09.1.454.CMB.1.raw
  modified_base (436)..(436): a, c, t, g, unknown or other
  misc_feature (436)..(436): n is a, c, g, or t
tcagacagtatatacacgaccggtgctcgatttagtatagacatcagggacttaggggctttgcaaggctcctgctgctctgtttccccggtgccaggtgtgacatcgagatcgaccagtctccgtcctcactgtctgcgtctagtggggacagtagcaccatctactggccgggcgagtcgaccgaatagtttaaggttacctttttttgggcctttggttcaggacgagggacgtccgtacggaacaaacgtccccgttaacgtccctagtactttcgtttcgtacggtacttacctacgtttaggtaaggtacgggtacggtaccgtacccgaggacccttagggttccgagggcggtcgtagggttcggttcgtagggactactacttcacctcctactacgactcacggctacgcgtacgccacggtacgnggtagtctttacggacttactttactacgctaaacctaaatatttacgtttacgttttacgtaccgttaggtttaccggtttacgggaacccggtaagggaaccaacggtacggttaaggaacgtaacgtaacggaaaacggtagtcgggtacgtacgacctaccgtaaccttagttccgtttaccggttacctttacggttaaccccttttcccgttaaccccgtcctaacggtttccaaacgttaacttaaaccggttattacccgtggttaacggttaccgggcgggttaccggggaccgttacgggtaaggaaccggtagtacgtaa

SEQ ID NO: 288855 - DNA, 682 bp, Homo sapiens
  misc_feature: GYAE6OF01CM8O3.44.75.G09.1.454.CMB.1.raw
  modified_base (343)..(343): a, c, t, g, unknown or other
  misc_feature (343)..(343): n is a, c, g, or t
  modified_base (378)..(378): a, c, t, g, unknown or other
  misc_feature (378)..(378): n is a, c, g, or t
tcagacagtatatacacgaccggtgctcgatttagtatagacatcagggacttagggggctttgccaggctcctgctgctctgtttccccggtgccaggtgtgacatcgagatgacccagtctccgtcctcactgtctgcgtctagttggggacagagtcaccatcacttggccgggcgagtgccgactattaggtacttttttggccttggttcagcgaggtagccgtaggacaaacgtcccctaagtccctgtacttctttcgtggtactccactttgaagagtcggagtcccagcctaggttcaggcggcaggttggttctgggacactatttccactcncaccatcagtcagcctagcagcctggactgtttcncgtaactttatacgtagaccaaactaattacgtttacttttttacgacccgtttagttacggttttacggaccccggtaaggggtaaccctaaggtacggttacgggaagtaacggtaaacggaaacggtaaaccgttcgggtacggtccggttaccggaaccttaaccgtaacttccgttcggtttcccttacgtacctttacccgtcccgtacctaccgttcgtacgttacttaagttacgttacttacgggttcgtacgggacggtacggtaccggtggaaccgtaacgggctcgtaaacg

SEQ ID NO: 288856 - DNA, 610 bp, Homo sapiens
  misc_feature: GYAE6OF01D0TIC.44.75.G09.1.454.CMB.1.raw
  modified_base (606)..(606): a, c, t, g, unknown or other
  misc_feature (606)..(606): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggacgcctggacaaacgcccctaagtccctgtattcttttctggactcctactttgaagaggtcggacgtcccagccgtaggttcaggcggcgtaggttgggtttcgtaggggacctacgtattttccacttcctacacctatcagcacgcctgcagcctggagtactttcgcgtacttatactcgacctaataatttactttactttttacgtaccgttacgttacggtttcggaccgtaacgggtaccaagtcgtaggacgtataacgaaaggtactggtagctcgcacgtactcgtcgttccttactacttcccttacccgcctactcgtagtattaacttacttacgttgtcgtaggtcggccgggtcggtacggagtacgggcgngtag

SEQ ID NO: 288857 - DNA, 728 bp, Homo sapiens
  misc_feature: GYAE6OF01BULM4.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgatattaggtacttttttggccttggtttcagcaggagccgtggacaaacgccccctaagtccctgtacttcttttctggactcctactttaggaagaggtggactcccagcctaggttcagcggctaggtcgggttctaggggactactctttacaccttctcacctatcgacgcacgtccgtgcacgtccgtaggacgtagtttccggacgttaacctttacttaacgtcgaacctaaactaaactttacttttacctttttttaacgtacccgtttaacgtttacgggttttacgggacccggtaaacggggaaccctaaggtccgtaggggtaactaacggtaacgtaaaacggtaacgttaggtacgggtctacggacctaaccgtacgttccgttacgttccgtttactacccgttcccgtttacccccgtccttacgtttaccgttacgttaaactttaacgttaccttacgttacggtttcgtcgggtaacccgggcgggttaccggtacgggtaaccggaacgggtcgtaacggtag

SEQ ID NO: 288858 - DNA, 797 bp, Homo sapiens
  misc_feature: GYAE6OF01B2NGD.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgactagttaggtacttttttggcctggtttcagcaggagcctggacaaacgtcccctaagtccctgtacttcttttcgtggtacttacctattttggaagtaggtcggacgttaccccgaggtccgtaacgggttcgacggccgggtacgttacgggtttcgggtttacggtacggggtacctaacgtttactttacctaccttccgttaccacctaattccgaacgtccgacggtcctcggacctggtacccgttagggtaacgttacgtttaccgaccggttaaccttttacgtaacctaccggtaaccctaaaacttaactttacgtttttaccttttttaacgtaccgtttaacgttacggggtttttaccggaacccgggtaacggggaacccgtaaaggtccgtagggtaacgtaacgttaaacgtaaacggtacgttacgggtacggtacgttacgacctacgtacttacggttaccttccgttaacctaccgtttccccgttaccccgaccttaacggttacttaccggtaattaaacgttactttaaccggtcgttccggtaggtacggttccgggtaccgacgggtaccgacgtcggacttaagg

SEQ ID NO: 288859 - DNA, 626 bp, Homo sapiens
  misc_feature: GYAE6OF01CVA0P.44.75.G09.1.454.CMB.1.raw
  modified_base (429)..(429): a, c, t, g, unknown or other
  misc_feature (429)..(429): n is a, c, g, or t
tcagacagtatatacacgaccggtgctcgatttagtatagacatcagggacttaggggctttgccaggctcctgctgctctgtttccccggtgccaggtgtgacatcgagatcgacccagtctccgtcctcactgtctgcgtctagttggggacagagtcaccatcacttgccgggcgagtgccgactattaggtacttttttggccttggttcagcgaggacgcctggaccaaacgtcccctaagtccctagtacttcttttcgtggactacctacttttggaaagtaggttggacgtcccccgaagccgtagggtttcaaggtccgggctaggttcgggtttactggggaacctacgtatttccaccttctccaacctagtcagccacgcctgcacgccgtggattctttcgacgtaactttatacngacctaaataattatttcttttactccgttatacggttttcggaccgtagggaccaagtcgtaggagactacgaaaggacgtggtgcgtgactaactcttcgtagtccttatccttcctccaccgtatcctagtacttagttacttattcggtcgtagggacgggtcgggtcgtacggaccggaaggtcgacgtaag

SEQ ID NO: 288860 - DNA, 533 bp, Homo sapiens
  misc_feature: GYAE6OF01EXEEI.44.75.G09.1.454.CMB.1.raw
  modified_base (528)..(528): a, c, t, g, unknown or other
  misc_feature (528)..(528): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtcccctgattcttttctggatcctactttgaaggagtggacgtcccagccaggttcaggcggcagtggttcgtgggacacatttcactctcaccatcagcagcctgcagcctggatagtttcgcgtacttattactcgacctaaacgaattactttactttttatccgttactacgtttgaccgagggtaaccaagcgtaggagatacgaaagtactgtgctgcacctatctgtctctactccttccgctatctagtatatactactgtctaggcgcggtcgaggacacggncgtag

SEQ ID NO: 288861 - DNA, 742 bp, Homo sapiens
  misc_feature: GYAE6OF01COXYW.44.75.G09.1.454.CMB.1.raw
  modified_base (646)..(646): a, c, t, g, unknown or other
  misc_feature (646)..(646): n is a, c, g, or t
  modified_base (720)..(720): a, c, t, g, unknown or other
  misc_feature (720)..(720): n is a, c, g, or t
tcagacagtatatacacgaccggtgctcgatttagtatagacatcagggacttaggggctttgccaggctcctgctgctctcgtttccccggtgccaggtgtgacatcgagatgacccagtcctccgtcctcactgtctgcgtctagtcgggacagacgtacaccatctacgttggccgggcgagtcgaccgactagttaggttacgttttttcggccgttggttacacggcgaggacgtccgtaggaaccgaaacgtccccgttaacgtcccgttagtactttcttttacgaggtactccgttaacgtttaggaaagtaggtcggtactacccgaggtaccgtaaggttccaaggtcggacggtacgttttcgggtacgtaggaacctacttactttaccactcctactacatacgacgctacgcctgaccacggtcgtagggtacttacgttacgacttaactttacggtacacctaaacctaattaactttacttttacttttacgtaccgttagtttacggttccgaacggttaacggcctaaggtcgtaggaacgttagaaacggaagtgtcggttagcctacgacctaaccgtaagttccctcggttaacttccgtaacccgtttcccgaccttaccctntaccggtaattaaccgttaattacggttaacgttcggtttccggaagggcccgggtacggtacggaaccggtanaaccggggtttcaaggttaacg

SEQ ID NO: 288862 - DNA, 634 bp, Homo sapiens
  misc_feature: GYAE6OF01DR1P5.44.75.G09.1.454.CMB.1.raw
  modified_base (324)..(324): a, c, t, g, unknown or other
  misc_feature (324)..(324): n is a, c, g, or t
tcagacagtatatacacgaccggtgctcgatttagtatagacatcagggacttaggggctttgccaggctcctgctgctctgtttccccggtgccaggtgtgacatcgagatgacccagtctccttcctccctgtctgcttctataggagacagagtcgccatcacttgccgggcaagtcagaccattaacagctatttaaatggtatcagcagagaccaggaaacgcccctgaactcctgatctctgctgacctccactctgactaaggtgatctctcaaggttcagtgcagtggatcgtggacagtactttcactctcactntcctccagtctcgactaaccgtgaacgttactttcgactaaacctttactactaggttaaccaacgtaagtaacgtttactaaccgttccggtacccccgttttacgttaacggtttttacggggaccggggtaacctaaggtccgttaggaacggtataaccgaaacgtacgtacgttcggtactacggacctaccgtaacttcgtacttaccgttctaaccttccgttccccgaccttaacgttccgtattaaacgttacttacgttaacgttcgttccgtaaggtcggtccgggttgcgggaaccgg

SEQ ID NO: 288863 - DNA, 723 bp, Homo sapiens
  misc_feature: GYAE6OF01CFW0Y.44.75.G09.1.454.CMB.1.raw
  modified_base (261)..(261): a, c, t, g, unknown or other
  misc_feature (261)..(261): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgacagttaggtacttttttggccttggtttcagcaggagcctggacaaacgcccctaagtccctgtacttcttttcgnggtactcctactttgaagtagtggacgtcccagccgaggttcagcgcgtagtggtctgggacactatttcactctcaccatcacgcacgctcgcagccgtggatacttcgcgtacctttatacgtacgacctaaactaattacttttactttttactaccgttaacgtttagtttttcgggaccgtaacgggaacctaaggtaccgtagggtaacgtaacgttaacccggaaaagggttaacccgttagggttacgggtaccctttaacgggaacccgttaaccctaaacgtttacccgttcggttttacccgtttaccctttaacgtttcccccgtttaccccggtaacccgtttactttacccgttaaggttaacttaacgtttaacgttacgttacggtttctaggggtacccggtacggggtccttaacggggaccgtaaacggcccggtataaacgg

SEQ ID NO: 288864 - DNA, 730 bp, Homo sapiens
  misc_feature: GYAE6OF01DXSCP.44.75.G09.1.454.CMB.1.raw
  modified_base (262)..(262): a, c, t, g, unknown or other
  misc_feature (262)..(262): n is a, c, g, or t
tcagacagtatatacacgaccggtgctcgatttagtatagacatcagggacttaggggctttaccaggctcctgctgctctgtttccccggtgccaggtgtgacatcgagatgacccagtctccgtcctcactgtctgcgtctagttggggacagagtcaccatcacttgccgggcgagtgccgacattaggtactttttggccttggtttcagcaggacgcctggaccaaacgtcccctaagtccctgtacttcgttttcnggactccgtactttagaagagtaggacgtccccaggccgtaggttcacggcggacgtacggttgggttcgtacggggactaacttaacgttttccaaccgttcctaccaaccacttaccagaccgaaccgtccgtcgaccgtacggtaccgttagggtaagttacgtttccggaacgttaactttaacttaccgcgtaacctaaactaacttttacttttaccgttttttactaccggtttacgttacgggttttccgggaccggtaacggggtacccgtaggtacgtagggtaacgtaacgtaacggtaaacggtaccgttggtacggtacgttccgacctacgtacgtttcctacggtttccttacttccttcccggttacccctctacttaccgtagtacttagttacgttcgtcgttacggtaggtcgggtccgggtacgtacgggacgaggctacgtactagg

SEQ ID NO: 288865 - DNA, 727 bp, Homo sapiens
  misc_feature: GYAE6OF01EFPLX.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttgggacagagtcaccatcacttggccgggcgagtcgccgatagtttaggttacttttttggccttggtttcagcgaggcgccgtggacaaacgtccctaacgtccctgtactttcttttcgtaggtacttccgttacgtttaggaaaggtaggtacgggacgttacccgacgcccgtagggttaccacggccgggtacgtacggtttgggtttacggtacgggtaacctactacttttaccacctttcctaccacctactcaacgccacgtccgtcgacgtagtccgtagggacttacgttcgacgttacttagttacacgtaacctaaattaactttacttttactttttacgtaccgtttaacgttacggtttacggacccggtaacggggtaacctaaggtacgtaggaacgtacgtaacggtaaacggtaacgtggtcggtactcgaacctaccgtattccgttcgttacctaccttaccgttcccttcccgacttacgtctaagttacttagttacgttactcggtacgtacgggtacggccgggttactaccggaaggtaacggcgtaggtaacg

SEQ ID NO: 288866 - DNA, 638 bp, Homo sapiens
  misc_feature: GYAE6OF01CH4TC.44.75.G09.1.454.CMB.1.raw
  modified_base (216)..(216): a, c, t, g, unknown or other
  misc_feature (216)..(216): n is a, c, g, or t
  modified_base (254)..(254): a, c, t, g, unknown or other
  misc_feature (254)..(254): n is a, c, g, or t
  modified_base (368)..(368): a, c, t, g, unknown or other
  misc_feature (368)..(368): n is a, c, g, or t
  modified_base (529)..(529): a, c, t, g, unknown or other
  misc_feature (529)..(529): n is a, c, g, or t
  modified_base (630)..(630): a, c, t, g, unknown or other
  misc_feature (630)..(630): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcacatcattgccgggcgagtgccgatattaggtactttttggcctggttcagcagganccgtggacaaacgcccctaagtccctgtattctttcgngtatccgtatttggaagaggtcgagtcccaagtccaaggttcaggcggctaggttcgggtttacctaggggaccacgttactttacaccttcgtcaacctatcaagcacgtctnccgagcctgggattctttacgcgtaactttaattcacgaactaactaaacgttattttactttttaacgacgttattagggtttcggaacccggtaggggtaaccctaaggtctaggaactagtaaccgtaaagtaacgttggtacgtactacgctaaccngttcgtcgttacgtctaacttcccgttaccgcctaacgttctagtaaattactaaagttccttagttccgagttacggaccggtggtaacgcggtaacggntacgtaag

SEQ ID NO: 288867 - DNA, 758 bp, Homo sapiens
  misc_feature: GYAE6OF01DODGC.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttggccgggcgagtgaccgacagttaggtacttttttggccttggtttcagcaggacgccgtggacaaacgcccctaagtccctgtattctttcgtggactcctaactttgaaggtaggtacggacgtccccgagtccgtaggttcaggccggctaggttcgggtttccgtggggactacgtactttccaactcctcaaccatacgacgcacgcctgcacggtccgtaggtagtacgtttcgacgtactttacgttacgtacgtaccaaactaatttacttttctttttaactacccgttacgttaacggttttaccgggtaccggaacggggtaacctaacggtacgtacgggaagtaacgtaaccggtaaaacgggtaacgttagggtcggtacgttacggtacccgtaaccgtactttaccgttacgtttcccgttaccgttacctttccccgtttaccccgtaccttaaccgtttcgttaaaccgttacttaaacgtttaaccgttaccgtttcggttaaccggtacggggtacgggtacccggggtacggttacggggaaccggtaacggggtcctacggtaaagg

SEQ ID NO: 288868 - DNA, 775 bp, Homo sapiens
  misc_feature: GYAE6OF01CD4C4.44.75.G09.1.454.CMB.1.raw
  modified_base (277)..(277): a, c, t, g, unknown or other
  misc_feature (277)..(277): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcacatcacttgccgggcgagtgccgactattaggtacttttttggcctggtttcagcgaggagcctggacaaacgcccctaagtccctagtattcttttctggactcctacgtttgaagngtggacgtcccagcctaggttcaggcggctagtggttctggacactatttcactctcacactcgagcacgcctagcacggtcctggggtacgtacgtttccggtaccgtttaacctttaatttaaccgacggtaacccctaaactaacttttaaccgtttttacctttttttaaccgttaccggtttaaccgtttacgggtttttaccggggcccgggtaaacggggtaaccgtaacggtccggttaagggtacgtaacgtaacggtaaacggtaacgttcgggtacggtaccgttacggtaccctaacccgttagtttaccttaccgggtttcctttaaccgttaacccgtttccccgtttaccccgtacctttaaccgtttcgttaaccggtttactttaaccgtttacgtttaccgggttacggttccggggtacccggggttccgggtttaccgtaacgggtaaccgggtaccggtacgtaacgtaaccggtgg

SEQ ID NO: 288869 - DNA, 769 bp, Homo sapiens
  misc_feature: GYAE6OF01A095R.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctcttcgtttccccggtgccaggtgtgacatcgagatcgacccagtcctccgtcctcactgtctgcgtctagtggggacagtacgtcaccatccacgttcggccgggacgagtcgaccgtaactagtttaggttactttttcggcctttaggtttcagtccgaggacgccgtagggaccaaaccgtcccccgttaagtccccgttagtactttccgttttccggacggtacttcccgtaacgttttacggaaggtacggttcgggaaccgtacccgtacgacccgttaagggttaccgagggccggtacgtagggtttcggttccggtacggggtaactaaccgttaactttcccgaaccttccgttaacccaccgtaacgtaccaacggtccgtacgccgttacgccgtacgtacccggtaggtaacggtacgtttccgacttaacgttattaccgacgtaacctaaacgttaatttaccttttacttttaaccgtaccgttaacgtttacggttttaccggacggaaccgggttaacacgggtactacgggtaaacgtacgttaaaccggaaagggtccgttaggtcggtaccgtacgacccgtaaaccgtcgttactccggtttacctacccttccggttacccccg

SEQ ID NO: 288870 - DNA, 694 bp, Homo sapiens
  misc_feature: GYAE6OF01C7N87.44.75.G09.1.454.CMB.1.raw
  modified_base (624)..(624): a, c, t, g, unknown or other
  misc_feature (624)..(624): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggacgccgtggacaaagcccctaagtccctgattctttctggatccaactttgaaagagtgagtcccagccaaggttcagacggcagtggtctgggactacagtttcacttctcaacctatacaggaccagcccgtgctacgcccgttagggacttaattttccgacggtaactttacgttaccgtgtaaccccaaataaaactttcgtttaacctttttttaacgtacccgttaacgtttaacgggtttttacggaacccgtaacgggggtaactaaacggtacgttagggtaagtaagttaacccgtaaaagggaaacccgttggtacggtacgttcggaacctaacccgtaatttccgtacggtttccttactacgtttaccgttaccccggaccttaaccggttntaccgtattaacttattaacgttcgtaccgtaggtacggacggtcgttacggactaacgggcgtctaagg

SEQ ID NO: 288871 - DNA, 699 bp, Homo sapiens
  misc_feature: GYAE6OF01AQHHB.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaacgcccctaagtccctgtacttcttttctggacttcctactttagaagtagtggacgtcccgagcctaggttacaggcggctaggttcggttcgtagggactacgtactttcgactcctcaccatcaagcacgtcctgaccacgtccgtaggtacgtactttcggacgtaactttacgttacctacgtaaccctaaacgttaactttacgttttaccttttttaacgtacccgttaacgttacggttttacgggtacccggtaacggggtaaccctaacggtccgttagggtaacgtaacgtacgtaaaacggtacgtggtacggtacgtacgacgaccgtacttcgttacgttaccttcgttaaccttcccgtacccgtccgtaacttcgtagtaacttacgttaacgttacgttcggttaccgacgggtacggtcgggtaacgttcgggaacggacggtcgtcgtaacgg

SEQ ID NO: 288872 - DNA, 703 bp, Homo sapiens
  misc_feature: GYAE6OF01D0D41.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgtattctttctggactcctactttgaagaggtggacgtcccagccaggttcagcggcaggtggttctgggacactatttcactctcacctatcagcagcctgcacgcctaggagtacgtttcgcgtactttacttacgtcgacctaaactaattactttaccttttttaactacccgttacttacgttttacgggtacccgtaacggggtaacctaacggtcgtagggaacgtaacgtaaccgaaaacgggtaccgttagggtacggtcgtacggacctaaccgtaacttccgttacgtttccttaccgttactttccccgttaccccgtaccctacgttacctacggtaactttaaacgttacgtttaaccgttacggttccggttacgggtaccgggttacccgggggtaccggttaccggggtaaccggtaaacggggtcccggtacgtaacggg

SEQ ID NO: 288873 - DNA, 754 bp, Homo sapiens
  misc_feature: GYAE6OF01AKSZZ.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttggccgggcgagtgccgactattaggtacttttttggccttggtttcagcaggacgcctggacaaacgtcccctaagtccctagtacttccttttctggtactcctactttaggaagaggtcggacgtcccgacgcctaggttcacggcggactaggtggttcgtacgggactactacgtttcacgtcctaccgacctataccagccgtacgtccgtcgaccgtacggtcccgtaggacgttacgtttccggtacgttaacgtttactttaccgtacgtaacccgtaaacttaactttacttttacttttttaaccgtacccgttaacgttacgggttttcgggacccggttaacggggaaccctaacggtaccgtagggtaacgtaacgtaacggaaacggtaacgttcgggtacggtaccgtacgtacccgtaaccgtacgttccgttaccgtttaccttaccttacccgttcccgttaccccgtaccttacttcgtaacgttaacttacgtaaccgttacgttcgttcgtacgggtaccggtccgggtacgtaccgggaaccggtaacgggtcggtacgtaacg

SEQ ID NO: 288874 - DNA, 651 bp, Homo sapiens
  misc_feature: GYAE6OF01APSZD.44.75.G09.1.454.CMB.1.raw
  modified_base (348)..(348): a, c, t, g, unknown or other
  misc_feature (348)..(348): n is a, c, g, or t
  modified_base (355)..(355): a, c, t, g, unknown or other
  misc_feature (355)..(355): n is a, c, g, or t
  modified_base (616)..(616): a, c, t, g, unknown or other
  misc_feature (616)..(616): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagccgtggcaaacgcccctaagtcccctgtattccttttcgtggtactcctacttttggaacgaggtggacgtcccaggtccctaggttaccaggccggctaggtggttccgtggacactatttccacttcncgacctntcacgcagccctgccagtccgtggacgtactttccggacgtactttataccgtcgaccctaaactaatttacttttaccgtttttactaccggttaacttacgggttttccggaccggtaaccggggtaacctaaggttacgtacgggagtaacgtaacgaaacggtacgtggtacgtcgtcgacctacctacgttctcgttccttactaccttcccgtcccgtactaacgtctagtaacttacgttactacgtcgttcgnggtacggcggtaccggtggaccggtagccgtgtag

SEQ ID NO: 288875 - DNA, 593 bp, Homo sapiens
  misc_feature: GYAE6OF01D9PG0.44.75.G09.1.454.CMB.1.raw
  modified_base (272)..(272): a, c, t, g, unknown or other
  misc_feature (272)..(272): n is a, c, g, or t
  modified_base (566)..(566): a, c, t, g, unknown or other
  misc_feature (566)..(566): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggccttggtttcagcaggagcctggcaaacgcccctaagtccctgattcttttctggatcctactttgaagngtggacgtcccagccaggttcagcggctaggtggttctgggacactatttcactctcacatcagcagcctgcagccgtagggaactatttcgacgtactttaattacacgtaccaaaataactttactttccttttttaataccgtttaactaggttttacggccggtaaggggacccaagtccgttaggaacgtaagtaccgaaaggtaactggtacgctacgcactattcgttcgtacctttcacgttcctaccctcgtaacttctacgtattaatacttaatggtctaggnggccggtcgtcggacgacggcgcgtag

SEQ ID NO: 288876 - DNA, 742 bp, Homo sapiens
  misc_feature: GYAE6OF01BNMXX.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatcgacccagtcctccgtcctcactgtctgcgtctagttgggacagacgtcaccatcacgttcggccgggcgagtcgaccgaactagtttacggttacttttttcggccgttggttcagcgaggacgccgtaggacctaaaccgtccccttaacgtccccgtagtacttttccgtttttcgtaggtacttaccgtaacgttttggaaacgtaggttcggaaccgttcccgaagccgtaaggttccgaggcggtacgtaggttcggttcgacggactacgttactttccactcctaccacctatcacgctacgccgtacgacgtacgtccgtaggtaacgttcgttacggacttaactttacgtacctacgtaaaccctaattaacttttcttttacgtttttacgtaccgtttaacgttcggttttaccgggacggttaacggaacgtacggtacgtaacggtaacgtaacgtaacggtaaggtacgttacgggtcgtacgtacgaccctacgtaccttcgttacgttacccttacctacttccccgtaccgtacctacttctacgtaactttactaccgtttatacgtcggttaggacggtcgggtacgtacggaacggcggtcgagtacg

SEQ ID NO: 288877 - DNA, 699 bp, Homo sapiens
  misc_feature: GYAE6OF01A5KTS.44.75.G09.1.454.CMB.1.raw
  modified_base (177)..(177): a, c, t, g, unknown or other
  misc_feature (177)..(177): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (390)..(390): a, c, t, g, unknown or other
  misc_feature (390)..(390): n is a, c, g, or t
  modified_base (694)..(694): a, c, t, g, unknown or other
  misc_feature (694)..(694): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttggccgggngagtgccgactattaggtacttttttcggccttggtttacaggcaggacgccgtggaccaaacgccccttaagtcccctgtacttcttttcgtggacttccgtatttaggaagtagtggacgtccccgagccgtaggttcacggcggcgtaggttggttaccgtgggacctactacgtttcacctcctcaccngtcacgacncgcctcggacncgccgtaggtgtacgtttcgaccgttactttacgttaccacgtaaccctaaattactttactttttacctttttaacgtacccgtttaacgttaggtttacgggacccggtaacggggtaaccaggtcggtaaggtacgtaacgttaacggaaaggtacgtacgggttcggacttacggacctaaccttactcggttaccttccgtttaccgttaccttccccggttaccgtccttacttcgtacgtacttaattaccgtacgttcgtcgcgggtacggcggttacgcgggtaaacgcggtcgngtacg

SEQ ID NO: 288878 - DNA, 664 bp, Homo sapiens
  misc_feature: GYAE6OF01DSEJC.44.75.G09.1.454.CMB.1.raw
  modified_base (278)..(278): a, c, t, g, unknown or other
  misc_feature (278)..(278): n is a, c, g, or t
tcagacagtatatacacgaccggtgctcgatttagtatagacatcagggacttaggggctttgccaggctcctgctgctctgtttccccggtgccaggtgtgacatcgagatgacccagtctccttcctccctgtctgcttctataggagacagagtcgccatcacttgccgggcaagtcagaccattaacagctatttaaattggtatcagcagagaaccgagggaaacgcccctgaacctccgtgatctctgctgcctccactctgcgaaggtggngtctcttcgaaggtttcagtggcgtgtggagtcgtgggtacagtactttacacctctccacctacttcctcctagttctgtaccgtaacctagaacgttatttcgacctaactttactactcgtaacaacgtagtaagtttactacgtccgtccccgtttattaccggtttggggtaccggggtaacctaaggtccgttagggtaactagttaacccgtaaaacgtacggttaggtacggtactacgtaccgtaaccctacttccgtttacgttacctttccgtacctttcccgttaccccgaccttacgtaccttaggaacttttacttaaccgttccttacgggttcgttacgggacggacccggggttgtacggggtacccgg

SEQ ID NO: 288879 - DNA, 560 bp, Homo sapiens
  misc_feature: GYAE6OF01B5RK7.44.75.G09.1.454.CMB.1.raw
  modified_base (255)..(255): a, c, t, g, unknown or other
  misc_feature (255)..(255): n is a, c, g, or t
  modified_base (459)..(459): a, c, t, g, unknown or other
  misc_feature (459)..(459): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggacaaacgcccctaagtccctgattcttttcnggactcctactttgaagagtggacgtcccagccaggttcagcggcagtggtctgggacactatttcactctacaccatcagcacgcctgcagcctggactatttcgcgtactttatactagaccaaatattatttctttttatccgttattagtttcggccgaagggacctaagcgtaggatatacgaaacggtacgtggtcgntcgacacctatcgtgttcttacattcccgtcccgactactctagtacttatacttagtcgttcgtaggtacggcgggtctacggacgacgggtcgagtaag

SEQ ID NO: 288880 - DNA, 714 bp, Homo sapiens
  misc_feature: GYAE6OF01EL7QG.44.75.G09.1.454.CMB.1.raw
  modified_base (711)..(711): a, c, t, g, unknown or other
  misc_feature (711)..(711): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttgggacagagtcaccatcacgttggccgggcgagtcgccgactagttaggtacttttttggccttggtttcagcgaggacgccgtggacaaaccgccccttaacgtcccctagtactttccttttcgtcggacttacctacgtttaggaaggtaggtcgggaccgttcccgagtacccgtaggttcgacggcggtacgtaggttcggttacggtacgggacctacgtacttttaccaccttcctacctaaccgtactacgacgtaccacgtccgtacgcgacgtcgtaggtacgtacgtttccgacgttaactttaacgttaccgtacgtaacctaacttaactttactttttaccttttttacgaccgtttaacgtttacgggtttaccggaaccgggtaacgggtaacccgtaagtcgtaacggaagtaacgtaacgtaaaggtacgttggtacgtcgtcgacctacgtactcgtcgttacctatccttccgtacccgtactcgttactactaagttacttacgttctgtccggtagccggtcggtctacgggacaaggtcgntag

SEQ ID NO: 288881 - DNA, 713 bp, Homo sapiens
  misc_feature: GYAE6OF01BWCXL.44.75.G09.1.454.CMB.1.raw
  modified_base (294)..(294): a, c, t, g, unknown or other
  misc_feature (294)..(294): n is a, c, g, or t
  modified_base (309)..(309): a, c, t, g, unknown or other
  misc_feature (309)..(309): n is a, c, g, or t
  modified_base (321)..(321): a, c, t, g, unknown or other
  misc_feature (321)..(321): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaagcccctaagtccctgattcttttctggatccatttgaagagtggatcccagccaggttcagcggnaggtggttctggacnctatttcactcncacatcagcagcctgcagtcctggacgtacttttcgaccgttaactttattaccgtagaccctaaataactttactttaccgttttttttaactacccggtttacctttaaggtttttacgggtacccgtaaacgggggaaccctaacgggtacttacggggaacgttaacgttaaacccggtaaaaagggttaacccgttaggggttacggtaccgttacgtaaccctaacccgtacgtttacccgtttcggtttaccctttacctaccgttacccgtttccccgtaccgtacgtttaccttaggttaactttaacgttaacgtttacgttacggttcgtacggtaccggtccgggtaccgttacgggacgtaaccgggcggtactaacgg

SEQ ID NO: 288882 - DNA, 710 bp, Homo sapiens
  misc_feature: GYAE6OF01BX3BE.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttggccgggcgagtcgccgacattaggtacttttttggccttggtttcagcaggagcctggacaaacgtccctaacgtccctagtacttcttttcgtggtactcctacgtttagaaggtagtggaacgttcccacgtccgtaggttcaggcggactaggttcggttcgtcgggactacgttcttcacctctacaccatcgagcacgctcgacacgtctggtactcgtttccgacgttactttacttactcgaaccaaactattacgttttactttttacttacccggttaagtttacggtttacggtaccggtaacggggtaacctaacgggtccgtaagggtaacgtacgtaaacggaaacgggttaacgttcgggtacgggtacggtacgaacccgtacctaacgtttccgttacgtttcctttacgttaacccttccccggtttccccaaccttacgttacgttacgtaacttaagttacgttacttcgttacgtaggtacgggtccgggtctacgggtacgaacggtccgtaagtacgg

SEQ ID NO: 288883 - DNA, 617 bp, Homo sapiens
  misc_feature: GYAE6OF01C6JXI.44.75.G09.1.454.CMB.1.raw
  modified_base (248)..(248): a, c, t, g, unknown or other
  misc_feature (248)..(248): n is a, c, g, or t
  modified_base (277)..(277): a, c, t, g, unknown or other
  misc_feature (277)..(277): n is a, c, g, or t
tcagacagtatatacacgaccggtgctcgatttagtatagacatcagggacttaggggctttgccaggctcctgctgctctgtttccccggtgccaggtgtgacatcgagatgacccagtctccttcctccctgtctgcttctataggagacagagtcgccatcacttgccgggcaagtcagaccattaacagctatttaaatggtatcagcagagaccagggaacgcccctagaactcctgatctcngctgcctccactctgcaaggtgatctctnaagttcagtggcagtggatcgtagggacagtattcactctccacactcctccagtctgaccaactgaagttatttcgacctaactttactactcgtacaactagtattactactccgtacccgtttctacggttttcgggacggggtacctaaggccgtagggacgtacgtaaccgtaaacgtaccgttggtaccggtacgtacggacctacccgtattccgttcgttaccgtttacgtaaccctttcccgttaccccgaccttacgttaccgttagtaactttaacttaacttaccgttacgtccggttaggacgggtccgggtcgtacgggtaaccgg

SEQ ID NO: 288884 - DNA, 886 bp, Homo sapiens
  misc_feature: GYAE6OF01D7RMJ.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagatcacatcacttgccgggcgagtgccgactattaggtacttttttggccttgggtttcagcgaaggacgccgtacggacaaacggaccccctaaggtcccctaggtactttcgtttttaccgtggtacttaccctacttttaggaaacgtaggttcggaaccgttcccaaggcctaagggtttcaacgggtccggcctagggttcgggtttcggtacgggggacctaaccttaattttcccgtaaccttcctcccgtaaccctaaggttcccaagcccgtaacgccccgtcggaacgacggtcccgtaggggtattaaccgttttccgaacggttacttttaactttaccgtcgtaaacccaaacttaaacttttactttttaccgtttttttacctacccgtttaccgttaaggtttttccgggacccgggtaaggggtaacctacgggtacggtacgggtaagaacgttaaaccgggaaacggtaacgttaccgggtgttaaccgggtcgaaaccctacccggtttacttccggtttcccgttttaacccgttttacctaaccctttttccccggttttccccccggaaaacctttccttcccgggttaaagttacctttaaaccgtttagtttaacccgggtttccgtcccgggttaagggttacgggacccggggggtttacgaccccggggttaaaagaccccggggggttacgccggggttaaag

SEQ ID NO: 288885 - DNA, 699 bp, Homo sapiens
  misc_feature: GYAE6OF01EV0HJ.44.75.G09.1.454.CMB.1.raw
  modified_base (258)..(258): a, c, t, g, unknown or other
  misc_feature (258)..(258): n is a, c, g, or t
  modified_base (271)..(271): a, c, t, g, unknown or other
  misc_feature (271)..(271): n is a, c, g, or t
  modified_base (338)..(338): a, c, t, g, unknown or other
  misc_feature (338)..(338): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaacgcccctaagtccctgattcttttctggntccactttgaagngtggagtcccagccaggttcagcggcaggtggttcgtgggacacattttccacttctcaccatcgancacgcctgcacgctggactagtttcgacgtaactttattacctgaaccctaaactaaatttacttttacctttttttacgtaccccgtttaacttaacgggtttttcggacccggtaacggggtaacccgtaaacggtccgttagggtaacgtaacttaaccggaaaaagggtaccgttacgggtcggtaccgttcggacctaacccgtaagttaccttcggtttcctttacctacctttaccccgttaccccccgtctacctttacgttacgtaaactttacgttaaactttcgtttaccggttcgttacgggaggtacccggggtcgtacggggtacgtaacggggccgtacgtaaagg

SEQ ID NO: 288886 - DNA, 787 bp, Homo sapiens
  misc_feature: GYAE6OF01DRRH3.44.75.G09.1.454.CMB.1.raw
  modified_base (179)..(179): a, c, t, g, unknown or other
  misc_feature (179)..(179): n is a, c, g, or t
  modified_base (705)..(705): a, c, t, g, unknown or other
  misc_feature (705)..(705): n is a, c, g, or t
tcagacagtatatacacgaccggtgctcgatttagtatagacatcagggacttaggggctttgccaggctcctgctgctctgtttccccggtgccaggtgtgacatcgagatcgacccagtcctccgtcctcactgtctgcgtctagttggggacagagtcacatcacgttggccgggngaggtcgccgtactagttaggttacttttttggccttggttcagcgaggacgcctaggaccaaacgtccccttaagtccctgtacttcgttttcagtactccgttacttaggaaggtaggtacggacgtacccaggtccgtaggttacgacggtccggagttaggttacggtttaccgtaggggtaacctactaactttcctaaccttctaaccaacctactacgaacggtctaaccgtcctacggtaccgacggtaccgttagggaacgtttcttaccggaccgttaaactttacgttaccaacggtaacctaaacttaacgttttacttttacgtttttaaccgtaccgttaaggtttaccggtttacgggaacccggtaacgggtaaccaacgttaccgtaggaacgtaacgtaaggaaacggtacgtcggtacgtcgtacgaacctaacctcgttacgttcgttacctaccgtacctttccgtaccccgaacttaccgttcgtaaacgtattaaaccgtttntaaccggtttacgttcgggttaacggacccggttcggggtaaccggtacgggtaaacccgggtaacgacgtaccgtaaaggg

SEQ ID NO: 288887 - DNA, 642 bp, Homo sapiens
  misc_feature: GYAE6OF01A6WDW.44.75.G09.1.454.CMB.1.raw
  modified_base (347)..(347): a, c, t, g, unknown or other
  misc_feature (347)..(347): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttggccgggcgagtgccgactattaggtacttttttggccttggtttcagcaggagcctggacaaacgcccctaagtccctgtacttcttttctggacttcctactttgaaagtagtggacgtcccaggtccaggttcagccggctaggtggttcgtgggactactatttcactctcacntcagcacgcctgcagcctaggagtatttcgactactttattactacgtaccaaacgtaattactttcttttttactccgttacttaggtttacggaccgaacggggtaccaaggtcgtaggacgtaataaccgaaaaggtacgtggtcggtctacgactacctacttcttcgttacctttcttaaccttccccgttccccgtactacgttacttacggtaattaacgttacttaccgtttcggttacgttacgggacggtcgggtacgtcgggaacgtacgggtcctacgtaacg

SEQ ID NO: 288888 - DNA, 791 bp, Homo sapiens
  misc_feature: GYAE6OF01EO2J0.44.75.G09.1.454.CMB.1.raw
tcagacagtatatacacgaccggtgctcgatttagtatagacatcagggtacgttaggggctttgccaggctcctgctgctctgtttccccggtgccaggtgtgacatcgagatgaccctagtctccgtcctcgactgtcgtgcgttctagttggggacagtagtcaaccatcacgttggccgggcgagtcgccgactatttaggtactttttggccttaggttcagccaggacgcctggacctaaaccgtccccttaagtccctagtacttcgttttactacgggacttccgtaacgtttaggaaggtacggttagggaccgtcccgaagacctacggttcacggccggacgtaggttcggttcgtacgggaactacgttaatttccacttcctacgtaccatcacgtacctcgccgtgaccgtacgtaccgtagggtacgtaacgtttccgaacggttaactttaacttaaccgacgtaaccgtaaacttaaactttactttttacctttttaacgtacccggtttacgttaacgggttttacggaaccggtaacggggtaacctaagggttccgtaagggtaacgtaacgtaaaccggaaaagttaacggtggtacggtacgtacgtaccgtaaaccgtcgttaccgttacgtttaccgttacctacccgttcccgttaacccggtaccttcggttaacgttaccgtaagtttaaacgttcgtttaagtccggttacgtacgggtacggtccgggtacggtacggaacccgtacgggactaccgtaag

SEQ ID NO: 288889 - DNA, 686 bp, Homo sapiens
  misc_feature: GYAE6OF01CNO8A.44.75.G09.1.454.CMB.1.raw
  modified_base (255)..(255): a, c, t, g, unknown or other
  misc_feature (255)..(255): n is a, c, g, or t
  modified_base (347)..(347): a, c, t, g, unknown or other
  misc_feature (347)..(347): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtctcactgtctgcgtctattggggacagagtcaccatcacttgccgggcgagtcgccgacattaggtacttttttggcctggtttcagtcaggagcctggcaacggccctaagtccctgactcttttacnggtatcactttagaagtagtggacgtcccagcctaggttcagcggtactaggttcgggttctgggacctacgtatttccacgtctcaacctntacagcacgtcctgccaaggtccgtgggaacgttcgttacgacggtaactttaacgtaccgtcgaacccgtaaagttaacttacttttacgttttttaacgtaccggtttaaccttaggttttacgggacccggtaacggggtaaccgtaagtccgtaggtaacgacttacgaaacggtacgtggtacggtactcggtacctacgtactcgtttacgttctttaccgtaccgtttccgttccccgacgttaactccgttaagtacttacgttacttacgtacggttccgtacgggtcggtacgggtaccttacgggaccgtaacgggtcgtacgtaacg

SEQ ID NO: 288890 - DNA, 739 bp, Homo sapiens
  misc_feature: GYAE6OF01DENXZ.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacgttggccggcgagtcgaccgactagtttaggtacgttttttcggccgttggtttcagcgaggacgccgtaggaccaaacgtccccttaagtccctagtacttcgtttcgtgtacttccgtaacgtttaggaaggtaggtcggacgtcccgacgtccgtaggttcgacggcgacgtggtcggtcgtacggactacgttcttcactctacacatcagccacgtcctgacgacgcgtaggacgttacgttcgacgttaacttagttacctacgaactaacttaatttacttttactttttaacgccgttaacgtttcgggttaccggacggtaacggacctaaggtccaagggtacgaaacgtaaaccgaaaggtaccgttgggtaccgacgtacctaaccgaaccgtttgtacctttacggttacccgttaaccttccccgttacccgttaccccgacctttagttaacgtacggtaaacttttaacgtaccggtttacttacgggtacccgttcggggtaacccgggttacgggtacgtacgggaacggttaaccggtaccggaattacgggg

SEQ ID NO: 288891 - DNA, 816 bp, Homo sapiens
  misc_feature: GYAE6OF01BG4WU.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtcctccgtcctcactgtctgcgtctagtggggacagagtccaccatctacgttcggccgggcgagtcgaccgactagttaggttacgttttttcggccgttggttcgagcgaggacgtccgtaggacctaaccgacccctaacgtcccgtagtactttcttttcgtcggtacttcctacgtttaggaaggtaggtcggtacgtcccgaacggtccgtacggttacgacggcggtacgtaggttcggttacgtcgggaactacctacgtttaccacttcctaccacctagtaccacggacgaccgtccgtacgaccgacgccgttaggtacttaccgttccgaacgttaccttagtaccgtacgtaactaacttattttactttcttttaacgtcgtttacgttacgggtttacggaccggtaacgggtaaccgtaagggtcgtaacggtaacgtaacggttaaacggtaaacggttacggttacgggccggttaccgttaaccgtccgtaaccgtcgtttccgtaccgttttaccgttaccgtttacctttaaccccccggtaccgttccgtaaccgtttacccggttaacttaacgttaagtttaacctttaaccggttcccgggttaacgtaccggggttaccgggtcccgggttaccgggtacgggaacccggttacgcgggttaaccgtaagg

SEQ ID NO: 288892 - DNA, 753 bp, Homo sapiens
  misc_feature: GYAE6OF01E3CGH.44.75.G09.1.454.CMB.1.raw
  modified_base (229)..(229): a, c, t, g, unknown or other
  misc_feature (229)..(229): n is a, c, g, or t
  modified_base (269)..(269): a, c, t, g, unknown or other
  misc_feature (269)..(269): n is a, c, g, or t
tcagacagtatatacacgaccggtgctcgatttagtatagacatcagggacttaggggctttgccaggctcctgctgctctgtttccccgggtgccaggtgtgacatcgagatgacccagtctccgtcctcactgtctgcgtctagttggggacagagtccaaccatccacttcggccgggcgagtgaccactatttaggtactttttcggcttggtttcagcgagganccgtacggacaaacgcccctaagtccctgtattctttcgngtactcctacgttgaagacggtgactcccaggtcctaggtcaggcgcgtaggtcggtacgtgggactactagtttccaacttccttccgaactacgtacgacgtccacggccttagaccgtcggccgtagggacttacgttcggtaaccttacgtttacttaccgactaacctaaaactaacgttttacttttaccgttttttaaccgtaacccggtttacgtttaacggtttaccgggaccggtaaacggggtaacctaacgggttcgtaacgggtaagttaaccgtaacggtaaaacggtaccggttaggtaacggtccgtacgtacctaccgttaagttccttacgttacccgttctaaccgtttccccgtcctaaccgtcttaccgtacggtaacttacgttaaccgttacgtaccgttcggtaacgggtaccggggcccggtaacggtacgggaacccgtaacggggtctaaggtaacg

SEQ ID NO: 288893 - DNA, 601 bp, Homo sapiens
  misc_feature: GYAE6OF01DXBTI.44.75.G09.1.454.CMB.1.raw
  modified_base (508)..(508): a, c, t, g, unknown or other
  misc_feature (508)..(508): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggacgcctggaccaaacgcccctaagtcccctgacttcttttctggtactcctactttgaagtagtggacgtcccagcctaggttcagcggcaggttggttcgtgggacacgtatttccactctaccaccatcacgtcagcctgctacgccgtaggtagtactttcgaccgtaactttatacctcgacctaataacttatttacctttttactaccgttacgttaggtttcggaccgtagggacctaagtcgtaggagtataacgaagtacgtgtaggctacgctaaccgtnttcttcgttcttacctacttcccgttccctctactcttgattagtacttatcgttcacgggtgaccgggtcgtacggacgacggtgagtaacg

SEQ ID NO: 288894 - DNA, 564 bp, Homo sapiens
  misc_feature: GYAE6OF01EARF8.44.75.G09.1.454.CMB.1.raw
  modified_base (259)..(259): a, c, t, g, unknown or other
  misc_feature (259)..(259): n is a, c, g, or t
  modified_base (308)..(308): a, c, t, g, unknown or other
  misc_feature (308)..(308): n is a, c, g, or t
  modified_base (316)..(316): a, c, t, g, unknown or other
  misc_feature (316)..(316): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgacatttaggtacttttttggccttggtttcagcaggagcctggacaaacgcccctaagtcccctgattcttttcnggactccactttgaagagtggagtcccagccagttcagcgcagtggtcngggacacntttcactctcacatcagcagcctgcacgcctggacgtatttcgcgtactttatactcgaccaataattatttctttttaactccgttactagttttcggaccgtagggtacctaaggtctagggaagtactacgaaaggtactggtgctgacacctatctgttcttctacttccttcccgctactctagtattagtacttactcgtcgtcggtacggacgggtcgtacggtacgaacggtccgctaag

SEQ ID NO: 288895 - DNA, 931 bp, Homo sapiens
  misc_feature: GYAE6OF01DS0QX.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatcgacccagtctccgtcctcactgtctgcgtctagttggggacagacgtcaccatcacgttgccgggcgagtgaccgtactatttacggtacgttttttcggccttggtttcaggcgaggacgtccgtaggaccaaaaccgtcccctaacggttccctaggtactttcgttttacggtacggtaccttacctaacgttttaggaagtacggtcggaccgtacccacggtccgtaacgggttacgaggtccgggacttaacgggtttcggggttccgtaagggggtaccttaactacttttacccaccgttaccttaccaaccttacgacgtaacgaccggtaccgtccgtacggccgaacggtccggtaggtacgttccggttaccggtaccgtttaactttactttacccggtacaaacccttaaagttaaacttttacgtttttaaccgtttttttaccgtaacccggtttaacggtttaccgggttttaaccggggacccgggttaaacgggggtaaacccttaacggggtacggtttaaccgggaagttaacggtaaacggtaaaccgggttaacggttccgggtttacggtacgtaccgtaccgtaaaccgttaccggttcgttaccggtttaccctttaccgttaacccgtttccccggttaaccccgaccgttaaccgtttagttacccggttaaattaaccgtttaaaccgttttaccggttacggtttaccgggttacggggtaaccggggtacccgggggttccgtaacccggggtaacggtaaaccggtcccggttaaataaaccgggg

SEQ ID NO: 288896 - DNA, 853 bp, Homo sapiens
  misc_feature: GYAE6OF01BUOIE.44.75.G09.1.454.CMB.1.raw
  modified_base (271)..(271): a, c, t, g, unknown or other
  misc_feature (271)..(271): n is a, c, g, or t
tcagacagtatatacacgaccggtgctcgatttagtatagacatcagggacttaggggctttgccaggctcctgctgctctgtttccccggtgccaggtgtgacatcgagatgacccagtcctccgtcctcactgtctgcgtctagttggggacagacgtcaccatctacttggcccggggcgagtcgccgtactagtttaggtacttttttggccttggtttcagcaggagcctggacaaacgcccctaagtccctgtacttcttttcgnggtactccgtactttacggaaggtaggtcggaccgtcccgacggaccgtacgggtttccgacgggtccgggtacgtacggggtttgggtttaccggtcggggaaacctaccgttaccgttttccacctttaccctacccaacccgtagttcccaacggccctaaccgggcccgttcgaccggtaccgacccgggttagggaaccgtttacttttccgggaccgttaacttttaacttacccgtacggtaaacctaaaccgttaaattttactttttaaccgtttttttaaccgttaccgggtttaaccgtttacggggtttttaccgggacccggggttaaacggggaaccgtaacgggtccggttaacgggacttaacggtaaaccgtaaacgggtacgtttacgggtacggtccgtaccgtaaccgtacccgttaagttccgttattcccgttaacttcccgttcccgttacccgacccttattaccgttacgttaaacttacgttaccgttacgttacggttccggtacggtaccggggcgggttacccgagggtaccccggaggtacccgacgtaggg

SEQ ID NO: 288897 - DNA, 728 bp, Homo sapiens
  misc_feature: GYAE6OF01A6CLR.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggacgcctggacaaacgcccctaagtccctgtacttcttttcgtggtactcctactttaggaacggtaggtcggaacgtccccgaaggtcccgtaggtttaccaaggccggtcgtagggttcggtttccggtgggactactacgtttccaacttcctaccaccactcgacgacctacgtccctggaccacggcccgtaggacgttacgtttccggtacgttaactttaacgttaccgtacgtaacctaaacgtagttaacttaaggtaactttacgttctacgttaggttacggtttacggaccggtaacgggaacctaaggtccgtagggaacgtaacgtaacgaaacgtacgtaggtacggtcgtacgacctaccgtacgttccgttacggtttactttaccggtaccttcccgttacccgtacctagttaccttacggtacttaacgttacttacggttacgtcggttacggacgggttccggtacggtacgggtacggtacgggtacg

SEQ ID NO: 288898 - DNA, 724 bp, Homo sapiens
  misc_feature: GYAE6OF01ANNCI.44.75.G09.1.454.CMB.1.raw
  modified_base (132)..(132): a, c, t, g, unknown or other
  misc_feature (132)..(132): n is a, c, g, or t
  modified_base (154)..(154): a, c, t, g, unknown or other
  misc_feature (154)..(154): n is a, c, g, or t
  modified_base (173)..(173): a, c, t, g, unknown or other
  misc_feature (173)..(173): n is a, c, g, or t
  modified_base (218)..(218): a, c, t, g, unknown or other
  misc_feature (218)..(218): n is a, c, g, or t
  modified_base (719)..(719): a, c, t, g, unknown or other
  misc_feature (719)..(719): n is a, c, g, or t
tcagacagtatatacacgaccggtgctcgatttagtatagacatcagggacttaggggctttgccaggctcctgctgctctgtttccccggtgccaggtgtgacatcgagatcgacccagtcctccgtcctnactgtctgctctatgggacagngtcacatcacttggccggngagtcgccgtacagtttaggtaccttttttggccttaggttccancgtacggagccgtggaccaaacgtcccctaagtcccctgtacttcttttcgtacggattaccgtactttacggaaggtaggtcggtacgtacccgagtcccgtaaggttcacggtcggtactcgggttcgtttaccggtaggtaccctactaggtttacctaccttcccgtacctacccgtaatccaacggtccgtacgtcccgttacgcggtaaccgtccgtaaggtacgtacgtttccgacttacgttactaccgtacggaactaacccgttaattccttttacttttaacgtcccttaaggtttacgtttacgggccgtaaccgggttacagtacgtaggtaacgtacgtacggtaaacgttacgcggtacggtccgtacgtaccctaactcggttacctacgttaccgtacttcccgttacccgtacctacgtcttaccgtattacgttaccgtcgtcgtacgtgcccggtagtcccgtaggacgacggtctaacgntacgg

SEQ ID NO: 288899 - DNA, 721 bp, Homo sapiens
  misc_feature: GYAE6OF01AQT81.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcacatcacttgccgggcgagtgccgactagttagggtactttttttgggccttggttttcagcagggacgcctggccaaacgccccctaagtcccctgtacttctttttcgtcggtatccctacttttagaaggtagttgggacgtcccagtccgtaggttcacggcggactaggttcggttcgtgggactacgtatttcacgtctaccacactcagcagcctgacagccgtaggatagtttccgcgtactttacttacctgtaccctaaactaaatttactttacttttttactaccgttacttacgggttttcggtaccggtacgggtaacctaaggtaccgttaggggaactaacgtaacggtaaacgggtacgttagggttacggtcttaccgggacctaccgtacttacgttcggttaccctttactaccgtttccccttacccggacccttacttaccgtaacgttaacttaacgtttacgttaccgttcggttcgttacgggtacgggttacccgggggtacttacggggaaccggacggtaccggtacgttaacgg

SEQ ID NO: 288900 - DNA, 829 bp, Homo sapiens
  misc_feature: GYAE6OF01BD4TK.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagtggggacagagtcaccatcacttcggccgggcgagtcgcccgactagtttacggtactttttttcggccttggtttcacgtcgaggacgtccgtggaccaaacgccccttaacgtccctgtacttcttttcgtaggacttcctacgtttaggaaggtaggtcggtacgtccccgaggcccgtaaggtttccaggtccggactaggttcgggtttccgtacgggtaacctactacgttttcccacttacgtaccgaaccgtactaccgagtccgtacgtcccgtaggaccctacggtcccgtaggtaacgttaccgtttaccggacgttaacctttacgttaccgtacggtaaccctaaacttaactttacgtttttacttttttaaccgtacccggtttacggtttaaccggttttccgggaaccgggttaaccggggtaaccgtaacggtcggtaacgggtaacgtaaaccgttaaccggtaaaacgggtaccgttacgggttccggcgtaccggtaacctaacccgtacgtttaccgttacgttacccgttaccgttcccgttacccgttacccgtaccgttacttaccgttaggtaacctttaacgttacgtacgttacgttcggttacgggaccggttacccgggacggttaccggtacgggaaccggtcgtaaccgtag

SEQ ID NO: 288901 - DNA, 790 bp, Homo sapiens
  misc_feature: GYAE6OF01DNXE3.44.75.G09.1.454.CMB.1.raw
  modified_base (172)..(172): a, c, t, g, unknown or other
  misc_feature (172)..(172): n is a, c, g, or t
  modified_base (217)..(217): a, c, t, g, unknown or other
  misc_feature (217)..(217): n is a, c, g, or t
  modified_base (294)..(294): a, c, t, g, unknown or other
  misc_feature (294)..(294): n is a, c, g, or t
  modified_base (311)..(311): a, c, t, g, unknown or other
  misc_feature (311)..(311): n is a, c, g, or t
  modified_base (358)..(358): a, c, t, g, unknown or other
  misc_feature (358)..(358): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttgggacagagtcacatcactgccggngagtgccgacattaggtacttttttggccttggtttcagcgaggngcctggacaaacgccctaagtccctgacttcttctcgtcgactcctagttagagagtcgacgtccacgcgtagtcgngcggcgtaggttgtcgnggactacttattccactctaccaacctacgtcaacgccgacgtccgngccgaacggtccgtaggttacgttaccgttaccggtacgttaaacctttacttaaccgtcgtaaacctaaacgttaagttttaccttttaccgttttttaaccgtacccgtttaacgtttacgggttttacgggaacccggtaaaccggggtaaccgtaacggtcgttaggggtaaacgtaacgtaaaccggtaaacgggttaacgttacgggtacggtacgttaccgaaccgtaccgttaacgtttaccgttcggttaccctttacccgttaacccgtttccccttacccccggtcctttaaaccgttaccgtttaacggtaacttttaaaccgttaacgtttacccctttgggttacccggttaggggtaacccggggttacccgggtaccgggttacggggaaacccgggttccgggaaggtaaacccg

SEQ ID NO: 288902 - DNA, 734 bp, Homo sapiens
  misc_feature: GYAE6OF01EIFZ8.44.75.G09.1.454.CMB.1.raw
  modified_base (396)..(396): a, c, t, g, unknown or other
  misc_feature (396)..(396): n is a, c, g, or t
  modified_base (728)..(728): a, c, t, g, unknown or other
  misc_feature (728)..(728): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttggccgggcgagtcgccgactatttaggtactttttttggccttgggtttacacgcgaggtagcccgtaggacaaaaccgtccccctaaggtccccttagtacttcttttcgtggacttcctaactttggaagacggtcggactacccagccgtaaggttccgaagcggactagggttggttcgtagggactactatttaccacttcctacactactcgacgacgacnccgtagaccacgtccgtaggacttacgtttcgtaccgtaactttacttaccgcgaacctaaacttaatttacgtttttacctttttactaccggtttaacgttacggttttaccgaccgggtaacggggaacctaagggtaccgttagggaacgtaacgtaacgtaaacgggtaaacgttcggtaacggccctaggaccctaacgtacgtttcgttacccggtttacttacgttacccgttacccttaccccgaccgtaggttaccttacggtaattacgttacttacgtaggtcacgggtacggcgggtacgtacggaacgtacggacgtntaacgg

SEQ ID NO: 288903 - DNA, 590 bp, Homo sapiens
  misc_feature: GYAE6OF01E2BPL.44.75.G09.1.454.CMB.1.raw
  modified_base (310)..(310): a, c, t, g, unknown or other
  misc_feature (310)..(310): n is a, c, g, or t
  modified_base (400)..(400): a, c, t, g, unknown or other
  misc_feature (400)..(400): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacntttcactctcaccatcagcagccctgcagcctggatcttttcgacgtacttattacctgacccaaactaatttactttctttttttaacncccgttactaggttttgacccgaggggtacccaaggtcgtggagattacgaaaaggtactggtggctagcaacctattcgtgttacttctacttcccttcccgcctagttccttagtaattacgttagttaccttggttccgtacggacgggtccgggtcgttacgggaccgtaacgggccgtagtaacg

SEQ ID NO: 288904 - DNA, 728 bp, Homo sapiens
  misc_feature: GYAE6OF01A2Z1L.44.75.G09.1.454.CMB.1.raw
  modified_base (365)..(365): a, c, t, g, unknown or other
  misc_feature (365)..(365): n is a, c, g, or t
  modified_base (407)..(407): a, c, t, g, unknown or other
  misc_feature (407)..(407): n is a, c, g, or t
  modified_base (705)..(705): a, c, t, g, unknown or other
  misc_feature (705)..(705): n is a, c, g, or t
tcagacagtatatacacgaccggtgctcgatttagtatagacatcagggacttaggggctttgccaggctcctgctgctctgtttcccggtgccaggtgtgacatcgagatgacccagtctccgtcctcactgtctgcgtctattggggacagagtcaccgatctacgttgccggggcgacggtcgaccggaactagttacgggtactttttttgggacccttggggttttcaaggtccgagggtacgtcccgttaggaccgaaaacggtcccccttaaaggttcccctggtaactttctttttcgtaggtacttccgtacgttttaggaagtacgtgggtaccgtcccgagcccgtaggttccngggtacgcgtacgttggttcgtggacactacgtttcacttcnctacatcgaacgctagtcctagcacgtcctgggaagtacttccgacgttacttacgttactcgaaccaaattaactttacttttacgtttttaccttaccgtttacgttacggtttaccgggtccgtaaacgggtaccgtaagtacgttacggaagttacgtaacggtaaagtacgtaggtacgtgtccgtacgaccgtattacttaccgttcttaccgttacttacccgtacccgtccttaagtcccgtataccttagtacgtttacttaggttccgtacggtcggtaacggtccgngttaccggaacggtcgaggtacg

SEQ ID NO: 288905 - DNA, 719 bp, Homo sapiens
  misc_feature: GYAE6OF01CM1PG.44.75.G09.1.454.CMB.1.raw
  modified_base (227)..(227): a, c, t, g, unknown or other
  misc_feature (227)..(227): n is a, c, g, or t
  modified_base (266)..(266): a, c, t, g, unknown or other
  misc_feature (266)..(266): n is a, c, g, or t
  modified_base (708)..(708): a, c, t, g, unknown or other
  misc_feature (708)..(708): n is a, c, g, or t
tcagacagtatatacacgaccggtgctcgatttagtatagacatcagggacttaggggctttgccaggctcctgctgctctgtttccccggtgccaggtgtgacatcgagatgaccccagtctccgtcctcactgtctgcgtctagttggggacagagtcaccatcacttcggccgggcgagtcgccgactagttaggttacttttttggccttggtttcagcgagngcctggacaaacgccctaacgtccctgtacttctttcgnggtactccgtacttagaagtaggtggacgtcccaagtccgtaggtccaggcggtcgagttggtcgtggactactatttccactctaccactatcaacgccgactcctaggcgtacgccggtaggtaattacggtttcgccttaactttacgtaccgttaacgaacccttaaattaactttaactttttacctttttacgttacccgtttaacgttaccgggttttaccggacccgggtaacgggtaaacccgtaggtaccggtaggtaacgtagtaaacggaaacggtacgttacgggacgtacgtaaccgactaacccgttacttccgtttgtaccttacgttcccgttacccgtacctaccgtcgttacctaggttacttaaacttacgttaccgttacgttccgtcgggtacgggtccggtcggtacgacgggttaacncgtaggtaacg

SEQ ID NO: 288906 - DNA, 745 bp, Homo sapiens
  misc_feature: GYAE6OF01CIU7T.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatcgacccagtctccgtcctcactgtctgcgtctagttggggacagagtcaccatcacttggccgggcgagtcgccgactagttaggtacttttttggccttggttcagcagggacgcctggacaaacgtcccctaagtccctgtacttctttcgtggtactcctactttggaagtaggtcggacgtcccagccgtaggttcaggcggcaggttggtttcgtgggacctacgtactttccactcctaccacctactcgtaacgcacgtcctcggcaacggtccgtagggtacgtacgtttaccgacgttaacttttacttacctacgacctaaacgtaaacttttacttttacttttttaacgtacccgtttaacgttacgggttttacggacccggtaacggggaaccgtaacggtacgtacgggtaacgtaacgtaacggtaaaacgggtacggttacggtacggtacgtacgacgtaccctaacgttccggttctttaccgtttaccctactttccccgttacccgtaccttacttacgttacggtaactttacgtaagtttacccgttaggttccgttcgggtaccgggtcggggtaccggttagggaccggaacggtcggtaacgtacgg

SEQ ID NO: 288907 - DNA, 804 bp, Homo sapiens
  misc_feature: GYAE6OF01DPN74.44.75.G09.1.454.CMB.1.raw
  modified_base (270)..(270): a, c, t, g, unknown or other
  misc_feature (270)..(270): n is a, c, g, or t
tcagacagtatatacacgaccggtgctcgatttagtatagacatcagggacttaggggctttgccaggctcctgctgctctgtttccccggtgccaggtgtgacatcgagatgacccagtcctccgtcctcactgtctgcgtctagttggggacagagtcaccatcacttggccggcgagtcgccgactagttaggttacttttttggccttggtttcagcaggacgcctggactaacggtccccttaacgtccctgtacttcttttcgnggtactcctactttggaacggtaggtggacgtcccgtaggtcctaggttcaggccggtcgtaggttcggttcgtgggacctacgtatttccacttctccaaccgctcgacgtcacgtcctgcgcgtcccgtaggaagtcgttttccgacgttaacgtttaactaccggtactaaccccgtaaaattaacgtttacgtttttaccgttttttaacctacccgggttttaagtttaaccgggttttcgggaccccggttaaacgggggtaaacccgtaaacggtttccgggtaaggggtaaacgttacgtaaaaccgggtaaaacggggttaccggtttagggttaccgggtaacgttacccgggtaaccctaaccgttaacgtttccgttttacccggtttacctttaccggttaaccctttacccccgtttcccggacctttacgtccttaggttaaactacgtttacgttacgttaggttccggtaagggtccggcgggttaacgtacgggtaccgtacgggtccacgtaacg

SEQ ID NO: 288908 - DNA, 845 bp, Homo sapiens
  misc_feature: GYAE6OF01ECHQZ.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatcgaccctagtctccgtcctcactgtctgcgtctagtgggacagagtcacctatctacgttcggccgggcgagtcgaccgtactagtttacggttacttttttcggccttgggttacagcgaggacgccgtaggactaaacgtccccgtaagtcccctagtactttcttttcgaggtacttccgtacgtttaggaaggtacggtacggtaccgtacccgagtaccgtaggttacgacggtcggtcgttacggttggttccggtacggacctactacgtttcaacctcaccactactcgacgtacctacgcctacgacgtaccggtacgtacggtaacgttacgttcccggtaacgttaaccgtttacttaccgaccgtaaaccttaaccgttaatttttaccttttaacgttttttaccgttaacccggtttaaccggttttacggtttaccgggaacccgggttacgggtaaccgaacgggttacggtacggggtaaactaacgttaaaccggtaaaacgggttacgtacgggtacgggtaacctaccggtaaccgtaaccgttgtttaacccgttccgttaacccgtttacctttaccccggttaccccttcccgtaccgttaccgtacggtttaacgtaatttaaccgttaaccgttacttaccgggttcgtaaaccgggtcgggtcgggttaccggttaacgggccgggtaaacggtccgtaaaggtacg

SEQ ID NO: 288909 - DNA, 742 bp, Homo sapiens
  misc_feature: GYAE6OF01DWN7F.44.75.G09.1.454.CMB.1.raw
tcagacagtatatacacgaccggtgctcgatttagtatagacatcagggacttaggggctttgccaggctcctgctgctctgtttccccggtgccaggtgcgacatcgagatgacccagtctccgtcctcactgtctgcgtctagttgggacagagtcaccatcacgttgccgggcgagtcgccgactagtttaggtacttttttggccttggtttcagcgaggacgccgtggaccaaacgcccctaagtccctgtattcgttttcgtggtactccgtaactttggaaagtaggtaggaccgttacccagtcccgtaggttcacggccggcgtaggttcggttcgtacgggaacacgtactttccacttcaccacactcgagccacgcctgacacgtccgtaggacgttactttccgacgtaactttaacgttacctacgtaaccctaaactaaacttttcgttttaccttttttacgtacccgttaacgttacggtttttacggacccggtaacgggtaacctaacggtacgtacgggtaacgtaacgttaaacgtaaaacgggtaacgttagggtccggtacgttaccgaccgtaacctacgtttaccgtacgtttccttaccgttaccttacccttaccccggtacctattaccgttagtaacttacgttaaccgttacgttacggttcgacggttaacgggcccgggttcgtagggaaccggacggtccgtacgaagg

SEQ ID NO: 288910 - DNA, 717 bp, Homo sapiens
  misc_feature: GYAE6OF01D2CG9.44.75.G09.1.454.CMB.1.raw
  modified_base (617)..(617): a, c, t, g, unknown or other
  misc_feature (617)..(617): n is a, c, g, or t
  modified_base (628)..(628): a, c, t, g, unknown or other
  misc_feature (628)..(628): n is a, c, g, or t
  modified_base (633)..(633): a, c, t, g, unknown or other
  misc_feature (633)..(633): n is a, c, g, or t
  modified_base (655)..(655): a, c, t, g, unknown or other
  misc_feature (655)..(655): n is a, c, g, or t
  modified_base (660)..(660): a, c, t, g, unknown or other
  misc_feature (660)..(660): n is a, c, g, or t
  modified_base (673)..(673): a, c, t, g, unknown or other
  misc_feature (673)..(673): n is a, c, g, or t
tcagacagtatatacacgaccggtgctcgatttagtatagacatcagggacttaggggctttgccaggctcctgctgctctgtttccccggtgccaggtgtgacatcgagatcgaccccagtcctccgtcctcacctgtctgcgtctagttggggacagagtccaccatcacgttggccgggcgtagtcgaccgatagtttaggttacctttttttggccttcggtttccaggtcgaagggacgtccgtagggacctaaaaccggtcccccttaacggtcccctaggtacttttccttttcgaggtaccttccgttacgtttaggaaagtaggtcggacgttccccgacgaccgtaggttaccgaggtcggtcggttagggttcgggtttaccggtggggtaacctacgttacgttttacccactttcctacctacctactccgacgtacgaccgtccgtagcccgagtccggtgtaacgttcgtttacggaccgtttacttactacgtccgtaaccctaagttaactttacttttcctttttactccgtttacgttcggtttcggaccgtacgggtaacgacgtcgtagtacgtataacggaagtcgtcggagtcncgtaccacgtntcgtntctcttcctcctccctatcctntactnttacgttacgttntgtcgacggtcgggtaccggtcgaccggtagtacggtctgtacg

SEQ ID NO: 288911 - DNA, 773 bp, Homo sapiens
  misc_feature: GYAE6OF01C4Y99.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcacatcacttgccgggcgagtgccgactattaggtacttttttggccttggtttcagcaggacgccgtaggacaaacgacccctaacgtccctgactttcttttcgtaggtactacctacgtttaggaaaggtaggttacggaccgttaccccacggacccgttagggttaccgaaggccgggtacgtaggtttcgggtttccgtaggggaccttaacgtattttaccctaccttcctacctaaccacttacacgaccgacgtcccgtacgcgtacgcccggtagggtacgttacgtttaccgacgtaactttataccgtacgacctaaactaattacttttcttttacgtaccgttacgttacgtttacggaccgtaacgggacctaaggtccgtaggtaacgtacgtaaacgtaaaggacgttcgggtacggtaccgtacgaccgtaacctacgtttaccgttacgttacctttaccgttaccctttccccgttacccgtaacccttcttaccgttaagttaacttaacgtttaaacttaccgttacggttccggtaggtaccgggtaccgggtcggtaacggttaccgggaacggtcccgaagttaaacggg

SEQ ID NO: 288912 - DNA, 919 bp, Homo sapiens
  misc_feature: GYAE6OF01AS2UR.44.75.G09.1.454.CMB.1.raw
  modified_base (119)..(119): a, c, t, g, unknown or other
  misc_feature (119)..(119): n is a, c, g, or t
  modified_base (132)..(132): a, c, t, g, unknown or other
  misc_feature (132)..(132): n is a, c, g, or t
  modified_base (187)..(187): a, c, t, g, unknown or other
  misc_feature (187)..(187): n is a, c, g, or t
  modified_base (413)..(413): a, c, t, g, unknown or other
  misc_feature (413)..(413): n is a, c, g, or t
tcagacagtatatacacgaccggtgctcgatttagtatagacatcagggacttaggggctttgccaggctcctgctgctctcgtttccccggtgccaggtgtgacatcgagatcgaccngtctccgtcctcnctgtctgtcgtactagttaggggacagtacgtcaccatactcgttcggcccgggngtacgtcgcccgactagttaggttccttttttcggccgttggttacgcgacgtaggcgccgttggaaccgtaacctccccgttaaacgtcccgtgttactttctttcgtcggtatacccgttagtttaggaaggtaaggttccggtaccgttacccgacgtaccggttacggttacgccggtcggacggttcggtttcggtcgtacgggactaacctttgttaccnccttaccgtacctacccgattccgacgtaccgcggtccccttaaggcccgtagaccgggttcaacggtttaatcccgggtaatttaaccgtttaacggtttcacccgtttaaccaaacctttaaagttttttacctttttacgttttaaaccccgtttcgtttaacccggtttaacggtttaccggggttaaccccgtaaacggggtaaccgttaaacggggttccggtaggttaaaccggtacggttaaaaaccgggtaccgggtaaaacttcggggttacccggtacgtaaccgggtacctaaacggttccttacggtttaccttaccccgtttttaaacctcccttttaaaccccccggttcccttaaaccgggttttccccgtatttaaacccccgggttattaacccctttggttacccggtttagttagggacccccggttaacgggccggggttttaaacgccccgggggaaaacccggttctaacccgtaggtccccg

SEQ ID NO: 288913 - DNA, 795 bp, Homo sapiens
  misc_feature: GYAE6OF01BSTGZ.44.75.G09.1.454.CMB.1.raw
  modified_base (477)..(477): a, c, t, g, unknown or other
  misc_feature (477)..(477): n is a, c, g, or t
  modified_base (515)..(515): a, c, t, g, unknown or other
  misc_feature (515)..(515): n is a, c, g, or t
tcagacagtatatacacgaccggtgctcgatttagtatagacatcagggacttaggggctttgccaggctcctgctgctctgtttccccggtgccaggtgtgacatcgagatcgacccagtctccgtcctcactgtctgcgttctagttgggacagagtcaccatcgacgttcggccgggcgtagtcgccgacgtagttaggttacctttttttcggccgtttcggttttacaggtacgaacgggtacgtccgttacgggaacctaaaccggtacccccgttaaaccgtccccgttaggttaaccgtttttacctttttcggtcggtaaccttaccttaaccgttttaaggaaacggtaaggtcggtaacgtcccgacgtaccggtacggttacgacggcggtaccgtaggttcggttacggacggactacgttactttcacgttccactaccgtagtcacgctacgtctagaccgngtaccgtaggtactacgtttcgacttattacgttaccncgtaaaccttaactaattttacctttacgtttttacgaccgtttaacggttacgggtttaccgggtaacccggtaaagggtaaccgtacggtacggtaacggaacgggtttaaacaaccgggtaaagtaccggttggtacgggttacttaccgggaaccctaacgtacgtttccgtttacgttaccgttaccttaacgttcccctacgtaccttatcgttatacgttatacgttcgtacgtggaccgtagggcgtacggtagtaccgacggctaggtacg

SEQ ID NO: 288914 - DNA, 800 bp, Homo sapiens
  misc_feature: GYAE6OF01CX397.44.75.G09.1.454.CMB.1.raw
  modified_base (204)..(204): a, c, t, g, unknown or other
  misc_feature (204)..(204): n is a, c, g, or t
tcagacagtatatacacgaccggtgctcgatttagtatagacatcaggggaggaatcagacccagtcaggacacagcatggacatgagagtcctcgctcagctcctggggctcctgctgctctggctcccaggtcgaccaaatgtgacatccagatcgacccagtccttcccttaccacccttgtctgactatcgtggtagganaacagagtaccaccattccacgttcggaccggtccagtacagtagtattagttaggttggttcggctggtatcgacgcaacgaaaccgagggtaaacctacccctaaactcccgtagacttactaagtaaggactatacgttaagggtttacggtaaaggtccggggttaccctagtacgtaacggttcgacggaccggtaggtacggttacggaacgttcggaacggggtaacaacggtttaacgtccgtacttacctaccgtaaccgtacgtaccgaacgtaccgtaaccgtccggtacgtaccgtacggtacccgttacggtacgtttaccggtttaagtttttacggaaaccctttaaccgtttaacgtttacccgtaaccgttaacccgtaaaacgtaaccggttttaaagttaaaccgttagttttaaccgtttaccgtaacgtttacgggtttacgggttttaaccgggaacccgggttaaaccgggtaaccgtaacgggtaaccgttacggtaacggtaaaccgttaaccggtaaaaccgttaccggtacgggtaacggtaccgtaaccgtaccgtaccgttaaccgg

SEQ ID NO: 288915 - DNA, 713 bp, Homo sapiens
  misc_feature: GYAE6OF01AIVHK.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacgttgccgggcgagtcgccgacattaggtaccttttttggccttggtttcagcaggagccgtggacaaacgtcccctaacgtccctgtacttcttttcgtggtactcctactttaggaagtagtggacgtcccacggccgtaggttcgacggtccggcgtaggttcgggtttcgtcggggacctaccgtattttccacctcctaccaccctactcgacgccacgccgtgcacgtccgtaggacgttacgtttccgacgtactttacgttacctaccgacctaaactaatttacttttaaccttttttacgttaccgttaacgtttacggttttacggaccggtaacggggtaacctacggtcgtacggtaacgtacgtaacgaaacggtacgtaggtcggtcgtacgacctacctagttccgttcgttaccttccgtaccttccccggttacccctaccttacgtaccgttagttaacttacgttacgtttacgttcggttcgtgggtaccgggtcgggtcggtcggacggtacgggcgtgtaacgg

SEQ ID NO: 288916 - DNA, 886 bp, Homo sapiens
  misc_feature: GYAE6OF01CMHGZ.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctcgtttccccggtgccaggtgtgacatcgagatcgacccagtcctccgtcctcactgtctgcgtctagtgggacagacgtcacctatcacgttcggccgggcgagtcggccgacgtagtttacggtttacgttttttcggtccgtttggttttacgacggtacgacgggacgtcccgtacgggacccgaaaccggtcccccgtaacgttccccttcgtactttccttttcgtacgtacttaccgttacgtttaggtaaggtacggtcggtacgttacccgacggaccgttacggttacgacggaccggtacggtaggttcggttcggtacgggtactacttacgtttacccgtacctccgttaccacctacgtacgtacgctaccggtccttcggactaaccggtccgttaacgggtacgtttacggtttccgtaacgtttaaccgtttaacgttacccgttacctaaaccttaaaccgtttaaatttttaaccgtttttacccgtttttttaacgtaacccggtttttacggttttaacgggttttacccgggtaacccgggtaacggggtaacccgttaccgggttaccggtaacggggttaaacccggtaaaccgggttaaaccgggtaaaaacggggttaccggtttacggggtaaccggtttccccggttacccggtaaacccccgttaccgtttaacgtttaccccgggtttaccccttttaacccctttaccggttaacccccgttttccccccggg

SEQ ID NO: 288917 - DNA, 584 bp, Homo sapiens
  misc_feature: GYAE6OF01A6ZMM.44.75.G09.1.454.CMB.1.raw
  modified_base (376)..(376): a, c, t, g, unknown or other
  misc_feature (376)..(376): n is a, c, g, or t
  modified_base (491)..(491): a, c, t, g, unknown or other
  misc_feature (491)..(491): n is a, c, g, or t
  modified_base (498)..(498): a, c, t, g, unknown or other
  misc_feature (498)..(498): n is a, c, g, or t
  modified_base (579)..(579): a, c, t, g, unknown or other
  misc_feature (579)..(579): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctgggtttcagcaggagcctggcaaagcccctaagtccctgacttcttttctggatcctactttgaagagtgacgtccagccaggttcagcggcagttggttcgtgggacactagtttcacttctcaccatcagcagtcctgcagcctggagtatttcgcgtacttacttacncgactaactaatttactttactttttactaccgttacgttacggttttcggaccgtaacgggtaaccaaggtcgttagggataacgtagaaaggtacgtgtcggcagctaacctntaccgtnttaccttcttactccttcccactactctagtaacttactacgttactcgtcgaggtcggacggtcgtcggaacacgggtcngtacg

SEQ ID NO: 288918 - DNA, 701 bp, Homo sapiens
  misc_feature: GYAE6OF01DOMOP.44.75.G09.1.454.CMB.1.raw
tcagacagtatatacacgaccggtgctcgatttagtatagacatcaggggaggaatcagacccagtaaggacacagcatggacatgagagtcctcgctcagctcctggggctcctgctgctctgtttccccggtgccaggtgtgacatcgagatgacccagtctccgtcctcactgtctgcgtctagttggggacagagtcaccatcacgttggccgggcgagtcgccgactagtttaggttacttttttcggccttggtttcagcaggacgccgtggacaaacgcccctaagtacctgtacttctttttcgtggtactcctacgtttagaaggtaggtcggacgtcccagccgtaggttcaggcggcgtaggtcggttcgtagggactaccgttatttccacttccttaccaaccgattaccacgcacgtcccgtgccgtacgtcccggtagggtagtacgtttaccggaccgttactttaacttacctacgtaccctaaactaactttacgttttacctttttttacgtacccgtttaacgtttacgggtttttaccggaccggtaaccggggtaacctaacggtcggtacgggtaacaaggttaaccggtaaaggttaacgttgggtacgggttctacgtaccgtaacccgtacgttccgtttacgttcctttactacccgtttcccgttaccccccg

SEQ ID NO: 288919 - DNA, 748 bp, Homo sapiens
  misc_feature: GYAE6OF01B4Z59.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgactatttaggtactttttttggccttggtttcagcaggacgcctggacaaacgcccctaacgtcccctgtattcttttctggatcctactttgaagtagtcggacgtcccgagccgtaggttcaggcggcgtaggttggttcgtgggacctactatttccactctcaccatcagtcacgccctgcgacgccgtaggtacgtacgtttccgacgttacgtttaactacgtacgtaaccctaaactaacttttactttaccttttttacgtacccgtttaacgttacgggttttacgggacccgggtaaaggggtaaccccgtaaggtccggtaagggtaacgtaaacgtaccgggtaaaacggttaaccgtcgggttcggtaaccgttccgaacgtaacccgtacgttacgtttccgtttacctttacgttaccctttcccggttaccccgtaccgttacgtttccgtacgttaactttaacgtttaacgttaccgttcggtttaccggtacgggtacgggtaccggggttcggtacgggaaccgggtaacggtccgtaagtacgg

SEQ ID NO: 288920 - DNA, 794 bp, Homo sapiens
  misc_feature: GYAE6OF01EGAMS.44.75.G09.1.454.CMB.1.raw
  modified_base (175)..(175): a, c, t, g, unknown or other
  misc_feature (175)..(175): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggngagtgccgacagttaggtacttttttggccttggtttccagccaggacgccgtaggacaaacgcccctaagtccctagtacttcttttcaggacttcctactttgaagtagttggacgtcccagccaggttcagcggctaggtcggtttcgtgggaacactatttccactctccgaccactacacgtacgacgtcctcgacctacgccgtaggacgtacgtttcgtacggttaacctttattacctacgtaacccaaattaaacgtttaacttttaccttttttaacgtcccgtttaacgttacggttttacgggacccggttaacggggaaaccgtaaggtccggttaagggaagttaacgttaaacgaaaacgggtttaacgttacgggttacgtaccgtttagacctaacccgtaactttaccggttcgtttacccgttaccttacccgtttccccgtttacccccggtaccgttacctttaccgttacggttaaaccgtttaactttaaccgtttaacccggtttacggttacccggtttacggggacggggtaccccggggttacggttacccgggttaaacgggtaaccgggtcccggtaacgttaaaccggg

SEQ ID NO: 288921 - DNA, 777 bp, Homo sapiens
  misc_feature: GYAE6OF01ERZAL.44.75.G09.1.454.CMB.1.raw
  modified_base (206)..(206): a, c, t, g, unknown or other
  misc_feature (206)..(206): n is a, c, g, or t
  modified_base (294)..(294): a, c, t, g, unknown or other
  misc_feature (294)..(294): n is a, c, g, or t
  modified_base (770)..(770): a, c, t, g, unknown or other
  misc_feature (770)..(770): n is a, c, g, or t
  modified_base (775)..(775): a, c, t, g, unknown or other
  misc_feature (775)..(775): n is a, c, g, or t
tcagacagtatatacacgaccggtgctcgatttagtatagacatcagggacttaggggctttgccaggctcctgctgctgtggcctcccaggttcgagatgtgacatcgagatgacccagtctccttccttctgtctttcttctgttggacgtcagcgtacaccatctacgttcgccgggcgacgtcgtacggttcgttttgggcncttggttcgccgtttggtttaaccgaaaacggtaaaaagggggcgaccggtaccccgttaacggtcctcgtacttctcgtacgaaacncgtacgtagggaggtacgaccgtcccggtactaggtactaaggttccgacctacggtccgtagggtggtcgggacgtacgtcctacgttccactaaccgtagttacggcccgtacgtcggtaccggtactaaggtaaggttacttcggactacctttaaactttacgtttccacggttacacgggtaacttacggttacttaaccgtaacgttaccggtaccgtttccccggtttacgtttaccggtttaccggtaaccgggtaacgggtaaccgtaacggtacgtaacggtaacgtaaaccggtaaacgtaacggtacggtccggtaccgtaaccgtacctaaacgctttaccgtagttaccgtaccttacccgtacccgtttacccgtaccgtcgttacgtacgtaacttagttacttacgttcgttacgtcgggtcggtcgggtcggcggtaccgaaacggtccgagtaacgntaagntc

SEQ ID NO: 288922 - DNA, 697 bp, Homo sapiens
  misc_feature: GYAE6OF01E4M6U.44.75.G09.1.454.CMB.1.raw
  modified_base (118)..(118): a, c, t, g, unknown or other
  misc_feature (118)..(118): n is a, c, g, or t
  modified_base (185)..(185): a, c, t, g, unknown or other
  misc_feature (185)..(185): n is a, c, g, or t
  modified_base (578)..(578): a, c, t, g, unknown or other
  misc_feature (578)..(578): n is a, c, g, or t
  modified_base (618)..(618): a, c, t, g, unknown or other
  misc_feature (618)..(618): n is a, c, g, or t
  modified_base (623)..(623): a, c, t, g, unknown or other
  misc_feature (623)..(623): n is a, c, g, or t
  modified_base (630)..(630): a, c, t, g, unknown or other
  misc_feature (630)..(630): n is a, c, g, or t
  modified_base (649)..(649): a, c, t, g, unknown or other
  misc_feature (649)..(649): n is a, c, g, or t
  modified_base (658)..(658): a, c, t, g, unknown or other
  misc_feature (658)..(658): n is a, c, g, or t
  modified_base (667)..(667): a, c, t, g, unknown or other
  misc_feature (667)..(667): n is a, c, g, or t
  modified_base (687)..(687): a, c, t, g, unknown or other
  misc_feature (687)..(687): n is a, c, g, or t
tcagacagtatatacacgaccggtgctcgatttagtatagacatcagggacttaggggctttgccaggctcctgctgctctgtttccccggtgccaggtgtgacatcgagatgacccngtctccgtcctcactgtctgcgtctagttggggacagacgtcacatcacgttggccgggcgaagtcncctactagtttacggttactttttcggccttggttcgagcgaaggcgcctcggacaaaccgtcccctaacgtccctgtacttcgtttacgtggtacttccttaacgtttagaaggttacgtcggtacgtaccccgagtccgtaggttcgacggcggactaggttcggttcgacggactacgttacgtttccaaccgtttcctaaccgtacctacgttacccgaacgtccgtaacggtccccaggggtcccgtaacgggtacgttagggtacgtttccgtttaccggtaacgtttaccggtttaatttacccgaccgtaaactaacctttatttaccttttacgttttacttacccgttagttcgggtttacggaccgggtacggacgtaacgnggtagataacgaacgtaagtagtggtctacgcgactacgntcgtntccttcncgttcctcctctatcgtanacttacgtnttagctggnggtaccggcgtacgacggancgggctgtcg

SEQ ID NO: 288923 - DNA, 909 bp, Homo sapiens
  misc_feature: GYAE6OF01A1JHK.44.75.G09.1.454.CMB.1.raw
tcagacagtatatacacgaccggtgctcgatttagtatagacatcagggacttagggggctttgccaggctcctgctgctcttgtttccccggtgccaggtgtgacatcgagatcgacccagtcctccgtcctcactgtctgcgtctagttgggacagagtccacatcacgttcggccgggcgacggtcgaccgaactagtttacgggttaccgtttttttcgggaccgtttgggtttaccaggtaccggaacgggacgtccgtacggaaccgaaaaccgtcccccgttaaggttccccgtagttacttttccgtttttacgacggtaacttacccgttacgtttaggaaaggttacgggtacggtaccgtacccgacggtaccgtaagggttaccgacgggtccggtacggttacgggttcgggtttaccggtacgggtaaccttaacttacttttaccgaacctttcctaccaccgtaactaccgacgaccgtaccgtcccgtacggaaccgtacggtaccggttaggtaacgtttacggtttacccggacgtttaactttaccgttaaccgacgtaaacccttaaattaacgttttactttttaccgttttaacgtaccgtttacggtttaccggtttaccgggaacccgggtaaacgggtaaccgtaacggtcggtaaagggtaactaacgtaaaccggtaaacggttacgtggtaccggtactacccgtacccgtaacttacgttccgtttctttacccgttaaccgtttccccgttacccgttaccccgacctttacgttagttaccggtaatttacgtttcccgtaggtttacggttccgggtaacgggtaacccgggcccgggtttaggaccggtaaccgtacggggtacctaaggtaacg

SEQ ID NO: 288924 - DNA, 726 bp, Homo sapiens
  misc_feature: GYAE6OF01CTKF1.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgctctagttggggacagagtcaccatcacttcggccgggcgagtcgccgaactatttaggtacttttttggccttgggttcagcgaggacgcctggacaaacgtcccctaagtccctgtacttctttacgggtactcctacgtttagaagtgtcggacgtcccgaagccgtaggttcaacggcggactaggttcggtaccgtaggacctacgttactttccacttctaccaccctatcaacgcacggtcctacgcacgtacgtggactcgtttaccgacgtactttacgtaccgtcgaacctaaatactttacttttactttttacgtaccgttacgttacggtttcggaccggtaacggtaaccgtaggtaccgtagggaacgtacgtaaacggtaaacggtacggttacgggtacgtccgtaacgtaaccctaccgttaacttccggtttaacgttcctttaccgttacccgttaccccgttcccgtaccgttactccgttaacttaacttaacgttacgttacgtaccgttcggtaaccggtcgggtaccggtacgtacgggaaccgtaacgcccgtaaggtaacg

SEQ ID NO: 288925 - DNA, 671 bp, Homo sapiens
  misc_feature: GYAE6OF01BQQU6.44.75.G09.1.454.CMB.1.raw
  modified_base (155)..(155): a, c, t, g, unknown or other
  misc_feature (155)..(155): n is a, c, g, or t
  modified_base (301)..(301): a, c, t, g, unknown or other
  misc_feature (301)..(301): n is a, c, g, or t
  modified_base (590)..(590): a, c, t, g, unknown or other
  misc_feature (590)..(590): n is a, c, g, or t
tcagacagtatatacacgaccggtgctcgatttagtatagacatcagggacttaggggctttgccaggctcctgctgctctgtttccccggtgtcaggtgtgacatcgagatgacccagtctccgtcctcactgtctgcgtctattggggacagngtcaccatcacttgccgggcgagtgccgactattaggacttttttggcctggtttcagtccaggagccgtggcaaacgcccctaagtcccctgattcttttctgatccactttgaatagtggagtcccagccaggttcaggcggtnagttggttctgggacacctagtttcactctcctacctatccaggtcacgtccctgccgaagtcctagggataagttttccggacctacgtttacgttactcggtaacctaaacgtaaacttagtttaccttttttacgtaccgtttaaccgttagttttcgggacccgtaacggggtaaaccaacgtaccgtaggaagtacttaaccggaaaaggtacgttaggtcggaccgttacggaccaaccgtattacccgtttagttccgtttacctaacgtttcccgtacccnccttaagtcctaggtaacttacgtacttaccgttacgtcgtaacggagtaccgggtctccgggtagacgggtcgacgtacg

SEQ ID NO: 288926 - DNA, 835 bp, Homo sapiens
  misc_feature: GYAE6OF01C2323.44.75.G09.1.454.CMB.1.raw
  modified_base (830)..(831): a, c, t, g, unknown or other
  misc_feature (830)..(831): n is a, c, g, or t
  modified_base (833)..(833): a, c, t, g, unknown or other
  misc_feature (833)..(833): n is a, c, g, or t
  modified_base (835)..(835): a, c, t, g, unknown or other
  misc_feature (835)..(835): n is a, c, g, or t
tcagacagtatatacacgaccggtgctcgatttagtatagacatcagggacttaggggctttgccaggctcctgctgctctgtttccccggtgccaggtgtgacatcgagatgacccagtctccttccttctgttcttcttctgttggaggcagcgtcaccatcacttgccgggcgagtcgtaggttcgttttcggtgcctgttgccttaggttacaaacggaaaaagggggcacgggaccccttaaggtcctcgtcctcgtcgtacgaaaccagacgtaggaaggtagtacgttccccgtactagggttcacgtcgaccctaggtccgagggtggggtcgggccggagtacccgacttctcccaacgttataccggtccgaccgttcgggccgtccgtaaggtaacgtaactttccgagtacccttaaagttttcgtttccttaggtaccacggtaacttacgggttaactaccgttaacggtttaaccgggttcccgttccccccggtttttaacgttaacccgggttttttcccggggaaccccggtaacggggggtaaaccccgttaaaggttaccggttaaaacggggtaaaacttaccggtaaaaaccgggttacgttacgggttacgggtaccgttacggtacccgtaaacctcggtttacccgtttaccgttttaccgttaccgttaacctttaccccggtttaccccgtaccgtttaacttaccgggttaacttaacgtttacgttaacgttaccggtttacgccgttagggacggttccgggaaggtccgggtagaacgggttcacgttaacggataggnngngn

SEQ ID NO: 288927 - DNA, 665 bp, Homo sapiens
  misc_feature: GYAE6OF01B0EGV.44.75.G09.1.454.CMB.1.raw
  modified_base (220)..(220): a, c, t, g, unknown or other
  misc_feature (220)..(220): n is a, c, g, or t
  modified_base (258)..(258): a, c, t, g, unknown or other
  misc_feature (258)..(258): n is a, c, g, or t
  modified_base (316)..(316): a, c, t, g, unknown or other
  misc_feature (316)..(316): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgactattaggtacttttttggccttggtttcagcaggngcctggacaaacgcccctaagtccctgtattcttttcnggactcctactttgaagagtggacgtcccagcctaggtcagcgcagtggtctgggacnctatttcactctacaccgatacagcacgtcctagcagccgtagggatactttcgcgtaactttacttacgtacgaccaaacttaattacttttacgttttttactcccgttacgttacggttttcgggaacccggtaacggggtaacccgtaaaggttcgtaacgggtaacgtaacgtaaccgaaaacgggtaacttacgggtcggaccgttagggaccctaacccgtattacccgttcgttccttaccttaccgtttccccgttacccgcctacgttcctagtacttaattaccgtacttcggtcgtggtagggtccgggtacggtcggacgtacgggtccgacgtag

SEQ ID NO: 288928 - DNA, 791 bp, Homo sapiens
  misc_feature: GYAE6OF01DGDF9.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgctctagttggggacagagtccaccatcacgttcgccgggcgagtgccgactagttaggtacttttttggcctggttcagcaggacgcctggacaaacgccctaacgtccctgtacttcgttttcgaggtactacctacgttttaggaaaggtaggtacgggtaaccgtccccgtaaggtacccgtagggtttccgaacgggcgggtaccggtagggtttcggggtttaccggtacggggtaaaccctacgtaactttttacccaacctttccgtacctaacctattccgacggaccacgtcccgtacggccaacggtccgtagggtacgtactttccgaccgttaactttagttacctcgtaacctaaactaatttacttttaccttttactacccgttaacgtttacggttttcgggaacccggtacggggtaacctaaggtcggtacggtaacgtacgtaaacgtaaacgggtacttgggtccgtacgtcgaccctaactacgtttcgttacctttcttccgttaacccttcccgttaccccgacttaaccttacggtattaattaaaccgtttaacttacggttacggttccgttacggggtaccgggtaccggggttctacgggtaccggaacggtcggaccgttaagg

SEQ ID NO: 288929 - DNA, 737 bp, Homo sapiens
  misc_feature: GYAE6OF01EVKPR.44.75.G09.1.454.CMB.1.raw
  modified_base (731)..(731): a, c, t, g, unknown or other
  misc_feature (731)..(731): n is a, c, g, or t
tcagacagtatatacacgaccggtgctcgatttagtatagacatcagggacttaggggctttgccaggctcctgctgctctgtttcccccggtgccagtgtgacatcgagatcgacccagtctccgtcctcactgtctgcgtctagttgggacagagtcacatacacttgccgggtacgagtcgccgactagttacggttacttttttcgggcccttggttttcgaagccgtagggaacgtcccgtagggacctaaaccgtaccccctaagtcccctagtaccttcttttcgtcggtacttcctagtttacgaaggtagttcggacgttacccgacgacccgtaggttacgacggtcggacgtggttcggtttacggtacgggaacctaacgttacgtttacctaaccttacctaccgtaacctaacggtactaaccggcgtaaccgtcccgttagaccgtaaccgtcggtacggtaacgtagtttaccgacccgtttacgtttaactttaaccgaccgtaaccaaacgttaatttaaccgtttacttttttacgtaccgttacgtttacggtttacgtaccggtaacgggtaaccgtagtcgtagagtaacgtacgtaaacgtacgtagcgtatcgacactacgtctacgtacttcgtacttccctcccgtctacgtcgtagtacttacgttactatacgtgtacgcggtaccgtcgaccggaggcgcgngtaacg

SEQ ID NO: 288930 - DNA, 685 bp, Homo sapiens
  misc_feature: GYAE6OF01BW4WT.44.75.G09.1.454.CMB.1.raw
  modified_base (371)..(371): a, c, t, g, unknown or other
  misc_feature (371)..(371): n is a, c, g, or t
  modified_base (667)..(667): a, c, t, g, unknown or other
  misc_feature (667)..(667): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttggccgggcgagtcgccgactattaggtactttttggccttggtttcagcgaggagccgtggacaacgcccctaagtccctagtacttcgttttacgtcggtactcctacgtttaggaagtaggtggacgtacccagccgtaggttacaggcggctaggttggttcgtgggtacacgtatttccacttctaccactactcgacnccgacgtccgtgccacgtaccggtagtacgtacgtttcgacggtttaactttataaccgtcgtaaacctaaactaaacttttacttttaccgttttttacgtaccgtttagttacgggttttcgggaaccgtacggggtaacctaaggtccgttaagggagtaacgtaacggtaaagtaccggtggtacgtactacgacctaacgtacttcgttcgttaccttaccttcgttcccgtacccgtcctagttcgtattaagttacgtacttgtacgttcgacggaaggtcccgggtanacggacgaggacgtctag

SEQ ID NO: 288931 - DNA, 878 bp, Homo sapiens
  misc_feature: GYAE6OF01ENKSW.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacgttgccgggcgaggtgccgacattaggtacttttttggccttggtttcagcaggacgcctggacaaacgcccctaagtccctgtacttcttttcgtggtacttcctacgtttttaggaaaggtacggttcgggtaacgttccccgaaggtacccgtaagggttttccgaacgggtccgggtacgtaacggggtttcgggttttccggtacgggggaacctaactactttttccaaccttccttaccaaccctacgttccgaacgccgtaacgcccgttaggacctaacggtcccttagggggaacgtacgtttttccgggaccgtttaaccttttaaagtttaacccgtacgtaaaacccttaaaaaaagtttctttttaaccgttttttttaaccgttacccggttttaacgtttacggtttttaacgggtaaccccggtaaacgggggttaaaccctaaacgggtacgttaacgggtaacggttaacgttaaccggtaaaaagggtaaccttcgggtacgggtaccgttcggaccgtaaccgtattacccgttacggtttccttacccgttaccgtttcccccgtttaccccgaccgttaaccgttcgttaaccggttaatttaacgttaacgtttaaccgttgttccgttagggtacgggtccggggtaccgttggggaacccgtaacgggaccgtacgtaacgtagg

SEQ ID NO: 288932 - DNA, 703 bp, Homo sapiens
  misc_feature: GYAE6OF01CV95S.44.75.G09.1.454.CMB.1.raw
  modified_base (335)..(335): a, c, t, g, unknown or other
  misc_feature (335)..(335): n is a, c, g, or t
  modified_base (662)..(662): a, c, t, g, unknown or other
  misc_feature (662)..(662): n is a, c, g, or t
tcagacagtatatacacgaccggtgctcgatttagtatagacatcagggacttaggggctttgccaggctcctgctgctctgtttccccggtgccaggtgtgacatcgagatcgacccagtctccgtcctcactgtctgcgtctagtggggacagacgtcaccatcacttggccgggcgagtcgaccgactagttaggtacttttttggccttggttcagcaggacgccgtaggaccaaacgcccctaacgtccctagtactttcttttcgaggactcacgttttaggaaggtagtggaacgtcccagccaggttcaggcggcgaggttggtcgnggactactacgtttaccactctacacctactacacgacctacgccgtacgcgacggtaccgtcgggtacgtacttttaccggaccggtaactttaacgttacgtactaaccccaattaactttaactttacttttttaacttaccgttacgttaggttttaccgggaccggtaaacgggtaacctacgggtacgtagggtaacgacgtaacgtaaaggaccggttagttaccgggtcttacgaccgtaacctaggtcccttaggttacccttcttacgttcccgttacccgcttaacgtcgttagtacttaacgtatacgttcggtntacgggtacggtacggtcgtacggacacggccgttagaacg

SEQ ID NO: 288933 - DNA, 888 bp, Homo sapiens
  misc_feature: GYAE6OF01E0VQB.44.75.G09.1.454.CMB.1.raw
tcagacagtatatacacgaccggtgctcgatttagtatagacatcagggacttaggggctttgccaggctcctgctgctctgtttccccggtgccgaggtgtgacatcgagatgacccagtctccgtcctcactgtctggcgtctagttggggacagagtccaccatcacttggccgggcgagtcgaccgtactagtttacgggttacttttttcggccgttggtttccgaggacgaacgggacgtccgttaggaaccaaaccgtaccccgttaaacgtccccgttagtactttccgtttttccgtacggtaccttccgttaacgtttaggaaaggtaggttacgggccgtaccccgacggtcccggtaaggttacgacggccggtagtacgggttcgggttcgttacgggacctacgttactttaccgacctacctacctaaccgtactcgaacgtccgacgtcctacggcccgacgtccgttacgggtagttacgtttccggtaacgttacctttacgtaccgtactaaacccgttaaattaacgttttaccgttttacttttacggtaccccgtttaaagtttcggggttaccggtaccgggtaaacgggtaaccgtacggtacggtacggtaacggtaacgtaaccggtaaacggtaccgttgggtaccgtacggaccgtacctacccgttaacgttccgtttacgtttacccttaccgttaccccgttacccgttaccccgggttaaccttacggttaacccgttaagttaaaccggttttccttaaacccgttttaagggttcccggttacgggtaaccgggttccgggtaacccgggtaccggtaccggggaacgtaaaccggggtcccgaaaggttacgg

SEQ ID NO: 288934 - DNA, 849 bp, Homo sapiens
  misc_feature: GYAE6OF01DD84Y.44.75.G09.1.454.CMB.1.raw
tcagacagtatatacacgaccggtgctcgatttagtatagacatcaggggaggaatcagacccagtcaggacacagcatggacatgagagtcctcgctcagcctccgtggggcctccgtgctgcttcgttccgtttccccggtgccaggtgtcgacatcgagactcgaccctagtcctccgtcctcactcgtctgtctcgttaggtcggggactaggtacgtccaccattcctacgttcggcccgggacgtacggtccgacccgtaactaggtttaggtttccgtttttcggccgtttggtttccaggtcgaggacgtccgtacggaaccgaaaccgtaccccttaacgttccccttaggttaccttttccggttttcgtacggtaccttaccgttagtttaggaacggtaggtacggtaaccgtcccgtacgtaccgtacgggttacagggccggttacgtacgggttcggtaccgtacgtactacgttcttacgtcgttcctaaccgtactcacgccgactccgtacgtccgtacgtaccggtaccgttaggttaccgtttaaccgttaccgttaaccgtttaactttaccgtaaaccccgtcgtttaaaacctttaaacgtttacctttttaaccgttttttccggtttaaccctaccgggttttttaaaccgggtttccgggttaaacccgggtaacccgggtaaccgttaaccggtacggtacggttaaacgtaacgggtaaaccttaaccggggtaacgttcggttaaccgggtcgtacccttaaacgtccttaccttaccggtttacttcccggtttaccctacccgtacccgtttcccccg

SEQ ID NO: 288935 - DNA, 780 bp, Homo sapiens
  misc_feature: GYAE6OF01DCU4J.44.75.G09.1.454.CMB.1.raw
  modified_base (172)..(172): a, c, t, g, unknown or other
  misc_feature (172)..(172): n is a, c, g, or t
tcagacagtatatacacgaccggtgctcgatttagtatagacatcagggacttaggggctttgccaggctcctgctgctctggctcccaggttcgagatgtgacatcgagatgaccaagtctccttccttcctgtcttcttctgttggagcagcgtcacatcacttgccggngagtcaggttcgttttcggtgtctgttcgccttggtttaccgaaaacgaaaaagggggacgacggtaccccctaaggtcctccgtcctcgtcgtagaaaccgagtacgtagggaagtgaccggtcccgtccgtaaggttccaaggttcgaccgaacgtccgagggtcggtcgggaccggactccgactcgtccaaccgtacgttaacgccgtaaccgtggccgacctaggaagtacttcgtcgtaccttaaactttcgtttcgtagttccgaacggtactaacgttacgtacgtaacgttacggttcccggtacccccgtttacgttaaccgttttaccgggaccgttaaaccgggggaccctaaaggtccgtaacggtaaaacgttaaccgaaaccggtaaccgttagggtaccggtaccgtaccggtacccgttaaccctacgggtttacctttacggtttacccgtttaccgttaaccgttcccccgtttacccggtaccttaacctttaccgtaggtaacttaacggttacttaccgttgtacccgtagggacggtcgggtacgtcggtaaccgacgggtaccgtaacgtacgtagccgtgacg

SEQ ID NO: 288936 - DNA, 860 bp, Homo sapiens
  misc_feature: GYAE6OF01CPWIM.44.75.G09.1.454.CMB.1.raw
  modified_base (479)..(479): a, c, t, g, unknown or other
  misc_feature (479)..(479): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagtgggacagacgtcacatcagttgccgggacgagtgcccgatagttaggtcctttttggcctggttcagcaggacgctggaccaaacgacccctaagtccctagtacttcgtttccgtaggacttacctacgtttagaaaggtggtacggtaacgcccgtaagtccgtaaggttcacggccggtgtaacggtttcgggtttaccgtacgggaacctacgtttactttaccgtaaccttctacccaacgttacgtaccgtaacggcctaacggccctagacccgaagtccggtaggtacgttaacggtttccgacggttaaacttacggtttaacnccggtaaacctaaacgttaacgttttacttttacgtttttaccgtaccggttttaacgtaccgggttttacgggaccggtaaacggggttaaccctaaagggtccggtaaagggtaacgtaaacggttaaccggaaaacgggttaaccggttggtacccgggtacgtcgggtaaaccctacccggttaaacgtttcccggttactttaccccgttaaaccttaacccggtttcccccgtttaacccccgggacccttaaaccctttcgggtaaacccgttttaataaacggttttacccgttaaacgttcggggttccgttaacggggaccgggttaccggggacggttacgggaacggaaccggttacccgaaggttaag

SEQ ID NO: 288937 - DNA, 673 bp, Homo sapiens
  misc_feature: GYAE6OF01CWLXJ.44.75.G09.1.454.CMB.1.raw
  modified_base (131)..(131): a, c, t, g, unknown or other
  misc_feature (131)..(131): n is a, c, g, or t
  modified_base (135)..(135): a, c, t, g, unknown or other
  misc_feature (135)..(135): n is a, c, g, or t
  modified_base (158)..(158): a, c, t, g, unknown or other
  misc_feature (158)..(158): n is a, c, g, or t
  modified_base (427)..(427): a, c, t, g, unknown or other
  misc_feature (427)..(427): n is a, c, g, or t
  modified_base (447)..(447): a, c, t, g, unknown or other
  misc_feature (447)..(447): n is a, c, g, or t
  modified_base (466)..(466): a, c, t, g, unknown or other
  misc_feature (466)..(466): n is a, c, g, or t
  modified_base (658)..(658): a, c, t, g, unknown or other
  misc_feature (658)..(658): n is a, c, g, or t
tcagacagtatatacacgaccggtgctcgatttagtatagacatcaggggaggaatcagacccagtcaggacacagcatggacatgagagtcctcgctcagctccgtgggctctgctgctctcgttcccgngccnggtgtcgacatcgagatcgaccngtcctcctcctctacttgtctcgtcgttactaggttggggacaggtacaccaccacgttacctaccggtcggcccgggtacgagtccggacctacgtagttttaggttttaccgtttttggccgtttggttcaggacgtaggctcccgtaggaacccgaaccgtaccccgttacgttcccgtggtttacctttccgtttttccggacgtacctttaccgtaggtttagaaggtcggtacgcctaccgacgtccgtaagtcgcgtacggngtcggttgcgtagaactctnttacctactcctacatacncgaagccgtaccgctcgacacggttcgaggttcctacgtcgtacttaccgttacggtacctacgaaccttatttaacttcgttttaactttctaccgttcggttagtacggtaccggtaagcccgttaaggcgttaagggtaatcgtaaacggacggtagtcgtcggcgtccaagttctaattcgtcccttnttcccgtctaccccg

SEQ ID NO: 288938 - DNA, 771 bp, Homo sapiens
  misc_feature: GYAE6OF01A0MCT.44.75.G09.1.454.CMB.1.raw
  modified_base (356)..(356): a, c, t, g, unknown or other
  misc_feature (356)..(356): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcacatcacttgccgggcgagtgccgacattacggtacttttttggcctggtttcagcaggacgctggcaaacgcccctaagtccctgtatcttttcgtggtatcctactttaggaagtagtggacgtcccgagtcctagggttaccagccggtcaggttcggttcgtacggacactagtttccaccgtctccacctacnccgacgcctacgcctgaccgtacgtccgtgggtacgttagttttaccgccggtaacttttaactaccgttaccgacccaaaacttaaactttactttaccgttttttaacgttacccgttaacgtttaggttttaccgggacccggtaagggggaacctaacggtcccggttaggaacccggttaataacccggttaaaacggtaacgggttccggttaagggtcccgtacgtaccccgtaacgtaacgttcccgttaacgttaccctttaccgtaacgtttccccttaaccccggccttaacgttaccccgtagtttaacccttaaggtttaacttacccgttacggttaccggttacggtaccgggtccgggttacgttaccggggaccgaacgggttacccggtagtaacgg

SEQ ID NO: 288939 - DNA, 849 bp, Homo sapiens
  misc_feature: GYAE6OF01DWM9O.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgactattaggtactttttggccttggtttcagtcgaggacgtccgtaggacaaaccgtcccccttaaaggtcccctagtactttcgttttcgtcggtactaccgttaactttggaaaggtaggttgggacgttccccgaaggtccgtaaggttcgaacggcgggtccgtaggttcgggttcgtaggggaacctacgttacgtttccaccttctaccaaccagttacacgccacgtcccgtagacgtacggtccggtagggtacgttacgttttccggtaacttaaccttttaacgttaccgtaccgtaaccctaaagttaaacttttaacttttttaccgttttttaacgttaccccgtttaaggttttaacggttttacgggacccgggttaaacgggtaacctaaaacgggttccggtaagggtaacgtaacgttaaaccggaaaacgggttacgttacgggtaggtacccgtttacgaacgtaaccgttaacgtttccgtttacgttacccgttttaccttacccggtttaccccttaccccgggtaaccttaacgtttacggttaaccggttaatttaaccgttaaactttccgttacgggttcgttacgggtacgggaccgggttcggtacgggtaaccggtacgggtcgtaacggtaagg

SEQ ID NO: 288940 - DNA, 741 bp, Homo sapiens
  misc_feature: GYAE6OF01EHO3G.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttgggacagagtcaccatcacgttgccggcgagtgccgactagttaggtacttttttcggccttggttcagcgaggacgccgtggacaaacgaccccttaagtccctgtacttcttttacgtgacttcctatttagaagtaggtggacttcccgagcccgtaggttcaggccggctaggtcggttcgtggggacactatttcacgtctcaccatcgagcacgcctagcagtccgtggaacgtactttcgacggttactttaatacctagacccaaacttaagtttacttttactttttacgttaccgttacgttacggtttttacggaccgtaacgggtaacctaacggtcgtaggtaacgtaacgttaacggaaaacgttacgtacggttaggtaccgtcgtaaccgaaccgtaacgttcccggtacgtttaccgttttacctacccggtttaccctaccccgggttacctaaccggttacttacgttaacccttaagttaacccgttttaccggtagtttaccgggttacgggtacggttacccgggggtacttaaccgggggaccgttaaacggggtaccgcggttaaacggg

SEQ ID NO: 288941 - DNA, 673 bp, Homo sapiens
  misc_feature: GYAE6OF01CCL0Z.44.75.G09.1.454.CMB.1.raw
  modified_base (262)..(262): a, c, t, g, unknown or other
  misc_feature (262)..(262): n is a, c, g, or t
  modified_base (380)..(380): a, c, t, g, unknown or other
  misc_feature (380)..(380): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttgggggacagagtcaccatcacttgccgggcgagtgccgactatttaggtacttttttggccttggttcagcaggagcctggacaaacggcccctaagtcctgtacttcttttcgnggactcctactttagaaggtagtgggacgtaccccgagcccgtaggttacgacgggccggacgtaggttcgggttcctacgggggacctacgtacttttccaacttcctacaccctancctagcacgcctgcagcgtggagtacgttcgacgtacttatactcgaacctaaactaacttactttactttttacgttaccgttacgtttggtttacggtaccggtacgggtaacgtaacggtcgtacggtaagtaacgtaacggtaaacggtacgttaggtcggtacgtacgactaaccgtactcggttcgttacgtttcctaccttccgttcccgacttacgtcgtagtactaattactacgttacgttcgtaggtacggccgggtacgtcgggtaggacggtcgatacgg

SEQ ID NO: 288942 - DNA, 704 bp, Homo sapiens
  misc_feature: GYAE6OF01CUJ4A.44.75.G09.1.454.CMB.1.raw
  modified_base (327)..(327): a, c, t, g, unknown or other
  misc_feature (327)..(327): n is a, c, g, or t
tcagacagtatatacacgaccggtgctcgatttagtatagacatcagggacttagggggctttgccaggctcctgctgctctgtttccccggtgccagggtgtgacatcgagatgacccagtctccgtcctcactgtctgcgtctagttggggacagagtcaccatcacttggccgggcgagtcgccgacattaggtactttttggccttggttcagcaggagcctagacaaagccctaaacgtccctgacttcttttactggacttcctactttgaagaggtggacgtccctagccgaggttacacgcggcagggttcggtttacncggggtaacactaacgtttcaaccttcactacccgatcaaggctacgcctgactagccgtgagtatttcccgagtacttaagttacctcggaacctaaactaaatttactttacgttttttacgacccgtttaacgttaggttttacgggtaccgaaacgggggtaacctaaacgggtaccgttaggggtaacgtaacgtaacgtaaaacgggtacgttagggtaccgggtactaccggactaacccgtattccgtacgttaccttacgtacttcccgttacccgacctattaccgtgtaattacgttacttagttacggtcgtacgggacgggtaccgggtaccgttagggaaccggtaacgggccgtaacgtaag

SEQ ID NO: 288943 - DNA, 839 bp, Homo sapiens
  misc_feature: GYAE6OF01AGG43.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttgggacagacgtcaccatctacttgccgggcgagtcgaccgatagttacggtactttttcggccgttggtttcagcgaggacgccgtggactaaccgtccctaacgtccctagtcttcgttttcgacgtacttacctagtttagaaggtaggtacggacgtcccgacgtccgtacggttcgacggcggtctacggtcggtttaccgtagggacctacgttacgtttacccgtacgttacctaccgtaaccgtacgttaccgaacgtaccgtaccggtcccgttacggaccgtaaccggtacccggttacgggtaacggttaccgttttccgggttaaccgttaaccgttttacttacccgttaccgtaaaccctaaacctttaacgttttaccgttttttaccgttttttaaccgttaacccggtttacgttttaaccggggttttacccggtaccggggtaacccgggtaaccgtaacggtccggtaaagtaaccggtaacgttaaaccggtaaacggtacggttacggtcggtaccgtacgaccggtacctacggttaccgttacgttttccgtaccttacccgttccccgtaacccgtacttacgtcgttaacgtacttaacgttaccgttgttacggtccggtagggttaccggcgggttaccggacgtaacggcgtcgtaacgtacgg

SEQ ID NO: 288944 - DNA, 576 bp, Homo sapiens
  misc_feature: GYAE6OF01AXOSZ.44.75.G09.1.454.CMB.1.raw
  modified_base (261)..(261): a, c, t, g, unknown or other
  misc_feature (261)..(261): n is a, c, g, or t
  modified_base (278)..(278): a, c, t, g, unknown or other
  misc_feature (278)..(278): n is a, c, g, or t
  modified_base (344)..(344): a, c, t, g, unknown or other
  misc_feature (344)..(344): n is a, c, g, or t
  modified_base (347)..(347): a, c, t, g, unknown or other
  misc_feature (347)..(347): n is a, c, g, or t
  modified_base (502)..(502): a, c, t, g, unknown or other
  misc_feature (502)..(502): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcagggagtcctggacaaaacgcccctaaagtccctgtattcttttcnggatccactttgaacgngtggactcccagcctaggttcaggcggctaggtggttctgggacactatttcactctacacatcancanctgcagctgactattcgcgtactatactgaacctaataattattacttttactaccgtacttagtttacggcgtaacgggacctaagtcgtacggagactaacgaaaggtacgtagtggtacacgacactactctgttactactactcctacccnctactctagtactaagttacttacgttcgttacgaggtacgtaccgggtcgtacggaccgacggtccgtatacg

SEQ ID NO: 288945 - DNA, 825 bp, Homo sapiens
  misc_feature: GYAE6OF01A61XG.44.75.G09.1.454.CMB.1.raw
tcagacagtatatacacgaccggtgctcgatttagtatagacatcagggacttaggggctttgccaggctcctgctgctcttgtttccccggtgccaggtgtgacatcgagatcgacccagtcctccgtcctcactgtctgcgtctagttggggacagagtcacctatcacgttcggccgggcgagtcgccgactagttaggttactttttcggccgttggtttcagcgaggaaacgccgtcggaccaaaccgtacccctaacgtaccctgtactttcgttttcgtcgtactccttacgttaggaaggtaggtacggtaccgtccgacgtccgtacggttacgcggtcggacgtggttggtcgtacggactactacgtttccactctaccactacacgacgaccgtaccgtccgtcgacgtacgtaccggttaggtaacgtttcgtttaccggtaaccgtttaaccgttttaactaaccgttaccgtaaacccttaaacgtttaactttttacccttttttaccgtttttaaccggtttacccggttttaaacggttttacggggttttaacccgggacccgggttaaaccggggtaaacccgttacggtaacggttaagggtaaaccgttaaacggtaaacggttaaacgggttaacgttccgggttaacgtcgtaccctaaccgtaccgttacgttcgtttaccgttaccgttaccttcccggttcccttacccgttcgtacgttactataaccgtttcgttaacgttcgttacgtcggtacggtcgggacggttcggaacgtaccgggactacggctaacgg

SEQ ID NO: 288946 - DNA, 708 bp, Homo sapiens
  misc_feature: GYAE6OF01B74YY.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttgggacagagtcacatcacttgccgggcgagtgccgactattaggtacttttttggccttggtttcagcaggagccgtggaccaaacgcccctaacgtccctgtattcttttcgcggtactcctactttagaaagtaggtcggacgtccccgagtcctaagggttccaaggtccgggacgtaggttcgggtttcgtacggggactaaccttactttccaaccgttcctacaccctaatccgacgccaacgtcctcggacgtacggaccgttggaacgttacgttttccggacgtaactttacgtttaacgtccgaacctaaactaattttacttttaccgttttttaacgtccgtttaacgtttcggtttacggacccggtaacggggaaccaggtaccgttaggaacgtacgtaacgtaaaacggtacgttcgggtacgtacgtaccgtaccaaccctagttccttacgttcctttaccgtactcccttacccgactacttcgtagtacttagttctacgttgtcgtggacggtcggtcgtcggaacgtcggtcgagtacg

SEQ ID NO: 288947 - DNA, 854 bp, Homo sapiens
  misc_feature: GYAE6OF01CM348.44.75.G09.1.454.CMB.1.raw
  modified_base (176)..(176): a, c, t, g, unknown or other
  misc_feature (176)..(176): n is a, c, g, or t
  modified_base (478)..(478): a, c, t, g, unknown or other
  misc_feature (478)..(478): n is a, c, g, or t
tcagacagtatatacacgaccggtgctcgatttagtatagacatcagggacttaggggctttgccaggctcctgctgctctgtttccccggtgccaggtgtgacatcgagatgacccagtcctccgtcctcactgtctgcgtctagttggggacagagtcacatcacttgccgggngagtgccgactattagggtactttttggcctggtttcagcaggagcctggaccaaacgccccctaagtccctgtaacttcgtttactggtactcctacgttttagaaaggtgtcggacgtccccgagtcccgtaggttaccagggcggtctaggttcgggttcgtacggggactacctaactttttcaaccggtcttccaaacctagttaccacggttcaaacccgtccgttgaaccgacggtcccgttaggggaaccttaacgtttttcccgacggtaaacttttaacctttaccggttanaaccccctaaaatttaaaacttacgttttttaacccttttttttaaccggttaaccccggttaagtttacgggtttttacgggaccccggtaaagggggtaacccaaacggttacgttaacggaagtaaacgtaaccggtaaaaagggtaacccttgggttaccgggacttaaccgggaccgtaaaccttacttaccggtttacctttacccgttaacttaacctttccccgttttacccccggaaccgttaacctttaccgttaaaggttaaacttaaacgttaccggttaactttccccgggttaattaaccggggacggttacccggggtacgttaacgggaacccggtaaaggttcccggaaccttaaacgg

SEQ ID NO: 288948 - DNA, 880 bp, Homo sapiens
  misc_feature: GYAE6OF01EK9TS.44.75.G09.1.454.CMB.1.raw
tcagacagtatatacacgaccggtgctcgatttagtatagacatcagggacttagggggctttgccaggctcctgctgctctcgtttccccggtgccaggtgtgacatcgagatcgacccagtcctccgtcctcactgtctgcgttctagttggggacagacgtccaccatccacgttcggccggggcgagtcgaccgactagtttaggttacttttttcggccttgggttacaggcgaggacgtccgtacggaaccaaaccgtacccccgtaacgtcccgttagtacttttccgttttacgtacgggtaacttacccgttaacgttttagggaaacggtagggttaccgggtaaccgtacccccaacgggtcccggttaacgggttaccgacgggtccccggtacggttaacggggtttccgggtttaccgggtacggggtaaccctttaaccgttacttttaccctacccgttacctaccctaaccgtacctacgacgtaccgacgtcccgtggaccgagtccgtaggtacgtttcggttccgtacgttaactttaacgttcccgaactaaaccaaactttaattttaccgtttttacgttttaaccgtacccgtttaggttcgtttaccgggaaccggtacgggtaacctaggtcgtaacggaagtaaacgtaacggtaaaacggttgtcgggtacctagtacccgtaccctaacgtttaccttaccggttccttttacgtaaccctacctttccccgggttaccctaacggttacttacggttaaataaccgtttaaacgttccggttacttacgggtttcgaaccggggttccggcggggttacgacccggaacggttaccggtcggtaagtacg

SEQ ID NO: 288949 - DNA, 782 bp, Homo sapiens
  misc_feature: GYAE6OF01D4VUF.44.75.G09.1.454.CMB.1.raw
  modified_base (419)..(419): a, c, t, g, unknown or other
  misc_feature (419)..(419): n is a, c, g, or t
tcagacagtatatacacgaccggtgctcgatttagtatagacatcagggactttaggggtcgtttgccaggctcctgctgctctgtttccccggtgccaggtgtgacatcgagacttcgacccagtctcccgtcctcactgtctgacgtctagttggggacagagtcaccatcacgttcgccgggcgacgtcgaccgatagttaggttacttttttggccgttaggtttcacgcaggcgccgtaggaccaaacgtccccgtaacgtccctgtacttcgtttcgtaggacttacctacgtttgaaaggtcggtacggaccgttaccccgaagtaccgtaggtaccacggccggtaccgtagggttcggttccgtgggtaaacctacgttaagtttccaccgttcctacaacctacgtcgngtaccacggtcctacgctacggtccgtagggtacgttaggtttcggaacgttactttaattaccggtaacgtaaccttaaaaccttagttttaaacctttttcctttttaacgttacccgtttaacgtttaacggtttacgggtaacccgggaacgggtaaccgtaacggcggttaagggtagtaaactaaccgggttaaagtaaccggtttggttacggtcgttacgaaccttaacctagttctttacggttactttctctccgttcccgacgtacttacgtacgttaattacgtaattacggttacgtacggtacgtacgggtaccggtacggtacgggaccggtaaacgcgtaacgtacg

SEQ ID NO: 288950 - DNA, 920 bp, Homo sapiens
  misc_feature: GYAE6OF01DLN1H.44.75.G09.1.454.CMB.1.raw
  modified_base (557)..(557): a, c, t, g, unknown or other
  misc_feature (557)..(557): n is a, c, g, or t
  modified_base (883)..(883): a, c, t, g, unknown or other
  misc_feature (883)..(883): n is a, c, g, or t
tcagacagtatatacacgaccggtgctcgatttagtatagacatcagggacttaggggctttgccaggctcctgctgctctgtttccccggtgccaggtgtgacatcggagatcgacccagtcctccgtacctcgactgtctcgacgttcttagttggggaactagacgtacaccatccgtacgttccggggaccgggtccggtaaggtcggacccgtaacgttaaacggttttacgggtttacggttttttttccgggaccgtttcggggtttaccgaccggacggtaacggggaccgtacccggttagggaaacccgtaaaacccggttacccccttaaccggttccccttaggtaaccttttcgttttcggtaccggtcttaccgtacttttagggaaaacgttcgggtaccggaaccgttccccggaacggtccggttaagggttcctaacgggccggtacgttcgggtttaggggtttaccggtaacggggtaacccctaacggtttactttaaccctaccgtttaccgtacccctaaccgtacgttaaacnccggtaacccggtcgtccgtaaacggtcccgaacggtttcccgggaaggttaaaccgttccggtttaacccgaacggtttacttttaaccttcgggaaacttaaccccgtaaagtttaacttttacggttttcccgttttaacgttacccggtttaacggtttaccgggttttccggaacccgggttaaacgggtaccgtaacggtcggtacggtacgtaacgtaaacggtaacggtacgtacgtcggtcacgtacgtcgtatacgttcctgtactaccgttaccttcctacgtacgttcgtacgtactagtactagtcggttacngggtaacgcgggtacgtaccggagtacgcgtagtacg

SEQ ID NO: 288951 - DNA, 921 bp, Homo sapiens
  misc_feature: GYAE6OF01DO360.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatcgacccagtcctccgtcctcactgtctgcgtactagttgggacagagtccaccatcacgttcggccggcgagtcgaccgtacgtagtttacggttaccttttttggccttggtttcagcgtaggacgccgtaggaccaaacgtcccgttaagtccctaggttactttccttttacggtacggtaaccttaccgtaagtttaggaacgacgggtacggtaccggttacccgaaccgtaccgttagggttccgaacgggtcccgggtgttaaacggggtttcgttacggtaaccggggtaacctaaccgttacgtttttacccgaaccgttcctaaccggaaacccctacggtttacgaaaccggtcgaaaccggtcccgttaaggaccctacggggtacccgttagggtaacgtttacgtttaccgtaaacgtttaacttttaaccgtaaaccgtaccgaaaccgttaaaacttaaatttttaccgtttttaacccttttttaccggtaaccgtttacggtttaacgggttttaccccggtaacccggggtaaaccgggtaacgttaaccggtcgggttaaacgggtaacgaaacggttaaaccggtaaaaccgggttacgttacgggtacccggtagttacccgaccccgttaacgtaaccttccggtttacggttacccttccgtaacctttccccgggacccttacgtacccttaggttacttaacgtttacgtaacgttacgttacggtcccgagggttaaccggaccgggacgtttacgggaaccctagggtcccgaaggttacg

SEQ ID NO: 288952 - DNA, 753 bp, Homo sapiens
  misc_feature: GYAE6OF01BUYSY.44.75.G09.1.454.CMB.1.raw
  modified_base (177)..(177): a, c, t, g, unknown or other
  misc_feature (177)..(177): n is a, c, g, or t
tcagacagtatatacacgaccggtgctcgatttagtatagacatcaggggaggaatcagacccagtcaggacacagcatggacatgagagtcctcgctcagctcctgggctcctgctgctctcgtttcccggtgccaggtgtgacatcgagatcgacccagtctccgtcctcacgtntctgcgtctagtgggacagagtcaccatcctacgtggccgggcgagtcgaccgatagtttacgggttacgttttttcggccttggtttcgacggtcgaggacgccgtaggaccaaaccggtccccttaacgtcccgtagtactttccgttttacgtggtaccttacccgttacttttaggaaggtacggttcgggtaccgttacccgacggtaccgtagggttcacgggcgtacgtaggttcggttacgcgggtaacctacgttaatttccgaccttcctacctaccctaagtcctaacggtccgtaacgtccctcggacgtaccgtacccgtagggaccgtttacggtttaccgtacgttaacgtttaaccgttaccgttacggaaccttaaacgttacgtttttaactttttccgtttttaacgttccgttaaccggtttacgggttttaccggaaccgggttaacgggtacccgtaacgtacgggttacggaaacgtagtaaccggtaaaggtaccgttgggacggtccgtacgaccttacggtactttgttaccttactcgtccttaccccg

SEQ ID NO: 288953 - DNA, 608 bp, Homo sapiens
  misc_feature: GYAE6OF01BGMA5.44.75.G09.1.454.CMB.1.raw
  modified_base (220)..(220): a, c, t, g, unknown or other
  misc_feature (220)..(220): n is a, c, g, or t
  modified_base (257)..(257): a, c, t, g, unknown or other
  misc_feature (257)..(257): n is a, c, g, or t
  modified_base (360)..(360): a, c, t, g, unknown or other
  misc_feature (360)..(360): n is a, c, g, or t
  modified_base (421)..(421): a, c, t, g, unknown or other
  misc_feature (421)..(421): n is a, c, g, or t
  modified_base (484)..(484): a, c, t, g, unknown or other
  misc_feature (484)..(484): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgactattaggtacttttttggccttggtttcagcaggngcctggacaaacgcccctaagtccctgattcttttcnggactcctactttgaagtagtggacgtcccagtccaggttcgaggcggcgtaggttggttcgtagggaccactatttcactctacaccatcagcacgcctgcncgctagggactacgtttcgactactttatacctgacctaaactatttatttactttttacnccgttactaggtttcggaccgtagggacaaggtctaggatataacgaaaggtactggtcgtcngtacactgttcgtcgttcttactacttcccgttacccgaccttactacttagtaacttacgttacgttacttcgtacgtaggtaccggtccgggtacgtcgggaacgtacggtcgtacgtaacg

SEQ ID NO: 288954 - DNA, 694 bp, Homo sapiens
  misc_feature: GYAE6OF01EP4D8.44.75.G09.1.454.CMB.1.raw
  modified_base (618)..(618): a, c, t, g, unknown or other
  misc_feature (618)..(618): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtcttagttggggacagagtccacatcacgttggccgggcgaggtcgaccgactagttacggttacttttttcggccttggtttcacggcgaggacgccgtggacaaaccgtcccctaacgtccctgtacttcttttcgaggtactccgtactttaggaagttggtacggacgtcccaggccgtaggttccgaggcggactacgggttggttacgtacgggactaccttactttccacctccgtacaccactacgacgcacgcctgccacgcgtgacgtcttccggatacttactacgcgaactaatattactttacgttttactaccgttacgtacgtttacggacccgtaacgggtaacctacggtcggtacggacttacgtaaacggaaacggttaggtcggtactaccggtaccgtacaaccttacttacgttcgttaaccgttccttaaccgtcccgttacccaaccgtttcgngttaaccgtattaacggtcttaccgtcggttagtacggaggtcccgggtacgttacggacgtaggaccgtgtaacg

SEQ ID NO: 288955 - DNA, 870 bp, Homo sapiens
  misc_feature: GYAE6OF01DA74D.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttggccgggcgagtcgccgactagttaggtacttttttggccttggtttcagcgaggacgccgtaggaccaaacgtccccctaacggtccctagtactttcttttacgtcggtactcctaacttttggaaaggtaggttcgggacgtccccaaggtcccgtaagggtttccaagggccgggactagggttcgggtttacggtacggggacctacgtacgttttccaccttcctaccaacctactaccgaaggcccaacgtcccgttggacccgacggtacccggttagggaacgttacgttttcggtaccggttaacttttaacgtttaccgtacggaaccctaaaacgtttaaactttaacgtttttcctttttttaacgtaccccgtttaacgtttaacggggtttttaccgggaccggttaaaccggggggtaaacctaacggtccgggttaacgggtaacgtaaacgtaaacccggtaaaagggtaaaccgtttcggggttacggtccgttaaccggacccgtaaccgttaacgttccgtttacgggtttccttaacccttaaccgtttcccccttaccccgggtaccttaaccgtttccgtaagttaactttaacgttaactttacggttacgttaccggtacgggtacggggttaccggtaccggtacggaacggaaccgggtacgtccgtaaaggg

SEQ ID NO: 288956 - DNA, 790 bp, Homo sapiens
  misc_feature: GYAE6OF01E3RUS.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctctgctgctctcgtttccccggtgccaggtgtacgacatacgagtactagaccccgtagtccgtccggtccctcacgttcgtcctcgtaccgttcgtagtttacgggggaactaggaacgttaccaccaattcctacgttcggcccgggtacgagtacggaccgacgtagtttacggttacgttttttcggccgttggtttaccgacgtcgtaggaacgccgtggaacgaaaccgtacccctaacgtccccgttagtaactttccttttacgtaggtacctacctacgtttaacggaagtaggtacgggtactacccggtaacgtaccgtaacggttaccgaaggaccggtgtaggtttacggttccggtagggtacctacgtactttacgtaccttcctaccctaaccgactacacgacgtcgtaccgctcggggggtactccgacggtaacgtacggttacgaccgttacgttaattaccgtccgtaacctaaactaactttacttttaaccgtttttagtaacccgttaacgttacggttttaccgggtaaccggtacgggtaaccggtaacgtcggtagggtaagtaaaccttaaaccgggaaacggttacgtagggtacgtcgaccgtaaccaaccgttactaccggttattaccgttcgttaacgttccccgg

SEQ ID NO: 288957 - DNA, 717 bp, Homo sapiens
  misc_feature: GYAE6OF01EIREJ.44.75.G09.1.454.CMB.1.raw
  modified_base (142)..(142): a, c, t, g, unknown or other
  misc_feature (142)..(142): n is a, c, g, or t
  modified_base (152)..(152): a, c, t, g, unknown or other
  misc_feature (152)..(152): n is a, c, g, or t
  modified_base (175)..(175): a, c, t, g, unknown or other
  misc_feature (175)..(175): n is a, c, g, or t
  modified_base (227)..(227): a, c, t, g, unknown or other
  misc_feature (227)..(227): n is a, c, g, or t
  modified_base (402)..(402): a, c, t, g, unknown or other
  misc_feature (402)..(402): n is a, c, g, or t
  modified_base (478)..(478): a, c, t, g, unknown or other
  misc_feature (478)..(478): n is a, c, g, or t
  modified_base (487)..(487): a, c, t, g, unknown or other
  misc_feature (487)..(487): n is a, c, g, or t
  modified_base (498)..(498): a, c, t, g, unknown or other
  misc_feature (498)..(498): n is a, c, g, or t
  modified_base (503)..(503): a, c, t, g, unknown or other
  misc_feature (503)..(503): n is a, c, g, or t
  modified_base (693)..(693): a, c, t, g, unknown or other
  misc_feature (693)..(693): n is a, c, g, or t
tcagacagtatatacacgaccggtgctcgatttagtatagacatcaggggaggaatcagacccagtcaggacacagcatggacatggagacgtcctcgctcagcctccgtgggcctcctgctgctcgttccggtttcccggngccgtaggtntcgactgtcgagactcgaaccgngtcctccgtacctcacttgttacgtcggtcgttacgtagggttacggggaanacggtacgtccacctaatcccggtcggttcccgggccggggtacgtacggtccgaaccggtaagtttaaggtttttaccgggttgttttttccggaccgttggttaccgagtacggacgggcgtacgacgaaccgtaaccgtaccccgttacgtccttagtcttttcgttacggngttaccttactaacgtagggtagtcggtacgaccggtacacggtcgtaggcgaggcggtagtagtcggtacgacgnttagtctcnctcgacctagntacgngtacgtctccggtgacgtcgtcggtacacgttacgtaccgtctttactacctacgtactaaccttaatttagtttaccgttttactttacgtacgttaacgttcgggtaccggtaaccggtccggtaaacgtgacggtaacggagtaaccgtaaagtacgggtactggttaacgcttacgacttcccgtnttcggtaacttctccgtcctaccg

SEQ ID NO: 288958 - DNA, 924 bp, Homo sapiens
  misc_feature: GYAE6OF01B51Y7.44.75.G09.1.454.CMB.1.raw
tcagacagtatatacacgaccggtgctcgatttagtatagacatcagggacttaggggctttgccaggctcctgctgctctgtttcccggtgccaggtgtgacatcgagatcgacccagtctccgtcctcactgtctgcgtactagttggggacagacgtcaccagtccacgttcggccgggcgaggtcgaccgactaagtttagggttactttttttcgggcctttgggtttaccgacggcgtaagggacgtccgtcgggacctaaaaccggtacccccgttaacgttccccgttagttacttttcctttttcgtacgggtaccttacccgttaacgttttacgggaaaagggttcgggttacggggtaaccgttacccccggaacggtaccgttaacggggtttaccggacgggtccgggtaacgtacgggtttcggggtttaccggtacggggtaacttaaccgttacgttttcccgtaaccttccttacccaacctaacgtccgaacgcctaaccggccgttgacctacggtccgtaaggggtacttacgtttacccggacgtttaaacgtttacgttacccgtctaaacctaaaactttacgttttaactttttaccgttttttacgtaccggtttaacggtttacgggtttaccggaaccgggttaacgggaaacccgtaaggtccggtaaggtacgtaaacgtaaccggtaaacggttacgtaggcggtacttccggtaactaccggttacttccgttacgtttccttacttaacccgtttcccctacccgtccttacgtttacgtaacgttactttaacgtaccttttacggtaccggtttcgggtcgggtaaacccgggtcggggttcccgggtaaacgggtacccggggtaacgggtaaccgtccggttaaacg

SEQ ID NO: 288959 - DNA, 766 bp, Homo sapiens
  misc_feature: GYAE6OF01CRMGK.44.75.G09.1.454.CMB.1.raw
tcagacagtatatacacgaccggtgctcgatttagtatagacatcagggacttaggggctttgccaggctcctgctgctctcgtttccccggtgccaggtgtgacatcgagatcgacccagtctccgtcctcactgtctgcgtctagtggggacagagtcacatcacttggccgggcgagtcgccgactagttaggtacttttttggccttggtttcagcaggacgccgtggaccaaacgtcccctaagtccctagtactttcttttcgtcggacttccgtaacttttaggaaaggtaggtgggtaaccgttaccccaggtacccgtaggggtttaccgaagggccgggtacgttagggtttcgggtttaccggttcgggggaaccctaccgttacgttttccaaccgtttcccgttacccaaccctagttaccgaacgtccgaacgtccctggaccgtacggtccctaggggtaacttcggttttacgaccgttaaacttttaacgttaccgtacctaacctaaactttaatttactttttacctttttaaccgttaccgtttaacgttacgggttttacgggaccgggtaacgggtaacctaacggtacgtaggaacgtaactaacggtaaaggtacgtggtagtcctagactactacttcgttcgtacttctaccttccgtaccctctagttacgtagtacttacttacgtacttacgtggtacggtcggacgggttacgtacggacggtacggcgtacgtag

SEQ ID NO: 288960 - DNA, 698 bp, Homo sapiens
  misc_feature: GYAE6OF01AJHEE.44.75.G09.1.454.CMB.1.raw
  modified_base (219)..(219): a, c, t, g, unknown or other
  misc_feature (219)..(219): n is a, c, g, or t
  modified_base (239)..(239): a, c, t, g, unknown or other
  misc_feature (239)..(239): n is a, c, g, or t
  modified_base (274)..(274): a, c, t, g, unknown or other
  misc_feature (274)..(274): n is a, c, g, or t
tcagacagtatataacacgaccggtgctcgatttagtatagacatcagggagggaatcagacccagtcaggacacagcatggacatgagagtcctcgctcagctcctggggctcctgctgctctggctcccaggttcgagatgtgacatcgagatgacccagtctccttccttcctgtcttcttctgttggaggtcagcgtcaccatcacttgccgggngagtcaggtcgtttttcggngctgttcgccttgggtttcaaacaaaaagggggtnaacggccccttaaaggtccctcgtactctacgttgaaaacctgactgggaaggttagacgtacccgtcaggtttcaggttgccagtccaggtgtgggccgagtcccactcgtcaccgattagccggaccttggccggtacctaggaacgtatttccgtggtacctaaactttaagttttcccgtagggtttaccaaggtacctaaggttaacttaccgtaagtttaacggtcgtaccccccgttttagttaccgttttttacggggacccgtaaggggggtaacccctaaggtaccgtttaacgggaaaacgttaccgtaaaaccgggtaaccgttagggtacggaccgtttacggacctaacccgtacgttaccgtacgttccgttacaactttacccgttcccccgaccgttaagttcccgg

SEQ ID NO: 288961 - DNA, 650 bp, Homo sapiens
  misc_feature: GYAE6OF01DC1FA.44.75.G09.1.454.CMB.1.raw
  modified_base (136)..(136): a, c, t, g, unknown or other
  misc_feature (136)..(136): n is a, c, g, or t
  modified_base (223)..(223): a, c, t, g, unknown or other
  misc_feature (223)..(223): n is a, c, g, or t
  modified_base (390)..(390): a, c, t, g, unknown or other
  misc_feature (390)..(390): n is a, c, g, or t
  modified_base (402)..(402): a, c, t, g, unknown or other
  misc_feature (402)..(402): n is a, c, g, or t
  modified_base (525)..(525): a, c, t, g, unknown or other
  misc_feature (525)..(525): n is a, c, g, or t
  modified_base (564)..(564): a, c, t, g, unknown or other
  misc_feature (564)..(564): n is a, c, g, or t
  modified_base (645)..(645): a, c, t, g, unknown or other
  misc_feature (645)..(645): n is a, c, g, or t
tcagacagtatatacacgaccggtgctcgatttagtatagacatcagggacttagggcttgccaggctcctgctgctctgttccccggtgccaggtgtgacatcgagatcgacccagtcctccgtcctcactgtcngcgtctagtcgggactagatcacatcacgtcggaccgggcgagtcgaccgtatagttacggttcgtttttcggcgttggttacacgngaaggcgtcctggaccaaacgtcccctaagtccctagtactttcttgcgtctaccgtattaggaaggttggcggtacctacccgtagtaccggtacgtcgacggccggtagtgggttacggttccgtaaggacctaggtacctttacaccttctaccacctagacgnggtaccacgcgngccgacgtacggtcgacgttccgttaacggtacctaattttaaccctcgaaccgtaacctaagttactttctttaacctttacgtacgttagttaccggttacggaacgacggtacacggtanacgaatacgaagtaacggactgtcggctacgctaacgtntacgtacgttctacctaccgttcccgtctacgtctcgacttagtactcgtacgtgtaacgcggtgacgtagtacgagacgntcgag

SEQ ID NO: 288962 - DNA, 912 bp, Homo sapiens
  misc_feature: GYAE6OF01C5C3J.44.75.G09.1.454.CMB.1.raw
tcagacagtatatacacgaccggtgctcgatttagtatagacatcagggacttaggggcttgccaggctcctgctgctctgtttcccggtgccaggtgtgacatcgagatcgacccagtctccgtcctcgactgtctgtcgtcttagtggggacagacgtccacctactcctacgttcggccgggcgagtcggccgaactagttaggttacgtttttcggcttggtttcaggcgagggtacgccgtaggacctaaccgtaccccttaacgtcccgtagttactttcgttttccgtacggtaccttccgtaacgtttaggaaggttacggtacgggtaccgttacccgacggttaccgtacgggttacgaacgggtccggtaccggttaggggttccggtttacggtacgggtaacgtaacctttacgtttacccaccgtttaccctaccaaccgttacctaccgtacggaccgtaccggtccgaccggtaccgtaccggtacccggtaagggttaacggttacccgtttacccggtaacctttaacgtttaaccgttaacccggttaccctaaaaccggttaaaccttttaacgtttacccgttttttaacccgtttttaaccgttaacgtttaaccgggtttaaccgggttttaccgggaccggggttaaacggggtaaccctacgggttaccggtaacgggtaaacgttaacggaaaccggtaaacgggttaaactcggttaacggtccgtaccggtacctaacgttaccgtccgggtttataccccgtttaactcccggttaaccctaccggtacccttaggccttataacgttaccgtttacgtagttacccgttaggtcccgggtaggtcccgggtaagacccggttaaggacccgtgaactaacgg

SEQ ID NO: 288963 - DNA, 872 bp, Homo sapiens
  misc_feature: GYAE6OF01CDSL3.44.75.G09.1.454.CMB.1.raw
  modified_base (118)..(118): a, c, t, g, unknown or other
  misc_feature (118)..(118): n is a, c, g, or t
  modified_base (163)..(163): a, c, t, g, unknown or other
  misc_feature (163)..(163): n is a, c, g, or t
  modified_base (737)..(737): a, c, t, g, unknown or other
  misc_feature (737)..(737): n is a, c, g, or t
tcagacagtatatacacgaccggtgctcgatttagtatagacatcagggacttaggggctttgccaggctcctgctgctctgtttccccggtgccaggtgtgacatcgagatcgaccngtcctccgtcctcactgtctgtcgtctagtgggacagacgtcacntctacgtcggccgggcgacgtcgaccgtaacgttagtttaacgggttttcgttttttcgggtaccgtttgggtttaccgacggtacgacgggacggtccggtacggaaccgtaaaaccgttaccccgttaaacgttccccgttagttaacttttccgttttcggtacggttacttaccttacgtttaaggaacgggtacggttacgggaccgtcccgaacggtaccgttacggtacggaccgggtcggtaccggtagggttcggttaccgggtacggtaaccctactttaccgtttacctacctttacccgtaaccctaaccctacgaccgtaaccgaccgtaaccggtccccgtaggacccgtacgggtccgggtaagggtaccttttacgggtacccgttaaccgttaacgtttacgtaaccgtaccgtaaaccttaaacttaattttaccgtttttacgttttaccgttaaccgtttacggtttaacggttaccggaaccggtaacgggtaccctaaggtaccggttaggaacctaacgtaaacgtaaccggtagtcgggttacgcgtacnccgttaactacgtttcctacttaccgttcttacccgttccgttacccaagttcctaacgttctaaaccttacgtttaacgtcggttcggtagccgggtacgggtcggtaccggttagacggacgtagtagtacgg

SEQ ID NO: 288964 - DNA, 693 bp, Homo sapiens
  misc_feature: GYAE6OF01C0T4T.44.75.G09.1.454.CMB.1.raw
  modified_base (175)..(175): a, c, t, g, unknown or other
  misc_feature (175)..(175): n is a, c, g, or t
  modified_base (213)..(213): a, c, t, g, unknown or other
  misc_feature (213)..(213): n is a, c, g, or t
  modified_base (258)..(258): a, c, t, g, unknown or other
  misc_feature (258)..(258): n is a, c, g, or t
  modified_base (577)..(577): a, c, t, g, unknown or other
  misc_feature (577)..(577): n is a, c, g, or t
  modified_base (687)..(687): a, c, t, g, unknown or other
  misc_feature (687)..(687): n is a, c, g, or t
tcagacagtatatacacgaccggtgctcgatttagtatagacatcagggacttaggggctttgccaggctcctgctgctctgtttccccggtgccaggtgtgacatcgagatcgacccagtctccgtcctcactgtctgctctagttgggacagagtcaccatcacttgccgggngagtgccgatattaggtcttttttggccttggttcagntaaggcgccgtggactaaacggccctaagtccctgtattcttttncggtactcctaagtttaggaaagtgtcgggtaactcccgagtaccgaggttccaggcggtcgtaggttcgggtttaccgagggacctattacttactccttccgctaacctggtacagtaccgcggtctacggcaccggtccgtaagtgttcgtacgtaccgttactttacgtcctacaacctaactttaattacgtttttccgtttttaacttaaccggttgtttaccgggttttacgggacccggtaacgggaacccgttaggaaccggtaggtaacgaaggttaaaccgtaaaggacctgggtttacgcgggtacnccgttaaccgtatttccgttacgtttccttaatcccgggttttcccaccctacttacggtcctaattctaattcgtacttcgtgaacggtgtcggacgtaggaccgtagntactag

SEQ ID NO: 288965 - DNA, 913 bp, Homo sapiens
  misc_feature: GYAE6OF01ADUKK.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttgggacagagtcaccatccacttggccgggcgagtcgccgaactagtttaaggttacgtttttttcgggcctttggtttcgagtccgagggacgccgtaggaccgaaacgtacccccgttaacgtccccgtagtacttttccgtttttacgtacggtaccttacccgttaaccgtttttagggaaaggtaagggttacgggaaccggtttacccccgaacggtcccgttaacggggttttccgaaacggggccgggtaccgtaacgggtttggggttttacccggttacggggtaacccgtaacctttaacggtttttcccaacctttcccttaccaaccccgtactaccgaacgggtcgaaacccgtcccgtcggaacccgtacggtacccggttagggacgtttacggtttacccggtacgttaaccgtttttacgttaacccgttaccggaaccttaaaccttaaatttactttttaccttttttaccgttaccgtttaacgtttacggttttcgggtaacccggtaacggggtaaaccgtaaggtacccggttaggaacgttaacgttaacggtaaaaggtaaccggttcggttacggccttaccggacctaaccgtacgttcccgtttcgttaccgtttcttaaccccgttcccttaccccgtaccctacttccggtcttaaagtttacttaaacggttccttacgggttcgaacggggtccggtacgggtacggtacggtaaggtaccggagtccgtacgg

SEQ ID NO: 288966 - DNA, 820 bp, Homo sapiens
  misc_feature: GYAE6OF01DTRE1.44.75.G09.1.454.CMB.1.raw
  modified_base (305)..(305): a, c, t, g, unknown or other
  misc_feature (305)..(305): n is a, c, g, or t
  modified_base (353)..(353): a, c, t, g, unknown or other
  misc_feature (353)..(353): n is a, c, g, or t
  modified_base (396)..(396): a, c, t, g, unknown or other
  misc_feature (396)..(396): n is a, c, g, or t
tcagacagtatatacacgaccggtgctcgatttagtatagacatcagggacttaggggctttgccaggctcctgctgctctgtttccccggtgccaggtgtgacatcgagatgacccagtcctcccgtcctcactgctgcgtctaggttgggacagacgtcaacctactccacgttcggaccgggacgaaggtcgacccgtaacctaagtttacggttacgtttttttcggcctttggtttccaaggacgaaggacgccctaggaaccgaaaacgtcccctaagtccctaggtactttgtttcgngactcctagttagaagaggtacgacgtaccagacgtggtacgacgcgngtagtcgttgacggactatacgtttcactacgtaccactagtnaaccgtcgacgtcctagacctacggtccgttaagggattaccgtttcgaaccgttacttttaagacccgtaggtaaccaaaacgttattttacggttttaccctttttaacgacccggttaattacggtttaccgggaccgtacgggtaaacgtaacggtaccgtttaggaacttaaacccgtaaaggtaaaccgtacgttacgggtcggttacaccgtaacccgtaacgtaactttccggttaccgttaccgtacccgttaacttaccccccggttaccccgtaaccgttaccgttaaccggtagttaaaggttaacctttaacgggttaacgtttacggtaaccccggttaacggggaaccggtcggggttaacccgggtcgggttaaaacccgggtcccgggaagttaaccggttaaacgg

SEQ ID NO: 288967 - DNA, 770 bp, Homo sapiens
  misc_feature: GYAE6OF01ALBUI.44.75.G09.1.454.CMB.1.raw
  modified_base (275)..(275): a, c, t, g, unknown or other
  misc_feature (275)..(275): n is a, c, g, or t
tcagacagtatatacacgaccggtgctcgatttagtatagacatcgagggacttaggggctttgccaggctcctgctgctctgtttccccggtgccaggtgtgacatcgagatgacccagtctccgtcctcactgtctgcgtctagttgggacagagtccacatcgacttcggaccgggcgagtcggaccgactagttaggtacttttttcggaccttggtttcgagcgaagggacgaccgtggacaacgccctaagtccctgtacttcttttgngtactacgactttaggaagtgtaggacgtccacgaccgtagttacgacgcggtacgagtttacggttcgcggaacctacttacggttacctaccgttactaccgtaacagttccgagtaccacgtcgtacgacacgttccgtaggtacgttacttacggaacctagtttaacgtacgtacggtaacctaaacgttactttactttttacgtttttaacgtacccggttaagtttacgggtttaccggaccgggtaaaggaacccggttaacggtaccggttaggaacgttaacgttaaacgggtaaaccggtagttaacgggtcggacgtaccggaacccttaacgaccggtttacgttccgtttaaacccgttcctaacgtttacccgtacccggtactaaccggttctaacggttaatacggtttaacttccggttaggtccgtaaggggccgtccgggttacgaacggttcccggacgtccggttaagacgg

SEQ ID NO: 288968 - DNA, 763 bp, Homo sapiens
  misc_feature: GYAE6OF01CPKDP.44.75.G09.1.454.CMB.1.raw
  modified_base (419)..(419): a, c, t, g, unknown or other
  misc_feature (419)..(419): n is a, c, g, or t
tcagacagtatatacacgaccggtgctcgatttagtatagacatcagggacttaggggctttgccaggctcctgctgctctgtttccccggtgccaggtgtgacatcgagatcgacccagtctccgtcctcactgtctgcgtctagttgggacagagtcaccatcacgttggccgggcgagtcgaccgactagtttaggtacttttttggccgttggtttaccaggcgacgggacgtcctaggaccaaaccggtacccccttaagtccctagtaactttccgttttacacggtacttacctaacgtttaggaaaggacggtacgggtaccgtacccgaacggtccgtacggtttacgacggccggtagtacgggttcggttacgttacgggactacctactttccacttcaccaacctnaccgagtccgacgtcgtgacgcgacggttagacgttacgtccgacgttacttacgttacgactaaccctaataactttacgttttacttttaacccgtacgtttacgttacggtttacggaccggtaaacgggtaacctaggtaccggtggaacgtaacgtaaccgggaaacgtacggttagggtacgtacgtacgtaaccgtacctaagtttcccggttacgttacctttaaccgtccctttaacccgttcccaaccgttcttaacgtactacgttacttacggttaacctaggtcgtacgggtaggcccggtaccggtaggacccggtaacggcctagtacg

SEQ ID NO: 288969 - DNA, 728 bp, Homo sapiens
  misc_feature: GYAE6OF01ERYAT.44.75.G09.1.454.CMB.1.raw
  modified_base (274)..(274): a, c, t, g, unknown or other
  misc_feature (274)..(274): n is a, c, g, or t
  modified_base (723)..(723): a, c, t, g, unknown or other
  misc_feature (723)..(723): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtctaggttcgttttcggtgtcttgttgccgttggttacgaaacgaaaaagggggcgacggtacccctaaggtcctcgtctcctacgacgaaaccngacgtaggaaggtacgaacgtccccggtacacggttacgagtgccagtccgtaggggtggtacggggcccggaggtccactcctaccaaccgtacttacggccgaaccgttcggaccggctaaggtaagaacttttccgaggacccttaaagttttctttcgttacgtccgaagtcctaggtaactctaagtacggttcgtccccgtttagtaccgttttacgggaccggaacgggaacctaaggtacgttaggaaaacgtaacgaaacggtaacgttacgttacggtagtcgtaccacctacttacgtttcgtaccttacgtaccttccgtttccccgtaccgtaaccttagtacgtaattacgttaacttacgttaccgttagtacgggtaccgggtaccggggtcgtacggggtaccaaccggggcgtaaccgttaggtaatcggntctag

SEQ ID NO: 288970 - DNA, 891 bp, Homo sapiens
  misc_feature: GYAE6OF01EKTEH.44.75.G09.1.454.CMB.1.raw
  modified_base (345)..(345): a, c, t, g, unknown or other
  misc_feature (345)..(345): n is a, c, g, or t
  modified_base (734)..(734): a, c, t, g, unknown or other
  misc_feature (734)..(734): n is a, c, g, or t
tcagacagtatatacacgaccggtgctcgatttagtatagacatcgaggggggggtctcaggaggcagcgctctcgaggacgtccaccaccagtggccgtgggctcctgcctccttccctcctacccccttcctccactcgaacggaccaccggtacgggtcccgtacggggcccctacgttctccggtcccttacggaacctcgaccgtccccttcccccgtcccgggtcggtttcccgggttcgttcggttaccgggtactacgttccgaaaccgtccctacctacttccctctcgaccttacgaccgtaacctacgtacgtttacttcgttagttagtaacncgtagtcttaactcgtttccgtacctttccggtaacgtacacggtacaccttccgaaccgagtacccaccggtaccccgtaccctaggtaccgtttacggtttattaccggttttacggtaacgtaaacccttacgggaccccgtccgtaccccggggttaaccgggtacccggggtttaccgtacgttttccgggtcgttacccggttaccggttccttaaaccccgggtgttaccggcccggtaaaaccccgtttccgacccccggtttacccgttaacccgggtaccttacccgggtaccggtttccggggaccgtacccggtacgtaccggtagtaacgtcgtagtaccgtacgttcgtatttaacgttcctaggcctaccggtntacggtccggtgacggtcctaggtcttagttcgtttggttccggttcggtacgggctaacggccttaacggccgtttcgtaaccgtggtaaccgtccgaccggtacccgttcccggtaccgtaccggtccccggtttacgtccgtccccggtttccc

SEQ ID NO: 288971 - DNA, 786 bp, Homo sapiens
  misc_feature: GYAE6OF01C9172.44.75.G09.1.454.CMB.1.raw
  modified_base (418)..(418): a, c, t, g, unknown or other
  misc_feature (418)..(418): n is a, c, g, or t
  modified_base (777)..(777): a, c, t, g, unknown or other
  misc_feature (777)..(777): n is a, c, g, or t
tcagacagtatatacacgaccggtgctcgatttagtatagacatcagggacgttagggctttgccaggctcctgctgctctgtttccccggtgccaggtgtgacatcgagatcgaccctagtcctcccgtcctcactgtctgcgtctagtgggacagctcacatcacgtggccggcgtagtcgaccgattagtttaggttacgtttttggccgttcggtccagcgaggacgccgtggaaccgaaaccgtaccccgtaacgtccctagtactttttcgtttcgtacggtactaccgtttaacgtttaggaaacggtacggtccggaccgttacccccgaacggtccggtaacgggttaccgaacgggtcccggtagtagggtttccgggttaccgtagggaaccctatttaccttaccnccgttactccaaccgtatacgaccgtcgaaccgtctacgaccgtagtccgaaggttcgttaaccgtttcggtaaccttactttaacgtactaccgtaaacctaacgtttaaacttttcgtttttccgttttaaccgtcccgtttaggttacgggttttacccggaacccgggtaaagggtacccgtacgtacggtaggaacgtaaccgtaacgggtaaacggtcgttagggtacgttccacggtcctaacgttcttacgttcttaaccgttcctcccgtacccgttcaccgttatcgtacgtattaacgtcgttacgttagcggtaccggtacgggtcgtacggtacggacggtaacgngtacggtaa

SEQ ID NO: 288972 - DNA, 814 bp, Homo sapiens
  misc_feature: GYAE6OF01BHY4R.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatcgacccagtctccgtcctcactgtctgcgtctattgggacagagtcaccatcacttgccgggcgacgtgccgacattaggtacttttttcggaccgtggtttcagcgaggacgcctggacaaacgacccctaagtcccgtagtacttcttttacgtaggtacttacctaacgttttacggaaaggtaacggttgggaaccgttcccaacggtaccgtacgggttaccaggtccggacgtacggttacgggtttaccgtcggggtaacctaaccgtacttttaccaaccgttcctaccgtaaccctaataccgaacgtccaacggtccctacggaccgtaacgtcccgtaagggtacgttacgttttaccggacgttaactttaacttaaccgtacgaaacctaaacgttaactttacttttacctttttacgttaccgttaacgttacgttttaccgggaaccggtaacgggtaaccgtaaggtaccgtacgggaacgtacgttaaacggaaacgggtaccgttaggtcggtactacgtacgtaccctaattccgttagttcccgttaacgtacctttacccgttaccccgtaccgttaacgtacgttaacgttaaacttacgttaaacgtttaccgtacggttacggaccgggtacgggtaacccggttacggacgaacccggaccgtaggtaaacgtcgg

SEQ ID NO: 288973 - DNA, 841 bp, Homo sapiens
  misc_feature: GYAE6OF01BW2CH.44.75.G09.1.454.CMB.1.raw
  modified_base (177)..(177): a, c, t, g, unknown or other
  misc_feature (177)..(177): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttgggacagagtcaccatcacttcggccgggngagtcgcgactattaggttactttttggccttggtttcagtcgaggacgcctacggaccaaacgtccccttaacgtccctgtacttcgttttcgtggactcctagtttagaagtagtcggacgtcccgagaccgtaggttcgacggcggtcgtaggttcggttcggtacgggactacgttacttccacgtcctacacctatcgacgccaacgtccgtacgcgtacggcgtcggtattaccggttacgtacgttaaccgtttactttaacgtaccgtaaccctaaacgttaacttttaccttttaccgttttttaaccgtaccgtttaacggtttacgggttttaaccgggacccgggttaaaccggggtaaaccgtaacggttaccgggtaacggtaacggtaacggttaaaccgaaaacggggtttaacgttcgggtaccgtacggtaacctacccggtaacctttaccggttaccgttttacccggttaccgtttaccctttaacccggttccccgtttaacccccgcttaaccgtttcgttaaaccggtttaacttaacgtttaaacgtttcccggttacggttttaaccgggcggttaaccccgggggtacgggttccggacgggggtaacccggtacccggtaacggtcccgtaaaggg

SEQ ID NO: 288974 - DNA, 616 bp, Homo sapiens
  misc_feature: GYAE6OF01E1GPM.44.75.G09.1.454.CMB.1.raw
  modified_base (117)..(117): a, c, t, g, unknown or other
  misc_feature (117)..(117): n is a, c, g, or t
  modified_base (153)..(153): a, c, t, g, unknown or other
  misc_feature (153)..(153): n is a, c, g, or t
  modified_base (192)..(192): a, c, t, g, unknown or other
  misc_feature (192)..(192): n is a, c, g, or t
  modified_base (226)..(226): a, c, t, g, unknown or other
  misc_feature (226)..(226): n is a, c, g, or t
  modified_base (298)..(298): a, c, t, g, unknown or other
  misc_feature (298)..(298): n is a, c, g, or t
  modified_base (316)..(316): a, c, t, g, unknown or other
  misc_feature (316)..(316): n is a, c, g, or t
  modified_base (337)..(337): a, c, t, g, unknown or other
  misc_feature (337)..(337): n is a, c, g, or t
  modified_base (368)..(368): a, c, t, g, unknown or other
  misc_feature (368)..(368): n is a, c, g, or t
  modified_base (390)..(390): a, c, t, g, unknown or other
  misc_feature (390)..(390): n is a, c, g, or t
  modified_base (611)..(611): a, c, t, g, unknown or other
  misc_feature (611)..(611): n is a, c, g, or t
tcagacagtatatacacgaccggtgctcgatttagtatagacatcagggacttaggggctttgccaggctcctgctgctctggctcccaggttcgagatgtgacatcagatgacccngtctccttccttcctgtcttcttcgtgttggagacngcgtcaccatcacttgccggcagtcaggttcgtttcggnacgtgtcgccttggttacaaacgaaaaagggggntacggccctaaggtcctcggtctcgtacgtagaaccagacgtggaagtagactcccgtacgaggttcacgtncctagtccgacgggttgngggtccggagttaccagtccncaccagttccgccacgtgccgctagaacgtntccgtagctaacgtttcttcgntacgctacagtactctaagtcgtacgtccccgttattacgtttcggaccgtacggactaagtccgtaaggaactaacgaaacggtactggtacgtacacggtacacctacgttctacgtcttaccgacttcctacccggtactactcgtactatacttagtacgttaccgtaccgtaggtaccggtcggacgtacggtacggacggtacgacgtaacgagngtaga

SEQ ID NO: 288975 - DNA, 709 bp, Homo sapiens
  misc_feature: GYAE6OF01BCO5I.44.75.G09.1.454.CMB.1.raw
  modified_base (208)..(208): a, c, t, g, unknown or other
  misc_feature (208)..(208): n is a, c, g, or t
  modified_base (224)..(224): a, c, t, g, unknown or other
  misc_feature (224)..(224): n is a, c, g, or t
  modified_base (241)..(241): a, c, t, g, unknown or other
  misc_feature (241)..(241): n is a, c, g, or t
  modified_base (266)..(266): a, c, t, g, unknown or other
  misc_feature (266)..(266): n is a, c, g, or t
  modified_base (587)..(587): a, c, t, g, unknown or other
  misc_feature (587)..(587): n is a, c, g, or t
tcagacagtatatacacgaccggtgctcgatttagtatagacatcaggggggggtctcaggaggcagcgctctcaggacgtcaccaccatggcctgggctctgcctcctcctccaccctcctcactcaggacacgacgggtcctcgggccagtctcgccctgactcacgccctccgtccgcggtccggtctgtcggcagtcagtcacntctctgcactgaaccngtactattcattgtacnctatcgatatctctcgtacgtacgncactccaaccgtacgacaccgaccgacccctagtaccgttcgttgtttacgttttaggacgtacgaaacgtaccgccctacccggtagggtaccgggttccgtagttcgttactcgcgtactacgagttcgacgacacgccgtcctacgtacgtacccgtcgttccggacgtccgtaaccggcgtacgtacgggtacgtcgttaagggcggtttaactattaccgtttaagtcgtccgacgtaccgcgttaccggtagggtacggtacgtacccctaaattgggttacgtttaccgttcggttttaacggttacccggggnggtaaccggtacgtccggtaaaccgtttcggacccggtttagaccggtcccggaacccaccgtaccccgggggttaaccctaccccggttcccgacccgggttaatttccccgtaacccggg

SEQ ID NO: 288976 - DNA, 726 bp, Homo sapiens
  misc_feature: GYAE6OF01CIB7S.44.75.G09.1.454.CMB.1.raw
  modified_base (182)..(182): a, c, t, g, unknown or other
  misc_feature (182)..(182): n is a, c, g, or t
  modified_base (274)..(274): a, c, t, g, unknown or other
  misc_feature (274)..(274): n is a, c, g, or t
tcagacagtatatacacgaccggtgctcgatttagtatagacatcagggacttaggggctttgccaggctcctgctgctctgtttccccggtgccaggtgtgacatcgagatcgacccagtctcccgtcctcacgtgtctgcgtcgtagttgggacagagtcaccatcacgttcggccgggngtagtcgccagtagttacggttactttttggccttggttcgagacgaggcgaccgtacgaacgaccgtaccgtaccgtctgtacttcttcgngtactactagtagagtacgtcgtaccaccgacgtacgtacgtgacgcgtgtcggtgtcgacgactacgttacttccacgtccaccgactacgctaacgcgtaccgcgacgcgtacggtacgtagtacgttcgtacgtacgttacgttacgtacctacgtaactaacttatttaccttttacgtttacctacgtttaacgtttcggtaccgtaccgggtaacggtaccgtcggtaggtagtaacgtaacgtaacgaacgttaccgtaggtccgacgtaccgtaccgtacgttacgttccgtttccgtacccgttttcccgtaaccccgtttcccgtaacccgttaaccgttcggtttaaccacggtttaaacgttacgtttaccgtttaacgttcgggtacggtccgggtacgttccggggaacgttaccggacgtaacgttccggattacgg

SEQ ID NO: 288977 - DNA, 292 bp, Homo sapiens
  misc_feature: GYAE6OF01A73OJ.44.75.G09.1.454.CMB.1.raw
  modified_base (152)..(152): a, c, t, g, unknown or other
  misc_feature (152)..(152): n is a, c, g, or t
  modified_base (227)..(227): a, c, t, g, unknown or other
  misc_feature (227)..(227): n is a, c, g, or t
  modified_base (255)..(255): a, c, t, g, unknown or other
  misc_feature (255)..(255): n is a, c, g, or t
  modified_base (266)..(292): a, c, t, g, unknown or other
  misc_feature (266)..(292): n is a, c, g, or t
tcagacagtatatacacgaccggtgctcgatttagtatagacatcagggacttaggggctttgccaggctcctgctgctcttcgtttccccggtgccaggtgtgacatcgagatgaccagtctccgtcctcactgtctgctctagttgggangatcaccatcacgttggccgggagaggtcgccgaatatttaggtacctttttttggcctggtttcagcgaagggngcgtcggacaaccgaccgtaccgtcctntcttctttctnnnnnnnnnnnnnnnnnnnnnnnnnnn

SEQ ID NO: 288978 - DNA, 751 bp, Homo sapiens
  misc_feature: GYAE6OF01DZ7JV.44.75.G09.1.454.CMB.1.raw
  modified_base (142)..(142): a, c, t, g, unknown or other
  misc_feature (142)..(142): n is a, c, g, or t
  modified_base (678)..(678): a, c, t, g, unknown or other
  misc_feature (678)..(678): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtntagttggggacagagtccacatctacttggccgggcgaggtcgaccgactagtttaggttacttttttcggccgttggtttaccaggtcgagggacgcccgtacggaccaaacgtcccctaacgtcccgtgtactttctttcgtgtactcctacttaggaagtaggtacggacgtacccgacgccgtacggttcgacggcggacgtagggttggttcgtgggacctacgtattcctactccgtaccaccactccagccagcccgtagacgacggtacgtaggtacgttactttccggaaccgtttacttaacgttacgtaccgtaacctaaacttaacgttttaactttttaccttttttaccgttaaccggttaagtttacggttttacgggacggtaacgggtaaccctaggtaccggtaaggtacgtaagttaaccggaaacgttacggtcgggttacgtacgtcccgtaactacccgttaattccggtttaccgtttacctaccgttacccttccccgttacccgtaacttntacttattaccttaattaccgttgttacggtcgtacgggcggtacgggttacggacgggacgacgcgaagtcg

SEQ ID NO: 288979 - DNA, 853 bp, Homo sapiens
  misc_feature: GYAE6OF01CFXJX.44.75.G09.1.454.CMB.1.raw
tcagacagtatatacacgaccggtgctcgatttagtatagacatcagggacttaggggctttgccaggctcctgctgctctcgtttcccggtgccaggtgtgacatcgagatcgacccagtcctccgtcctcactgtctggcgttctagttggggacagagtcaccatctacgttcggccggggcgacgtcgaccgtaacgtagtttaggttacgttttttcggtccgttggtttaccaggaccgagggaccgtcccggtacggaaccaaaaccggtcccccttaaagttcccgtagttactttccgttttacgcgtacctacttacgtttaggaacggtacggtacggtaccgtacccgtacggtacccggtaggttacgacggaccgggtacgttacggtttcgggtacgtaccgggtaagtaacgtaacgttccctaccttcctaacctaccgtactacgacggacgtaccgcgtaccgctacgaccgttagtacgttagtttacgtttacgtaacctttaacgttaccttaccgtaacggtaccaaacgttaacgttacgttaaagtttcgtttactttacgtaacggttaacgggttacggtttaccgggaaccggtaaccggtaaccgggaacttacgggaaacggacggttaaactaaaccggtaaacgttaacggtacgtaccggtaccttaacgaacccttacgggtaccttacggttactttccgtaccgtttaacccgttcccgtacccttaccttcggttaactacctttaaagtacttaccgttaacggttacccgtacggtaacgggttccggggacgtttaggcccggcggttaaccg

SEQ ID NO: 288980 - DNA, 828 bp, Homo sapiens
  misc_feature: GYAE6OF01B5I85.44.75.G09.1.454.CMB.1.raw
  modified_base (183)..(183): a, c, t, g, unknown or other
  misc_feature (183)..(183): n is a, c, g, or t
tcagacagtatatacacgaccggtgctcgatttagtatagacatcagggacttaggggctttgccaggctcctgctgctctcgtttccccggtgccaggtgtgacatcgagatcgacccagtcctccgtcctcactgtctgcgtcgtagtgggacagtacgcaccatctacgttcggccgggngtagtcggacccgaacttaagtttacggtttacgttttttcggccgttggttcgaggacgaggacgaccgtacggaaccaaaccgtaccccgttaacgtccctagttacttttccgttttacggtacggtacttcccgtagttttaggaaggtagggttacggaccggtacccgaacggtaccggttaacgggttaccgacgggttaccgggacgttaacgggttcgggtttccgtacgggtactaaccgtttactttacctaaccttcctaccaaccgtactacgacgccgacggtcccgtcaaccggacggacgttacggggaagttaccgtttccggtaactttaactttacgttacctacggtaaaccctaaactttaacttttaccttttaccgttttttaccgtaccgtttacgtttacggtttaccgggacccggtaacggggtaacccgagttacggtaaggaacgtaacgtaacgggtaaaggttaccggtagtccggtacgttaccgaacgtaccttacgttcgttccgttccttacgtacccttacccgtccctaacgtctcgtacttacgttaacttacgtattcggtggtaccggtacgggtccggtaggtacggacggaggtccgatacgg

SEQ ID NO: 288981 - DNA, 514 bp, Homo sapiens
  misc_feature: GYAE6OF02IVJX0.44.75.G09.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (393)..(393): a, c, t, g, unknown or other
  misc_feature (393)..(393): n is a, c, g, or t
  modified_base (492)..(492): a, c, t, g, unknown or other
  misc_feature (492)..(492): n is a, c, g, or t
  modified_base (511)..(514): a, c, t, g, unknown or other
  misc_feature (511)..(514): n is a, c, g, or t
tcagacagtatatacacgaccggtgctcgatttagtatagacatcagggacgttaggggactttgcccaggctcctgcctgctctgtttccccggtgccaggtgtgacatcgagatgacccagttctccgtcctcactgtctgcgtctattggggacagagtcaccatcacttgccgggcgagtcaggtcgttttcggngctgttgcctggtttcaacaaaaggggnaggcccctaaggtcctcgtctctcgttgaaaccagactggaaggtagagtcccgtcaggttcagtgccagtccaggtggtgggccgaggtccactctcaccattagcgactgcggctgaagnttcngcaacttatttctgtcagcagtatcatagtgccccgtttnacttttgcctaggggaccaagcgtggaaatcaaacgactgtggctgcaccatctgtcttcattctcccgctatctgatatatacttgtctgaggtcggntggcgaaggcgactatagnnnn

SEQ ID NO: 288982 - DNA, 550 bp, Homo sapiens
  misc_feature: GYAE6OF02HZV4T.44.75.G09.1.454.CMB.1.raw
  modified_base (351)..(351): a, c, t, g, unknown or other
  misc_feature (351)..(351): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagtcaggagcctggcaaagcccctaagtccctgacttcttttctggatcctactttgaacgtagtggagtcccagccaggttcagcggcagtggttcngggacacgatttcactctcaccatcagcagcctgcagcctggagtactttcggcgtaactttattactcgacccaaataactatttacttttttaatccggttaactaggtttttcggaccctaaggggtaccaaggtcctgggacgacttacgaaagggactggtaggctacgcaccatccttagtcttcgattcccg

SEQ ID NO: 288983 - DNA, 536 bp, Homo sapiens
  misc_feature: GYAE6OF02HH1SN.44.75.G09.1.454.CMB.1.raw
  modified_base (435)..(435): a, c, t, g, unknown or other
  misc_feature (435)..(435): n is a, c, g, or t
  modified_base (454)..(454): a, c, t, g, unknown or other
  misc_feature (454)..(454): n is a, c, g, or t
  modified_base (487)..(487): a, c, t, g, unknown or other
  misc_feature (487)..(487): n is a, c, g, or t
tcagacagtatatacacgaccggtgctcgatttagtatagacatcagggggtctcaggaggcagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccagcgacaattccactggccctttaaagtctctatcatggtacgcagtggtcccggccgagcccccaaagtcctcttttacgacgtcctttcgcgggcttcggcagtccctggccgtttttcggcctccagttctgaccacgcggcctcctgaccatcaccaaactccggcctgaggatgaggctgactacttttgtgtgcatatttcgattcactcaaatntgtcttcggagtgggaccngtcagcgtcctgcgtcagcccaaggccaacccnctcgtcacgtctcgttcccgccttcctctactctactgtctgagtcggg

SEQ ID NO: 288984 - DNA, 499 bp, Homo sapiens
  misc_feature: GYAE6OF02FJ66J.44.75.G09.1.454.CMB.1.raw
  modified_base (497)..(497): a, c, t, g, unknown or other
  misc_feature (497)..(497): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtccccagccaggttcagcggcagtggttctgggacacatttcactctcaccatcagcagcctgcagcctggagatttcgcgtacttattactgccaacaatattctttttatccgtactagttttggcctaggggaccaagctggagatcaaaggactgtggctgcaccatctgtcttcatccttcccgcatctgatatatactgtctgagcggctggcaggcnag

SEQ ID NO: 288985 - DNA, 502 bp, Homo sapiens
  misc_feature: GYAE6OF02HSD75.44.75.G09.1.454.CMB.1.raw
  modified_base (412)..(412): a, c, t, g, unknown or other
  misc_feature (412)..(412): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagtatttcgcgacttattactgccaanaatattcttttttatccgttactagttttggccgtaggggaccaagctggagatacgaaaggactgtggctgcacatctgtcttcattcc

SEQ ID NO: 288986 - DNA, 503 bp, Homo sapiens
  misc_feature: GYAE6OF02H5NKX.44.75.G09.1.454.CMB.1.raw
  modified_base (252)..(252): a, c, t, g, unknown or other
  misc_feature (252)..(252): n is a, c, g, or t
  modified_base (474)..(474): a, c, t, g, unknown or other
  misc_feature (474)..(474): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggcctggtttcagcaggagcctggcaaagcccctaagtccctgatcttttcnggatccactttgaagagtggagtcccagccaggttcagcggcagtggttctgggacacatttcactctcaccatcagcagcctgcagcctggagatttcgcgtacttattactgccaacaatattcttttttatccgttactagttttggcctagggaccaagctggagatacaaaggaactgtgctgcaccatctgtcttcactctcccgcatctgatatntactgtctgagcggctggcaaggcgatag

SEQ ID NO: 288987 - DNA, 559 bp, Homo sapiens
  misc_feature: GYAE6OF02G6Y14.44.75.G09.1.454.CMB.1.raw
  modified_base (346)..(346): a, c, t, g, unknown or other
  misc_feature (346)..(346): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtccccagccaggttcagcggcagtggttctgggacacatttcactctcaccatcagcagcctgcagcctgganatttcgcgacttatactgccaacaattattctttttatccgtactagttttggccagggaccaagcgtaggagatacgaaagtactgtgctgcaccatctgttcttctacttccttcccgacctactctagtacttaacttaacttaccgttgttaccgttcggtaacgggtccggggtaccgttacgggaccggaacgggccgacgtaacgg

SEQ ID NO: 288988 - DNA, 507 bp, Homo sapiens
  misc_feature: GYAE6OF02HZCJ1.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtacttattactgaccaacaatattcttttttatccgttactagttttggcctaggggtaccaaggctggagatacgaaaggaactggtggctgcacatctgtcttcattcc

SEQ ID NO: 288989 - DNA, 497 bp, Homo sapiens
  misc_feature: GYAE6OF02GULTQ.44.75.G09.1.454.CMB.1.raw
  modified_base (251)..(251): a, c, t, g, unknown or other
  misc_feature (251)..(251): n is a, c, g, or t
  modified_base (495)..(495): a, c, t, g, unknown or other
  misc_feature (495)..(495): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtccccagccaggttcagcggcagtggttctgggacacatttcactctcaccatcagcagcctgcagcctggagatttcgcgacttattactgccaacaatattcttttttatccgtactagttttggccagggaccaagctggagatcaaaggactgtgctgcaccatctgtcttcactcttcccgcatctgatatatactgtctgagcggctggcaggcgnag

SEQ ID NO: 288990 - DNA, 503 bp, Homo sapiens
  misc_feature: GYAE6OF02IGUIK.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagattttcgcgacttattactgccaacaatattcttttttatccgttactagttttggccaggggtaccaagctggagatcaaaggactgtgctgcaccatctgtcttcatccttccgccatctgatatatactgtctgagcggctggcaaggcgactag

SEQ ID NO: 288991 - DNA, 506 bp, Homo sapiens
  misc_feature: GYAE6OF02GNELH.44.75.G09.1.454.CMB.1.raw
  modified_base (424)..(424): a, c, t, g, unknown or other
  misc_feature (424)..(424): n is a, c, g, or t
  modified_base (504)..(504): a, c, t, g, unknown or other
  misc_feature (504)..(504): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtactttattactgaccaacaatattcttttttatcccgttactagttttggccgaggggaccaagctgganatacaaaggactgtgctgcacatctgtcttcattccttcccgcatctgatatatacttgtctgagcggctggcaaggcgnag

SEQ ID NO: 288992 - DNA, 501 bp, Homo sapiens
  misc_feature: GYAE6OF02H30PN.44.75.G09.1.454.CMB.1.raw
  modified_base (383)..(383): a, c, t, g, unknown or other
  misc_feature (383)..(383): n is a, c, g, or t
  modified_base (497)..(497): a, c, t, g, unknown or other
  misc_feature (497)..(497): n is a, c, g, or t
tcagacagtatatacacgaccggtgctcgatttagtatagacatcagggacttagggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgacttgttactgccaacaatattcttttttanccgttacagttttgccaggggaccaagctggagatcgaaaggactgtggctgcaccatctgtcttcattctccgcctatctgatatatctgtctgagcggctggcaaggtccgntacg

SEQ ID NO: 288993 - DNA, 498 bp, Homo sapiens
  misc_feature: GYAE6OF02HV70X.44.75.G09.1.454.CMB.1.raw
  modified_base (421)..(421): a, c, t, g, unknown or other
  misc_feature (421)..(421): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccacttttgaagagtggagtcccagccaggttcagcggcagtggttctgggacacatttcactctcaccatcagcagcctgcagcctggagatttcgcgacttattactgccaacaattatcttttttatccgttactagttttggcctaggggaccaagctgganatcaaaggactgtggctgcacatctgtcttcatcctccgcatctgatatatactgtctgagcggctggcaggcgcag

SEQ ID NO: 288994 - DNA, 515 bp, Homo sapiens
  misc_feature: GYAE6OF02GP2FC.44.75.G09.1.454.CMB.1.raw
  modified_base (512)..(512): a, c, t, g, unknown or other
  misc_feature (512)..(512): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtccccagccaggttcagcggcagtggttctgggacacatttcactctcaccatcagcagcctgcagcctggagatttcgcgtacttattactgacccaacaattattctttttatccgttactagttttcggccgtaggggaccaagcgtggagatacgaaaggtaactgtgctgcaccatctgtcttcacttccttcccgccatctgtatatatactgtctgagcggctggcaaggcntag

SEQ ID NO: 288995 - DNA, 507 bp, Homo sapiens
  misc_feature: GYAE6OF02HIY06.44.75.G09.1.454.CMB.1.raw
  modified_base (251)..(251): a, c, t, g, unknown or other
  misc_feature (251)..(251): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggttctgggacacatttcactctcaccatcagcagcctgcagcctggagatttcgcgtacttattactgccaacaatattcttttttatccgttactagtttttggcctaggggaccaagctggagatcgaaagactgtggctgcaccatctgtcttcattccttcccgcctatctgtatatatactgtctgagcgggctggcaggcgcag

SEQ ID NO: 288996 - DNA, 518 bp, Homo sapiens
  misc_feature: GYAE6OF02ILSW2.44.75.G09.1.454.CMB.1.raw
  modified_base (251)..(251): a, c, t, g, unknown or other
  misc_feature (251)..(251): n is a, c, g, or t
  modified_base (489)..(489): a, c, t, g, unknown or other
  misc_feature (489)..(489): n is a, c, g, or t
  modified_base (516)..(516): a, c, t, g, unknown or other
  misc_feature (516)..(516): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgatctttcnggatccactttgaagagtggagtccccagccaggttcagcggcagtggttctggggacacatttcactctcaccatcagcagcctgcagcctggagatttcgcgactttatactgaccaaacaatattcttttttatcccgttaactagtttttggcctagggggaccaaggctaggagatacgaaaggaactgtggctgcaccatctgtcttcattccttcccgcctatctgatatnttactgtctgagcgggctggcaggcgnag

SEQ ID NO: 288997 - DNA, 542 bp, Homo sapiens
  misc_feature: GYAE6OF02IT8G3.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtcccctgactctttctggatccactttgaagagtggagtcccagccaggttcagcggcagtggttctgggacacatttcactctcaccatcagcagcctgcagcctaggagatttcgcgacttattactgccaaactaatattcttttttatcccgttaactacgttttcggcctaggggtacctaaggctacggagaatacaaaggtactgtagctgcaccatctgttcttcacttccttcccgactactctgtacttacgtacttacttgtcctgtcgacgggcttcgggactacggcgatacg

SEQ ID NO: 288998 - DNA, 498 bp, Homo sapiens
  misc_feature: GYAE6OF02JDO9V.44.75.G09.1.454.CMB.1.raw
  modified_base (345)..(345): a, c, t, g, unknown or other
  misc_feature (345)..(345): n is a, c, g, or t
  modified_base (496)..(496): a, c, t, g, unknown or other
  misc_feature (496)..(496): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctgganatttcgcgacttattactgccaacaatatcttttttatccgtacagttttggccaggggaccaagctggagatcaaaggactgtgctgcaccatctgtcttcattccttcccgccatctgatatatactgtctgagcgggctggcaggcgnag

SEQ ID NO: 288999 - DNA, 499 bp, Homo sapiens
  misc_feature: GYAE6OF02IUMW8.44.75.G09.1.454.CMB.1.raw
  modified_base (251)..(251): a, c, t, g, unknown or other
  misc_feature (251)..(251): n is a, c, g, or t
  modified_base (497)..(497): a, c, t, g, unknown or other
  misc_feature (497)..(497): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggttctgggacacatttcactctcaccatcagcagcctgcagcctggagatttcgcgtacttattactgccaacaatatctttttatccgtactagttttggcctaggggaccaagctggagatcaaaggactgtggctgcaccatctgtcttcatcttcccgctatctgatatatactgtctgagcgggctggcaggcgnag

SEQ ID NO: 289000 - DNA, 517 bp, Homo sapiens
  misc_feature: GYAE6OF02HV0AT.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgatcttttctggatccactttgaagagtggagtcccagccaggttcagcggcagtggttctgggacacatttcactctcaccattagcagcctgcagcctggagtatttcgcgtacttattactgaccaaactaatattcttttttatccgttactagttttggccgaggggaccaagctggagattacgaaaggactggtggctgacaccatctgtcttctacttcctcccg

SEQ ID NO: 289001 - DNA, 520 bp, Homo sapiens
  misc_feature: GYAE6OF02GRQ8I.44.75.G09.1.454.CMB.1.raw
  modified_base (487)..(487): a, c, t, g, unknown or other
  misc_feature (487)..(487): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccatgatcttttctggatccactttgaagagtggagtcccagccaggttcagcggcagtggttctgggacacatttcactctcaccatcagcagcctgcagcctggagtatttcgcgtactttaattactgacccaactaattattcttttttaatcccgttactagttttggaccgtagggggacccaagtctaggagatacgaaaggactgtggctgcacatctgtcttcatccttcccgctactctnatatatctgtctgacgcgggctggcgaggcgac

SEQ ID NO: 289002 - DNA, 506 bp, Homo sapiens
  misc_feature: GYAE6OF02I5YKP.44.75.G09.1.454.CMB.1.raw
  modified_base (374)..(374): a, c, t, g, unknown or other
  misc_feature (374)..(374): n is a, c, g, or t
  modified_base (503)..(503): a, c, t, g, unknown or other
  misc_feature (503)..(503): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgattcttttctggatccactttgaagagtggagtccccagccaggttcagcggcagtggttctgggacacatttcactctcaccatcagcagcctgcagcctggatatttcgcgtacttattactgaccaanaattattctttttactccgttactagttttggcctaggggaccaagctggagatacgaaagactgtgctgcactatctgtcttcatcctcccgcatctgatatatactgtctgagcggctggcacggcncag

SEQ ID NO: 289003 - DNA, 705 bp, Homo sapiens
  misc_feature: GYAE6OF02FE0S8.44.75.G09.1.454.CMB.1.raw
  modified_base (260)..(260): a, c, t, g, unknown or other
  misc_feature (260)..(260): n is a, c, g, or t
  modified_base (278)..(278): a, c, t, g, unknown or other
  misc_feature (278)..(278): n is a, c, g, or t
  modified_base (316)..(316): a, c, t, g, unknown or other
  misc_feature (316)..(316): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttggccgggcgagtgccgacatttaggtacttttttggccttggtttcagcaggacgcctggacaaacgcccctaagtccctgtattcttttcnggactcctactttgaagngtggacgtcccagccaggttcagcggcaggttggttcngggactactatttcactctcaccatcagcagcctgcagtccgtagggacgttactttccgacgtacttacttacctgaccctaaactaatttactttaccttttttaacgtccgttacttacggttttcgggaccggtaacgggggaacccaaggtcgtagggaagtaacgttaacgaaacgggtaacgttcgggtacggtaccttcggaccctaaccgtacgtttaccgtttcgtttaccctttacccttacgttccccgtttaccccggtaccttaacgttaccgttagtaactttaacgttaacttaccgttacggttaccgttacgggtaaccgggtcccggggttaccgttaccggggaccgtaaccgggtcgtaccgtaacgg

SEQ ID NO: 289004 - DNA, 504 bp, Homo sapiens
  misc_feature: GYAE6OF02FR9E1.44.75.G09.1.454.CMB.1.raw
  modified_base (346)..(346): a, c, t, g, unknown or other
  misc_feature (346)..(346): n is a, c, g, or t
  modified_base (465)..(465): a, c, t, g, unknown or other
  misc_feature (465)..(465): n is a, c, g, or t
  modified_base (501)..(501): a, c, t, g, unknown or other
  misc_feature (501)..(501): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctggggacacatttcactctcaccatcagcagcctgcagcctgganatttcgcgtacttattactgccaaacaatattctttttatccgtactagttttggcctaggggaccaagctaggagatacgaaaggaactgtgctgcaccatctgtcttcattcctccncatctgatatatactgtctgagcggctggcaggcgntag

SEQ ID NO: 289005 - DNA, 511 bp, Homo sapiens
  misc_feature: GYAE6OF02H81M6.44.75.G09.1.454.CMB.1.raw
  modified_base (508)..(508): a, c, t, g, unknown or other
  misc_feature (508)..(508): n is a, c, g, or t
tcagacagtatatacacgaccggtgctcgatttagtatagacatcagggacttagggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggcctggtttcagcaggagcctggcaaagcccctaaagtccctgatcttttctggatccactttgaagagtggagtcccagccaggttcagcggcagtggttctgggacacatttcactctcaccatcagcagcctgcagcctggagatttcgcgaacttattactgccaaacaattattcttttttatccgttactagttttggcctaggggacaagctggagaatacaaaggactgtgctgcaccatctgtcttcattccttccgcctatctagatatatactgtcttgagcggctggcaaggtcgntag

SEQ ID NO: 289006 - DNA, 587 bp, Homo sapiens
  misc_feature: GYAE6OF02HECDS.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagccctaagtccctgatctttctggatccactttgaagagtggagtcccagccaggttcagcggcagtggttctgggacacatttcactctcaccatcagcagcctgcagcctggagtatttcgcgtactttattactgaccaaactaattactttcttttttaatcccgttaactagtttttcgggacccgtaacgggggtaaccctaaaggtccgttagggaacgtacttaccgtaaaagggtaaccttgggtacgggtacgttacggaccgtaacccgtacgttccgttacggtttacctttaccgactttccccg

SEQ ID NO: 289007 - DNA, 501 bp, Homo sapiens
  misc_feature: GYAE6OF02I22O4.44.75.G09.1.454.CMB.1.raw
  modified_base (463)..(463): a, c, t, g, unknown or other
  misc_feature (463)..(463): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgatcttttctggatccactttgaagagtggagtcccagccaggttcagcggcagtggttctgggacacatttcactctcaccatcagcagcctgcagcctggagtatttcgcgtacttattactgaccaacatattctttttatccgttatagttttggcctagggaccaagctagganatacaaggactgtaggctagcacatctgtcttcattcc

SEQ ID NO: 289008 - DNA, 521 bp, Homo sapiens
  misc_feature: GYAE6OF02I8WDL.44.75.G09.1.454.CMB.1.raw
  modified_base (519)..(519): a, c, t, g, unknown or other
  misc_feature (519)..(519): n is a, c, g, or t
tcagacagtatatacacgaccggtgctcgatttagtatagacatcagggtacggttaaggggctttagccaggctcccctgcttgctctgtttccccgggtgccaggtggtcgacgatcgagatgacccagtctccgtcctcactgtctgcgtcgtattggggacagagtcaccatcacttgccgggcgagtgccgacattaggactttttttggccttggtttcagcaggagcctggcaaagcccctaagtccctgatcttttctggatccactttgaagagtggagtccccagccaggttcagcggcagtggttctgggacacatttcactctcaccatcagcagcctgcagcctggagtatttcgcgacttattactgaccaacaattattcttttttatccgttactagtttttggcctaggggaccaagctggagatcaaaggactgtgctgcaccatctgtcttcattccttcccgcatctgatatatactgtctgagcggctggcgaggcgnag

SEQ ID NO: 289009 - DNA, 495 bp, Homo sapiens
  misc_feature: GYAE6OF02GGCY8.44.75.G09.1.454.CMB.1.raw
  modified_base (466)..(466): a, c, t, g, unknown or other
  misc_feature (466)..(466): n is a, c, g, or t
  modified_base (492)..(492): a, c, t, g, unknown or other
  misc_feature (492)..(492): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgacttattactgccaacaatatctttttatccgtactagttttggcctaggggaccaagctggagatacaaagactgtgctgcacatctgtcttcatctcccgcatctgatatntactgtctgagcggctggcaaggcgntag

SEQ ID NO: 289010 - DNA, 507 bp, Homo sapiens
  misc_feature: GYAE6OF02IEDR6.44.75.G09.1.454.CMB.1.raw
  modified_base (250)..(250): a, c, t, g, unknown or other
  misc_feature (250)..(250): n is a, c, g, or t
  modified_base (309)..(309): a, c, t, g, unknown or other
  misc_feature (309)..(309): n is a, c, g, or t
  modified_base (487)..(487): a, c, t, g, unknown or other
  misc_feature (487)..(487): n is a, c, g, or t
tcagacagtatatacacgaccggtgctcgatttagtatagacatcagggacttagggctttgccaggctcctgctgctctgtttccccggtgccaggtgtgacatcgagatgacccagtctccgtcctcactgtctgcgtctatggggacagagtcaccatcacttgccgggcgagtgccgacattaggacttttttggcctggtttcagcaggagcctggcaaagcccctaagtcccctgatcttttcnggatccactttgaagagtggagtcccagccaggttcagcggcagtggttctggggacanatttcactctcaccatcagcagcctgcagcctggagatttcgcgacttattactgccaacaattattccttttttatccgttacagtttttgcctagggacctaagctggagattacgaaaggactgtgctgcaccatctgtcttcatcttccgctatctagatatatactgtctagngcggctggcaacggcgctag

SEQ ID NO: 289011 - DNA, 561 bp, Homo sapiens
  misc_feature: GYAE6OF02IGIUG.44.75.G09.1.454.CMB.1.raw
  modified_base (252)..(252): a, c, t, g, unknown or other
  misc_feature (252)..(252): n is a, c, g, or t
  modified_base (466)..(466): a, c, t, g, unknown or other
  misc_feature (466)..(466): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggcctggtttcagcaggagcctggcaaagcccctaagtccctgatcttttcnggatccactttgaagagtggagtcccagccaggttcagcggcagtggttctggggacacatttcactctcaccatcagcagcctgcagctggatatttcgcgtacttattactgaccaaacaatttactttacttttttatccgttaactaggtttttcgggaccggtagggaaccgagtcgtaggagtagtaacgaaaggtacgtggtcgcgngaccacctattctcgttcttctacttcctcccgactactctagtattatacttactgtcgtagacggcgggtcgtacggacggaacggcgatacg

SEQ ID NO: 289012 - DNA, 489 bp, Homo sapiens
  misc_feature: GYAE6OF02JI1YY.44.75.G09.1.454.CMB.1.raw
  modified_base (414)..(414): a, c, t, g, unknown or other
  misc_feature (414)..(414): n is a, c, g, or t
  modified_base (486)..(486): a, c, t, g, unknown or other
  misc_feature (486)..(486): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgacttatactgccaacatattctttttatccgtactagttttggccagggaccaagctgganatcaaaggactgtgctgcacatctgtctcatctccgcatctgatatatactgtctgagcgggctggcaggcntag

SEQ ID NO: 289013 - DNA, 505 bp, Homo sapiens
  misc_feature: GYAE6OF02HQNPJ.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgacttatactgccaaacaatattctttttatccgttactagttttggccgtagggacctaagcttggagatacgaaaggactgtgctgcacatctgtcttcacttcctccgctatctgatatatactgtctgagtcggctggcaaggcgctag

SEQ ID NO: 289014 - DNA, 502 bp, Homo sapiens
  misc_feature: GYAE6OF02F462F.44.75.G09.1.454.CMB.1.raw
  modified_base (385)..(385): a, c, t, g, unknown or other
  misc_feature (385)..(385): n is a, c, g, or t
  modified_base (502)..(502): a, c, t, g, unknown or other
  misc_feature (502)..(502): n is a, c, g, or t
tcagacagtatatacacgaccggtgctcgatttagtatagacatcagggacttaggggctttgccaggctcctgcttctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagccccctaagtccctgatcttttctggatccactttgaagagtggagtcccagccaggttcagcggcagtggttctggggacacatttcactctcaccatcagcagcctgtagcctggagatttcgcgacttattactgccaacaatatcttttttanccgtactagttttggccaggggaccaagctggagatcaaaggaactgtggctgcaccatctgtcttcatcttcccgcatctgatatatactgtctgagcggctggcaggcgcatagn

SEQ ID NO: 289015 - DNA, 527 bp, Homo sapiens
  misc_feature: GYAE6OF02FTKVZ.44.75.G09.1.454.CMB.1.raw
  modified_base (433)..(433): a, c, t, g, unknown or other
  misc_feature (433)..(433): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccgggcgagtgccgacattaggactttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagtatttcgcgtacttattactcgaccaactaattacttcttttttacnccgttactagttttcggccgtaaggggtaccaaggtcgtagggagtatacgaaaggtaactggtacggctgcacctatcctgtcttcattcccg

SEQ ID NO: 289016 - DNA, 508 bp, Homo sapiens
  misc_feature: GYAE6OF02GDPOQ.44.75.G09.1.454.CMB.1.raw
  modified_base (466)..(466): a, c, t, g, unknown or other
  misc_feature (466)..(466): n is a, c, g, or t
  modified_base (477)..(477): a, c, t, g, unknown or other
  misc_feature (477)..(477): n is a, c, g, or t
  modified_base (505)..(505): a, c, t, g, unknown or other
  misc_feature (505)..(505): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtccccagccaggttcagcggcagtggttctgggacacatttcactctcaccatcagcagcctgcagcctggagatttcgcgtacttattactgaccaactaatacttcttttttatccgttactagttttggacctaggggaccaagctaggagatacgaaaggactgtgctgcacatctgtctcactctccncatctgatatntactgtctgagcggtctggcgacggcgntag

SEQ ID NO: 289017 - DNA, 686 bp, Homo sapiens
  misc_feature: GYAE6OF02FV5RZ.44.75.G09.1.454.CMB.1.raw
tcagacagtatatacacgaccggtgctcgatttagtatagacatcaggggacttagggctttgccaggcgtcctcgctcgcgtcttgtttccccggtgtccaggttgtgacatcggagatagacccagtctaccgtcctcactggtcttggcgtctattggggacagtagtcaccgatctaacgttgccgggcgagtgccgacattaggactttttggcctggttcagcgaggagtccgtggcaaacgccccgtaacgtccctgacttcttttcctggactcccactttcgaagtaggtggtacgtcccctagcccgtaggttccaggccggcaggtgggttccgtggggaccactagtttccactcgtcaccgatcgagcagcctgcagtccgtgggagtatttcgacgtacttatactgacctaactaatacgttcctttttactcccgtaacttagttttcggaccgtagggaacctaaggtaccttacggaagtaactaacgaaaggtacttagtacggtctacgactaccgaactccgtacgttccttacgtaacgttcccgttaccccggacctaccgttaccgtacgtaactttaacgttaacgttaaccgttagttaccgttacggaaccggtaccggggtacgtacggggtaccgaacggggtaccgtacgtaacgg

SEQ ID NO: 289018 - DNA, 512 bp, Homo sapiens
  misc_feature: GYAE6OF02HYPZF.44.75.G09.1.454.CMB.1.raw
  modified_base (509)..(509): a, c, t, g, unknown or other
  misc_feature (509)..(509): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtacttattactgccaaacaatattcttttttatccgttactagtttttggcctaggggaccaagctggagatacaaaggaactgtggctgcaccatctgttcttcacttcttcccgcctatctgatatattactgtctgagcgggctggcaaggcntag

SEQ ID NO: 289019 - DNA, 576 bp, Homo sapiens
  misc_feature: GYAE6OF02IFF11.44.75.G09.1.454.CMB.1.raw
  modified_base (295)..(295): a, c, t, g, unknown or other
  misc_feature (295)..(295): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccgggcgagtgccgacattaggacttttttggccttggttttcagcaggagcctggcaaagcccctaagtccctgatcttttcnggatccactttgagagtggagtcccagccaggttcagcgcagtggttctgggacacatttcactctcaccatcagcagcctgcagcctggagtatttcgcgtacttactttactgaccaaactaattactttcttttttaactccgtttaactagttttttcgggaccgtaggggtaccaaagtcgtagggtaagacgttacgaaacgggtaacttggtacgggtacgttacggtacctaaccctagttaccttcggtttcctttacgtaactttcccccg

SEQ ID NO: 289020 - DNA, 509 bp, Homo sapiens
  misc_feature: GYAE6OF02IF6EH.44.75.G09.1.454.CMB.1.raw
  modified_base (507)..(507): a, c, t, g, unknown or other
  misc_feature (507)..(507): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctgggagattttcgcgactttattaactgcccaaacaattattcttttttatccgttactagttttggcctaggggaccaagctggagatacaaaggactgtgctgcaccatctgtcttcatcttcccgccatctgatatatactgtctgagcgggctggcaaggcgnag

SEQ ID NO: 289021 - DNA, 405 bp, Homo sapiens
  misc_feature: GYAE6OF02IGEVT.44.75.G09.1.454.CMB.1.raw
  modified_base (330)..(330): a, c, t, g, unknown or other
  misc_feature (330)..(330): n is a, c, g, or t
  modified_base (379)..(405): a, c, t, g, unknown or other
  misc_feature (379)..(405): n is a, c, g, or t
tcagacagtatatacacgaccggtgctcgatttagtatagacatcgaggggacttaggggcattccctggtatcagcagaaaccagggaatgcccctaaggtcctcgatctataaggcgtctagtttagaaagtggggtcccatcaaggttcagcggcagtggatctgggacagaattcactctcaccatcagcagcctgcagcctgatgattttgcaacttattactgccaaacagtaataagagttattctcagtagttttggcaggggaccaagctggagatacaaaacgactggtcggctgcacctatctgtcttcatccttcccnctatctgatatatactgtctgacggcggctggacgaaggcacattagcnnnnnnnnnnnnnnnnnnnnnnnnnnn

SEQ ID NO: 289022 - DNA, 502 bp, Homo sapiens
  misc_feature: GYAE6OF02G2QND.44.75.G09.1.454.CMB.1.raw
  modified_base (266)..(266): a, c, t, g, unknown or other
  misc_feature (266)..(266): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
tcagacagtatatacacgaccggtgctcgatttagtatagacatcaggggaggaatcagacccagtcaggacacagcattgacatgagagtcctcgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaagggggnaggcccctaaggtcctcgtctctcgtgaaaccagactggaaggtagagtcccgtcaggttcaggtgccagtccaggtggtgggccggagtccactctcaccattagcgacctgcggcctgaagattctgctaacttatttctgtcagctagtatcatagtcgcccgttctacttttggccaggggaccagctaggaaatcaacgactgtgctgcacntctntctcntctccncntc

SEQ ID NO: 289023 - DNA, 514 bp, Homo sapiens
  misc_feature: GYAE6OF02IP9M0.44.75.G09.1.454.CMB.1.raw
  modified_base (512)..(512): a, c, t, g, unknown or other
  misc_feature (512)..(512): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccacttttgaagagtggagtccccagccaggttcagcggcagtggttctggggacacatttcactctcaccatcagcagcctgcagcctggagattttcgcgtactttattactgaccaaacaattattcttttttatcccgttaactagtttttggccaggggaccaagctggagatcaaaggactgtggctgcaccatctgtcttcacttccttcccgccatctgatatatactgtctgagcggctggcaaggcgnag

SEQ ID NO: 289024 - DNA, 645 bp, Homo sapiens
  misc_feature: GYAE6OF02JN541.44.75.G09.1.454.CMB.1.raw
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
  modified_base (348)..(348): a, c, t, g, unknown or other
  misc_feature (348)..(348): n is a, c, g, or t
  modified_base (375)..(375): a, c, t, g, unknown or other
  misc_feature (375)..(375): n is a, c, g, or t
  modified_base (391)..(391): a, c, t, g, unknown or other
  misc_feature (391)..(391): n is a, c, g, or t
tcagacagtatatacacgaccggtgctcgatttagtatagacatcagggacttaggggctttgtccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgacttcttttcnggatccactttgaagngtgagtcccagccaggttcagcggcagtggttctgggacacatttcactctcaccatcagcagcctgcagcctgganatttcgcgtacttattctgacccaaanattattccttttttancccgtttaatagtttttcggacctaaggggtacccaaaggtccttagggacgtaattaccgaaaaggtaaccgttggttacggtaccttaggcctaaacccgtattccgttacgttacctttaccaactttcccgtttaccccggctaacttccgttacggtaacttacgtttaaccttaactttcgggttacccttaagggaaccggttcggggtccttaggggttacccgaaagggttcccgtaacgtaacg

SEQ ID NO: 289025 - DNA, 539 bp, Homo sapiens
  misc_feature: GYAE6OF02F6YF1.44.75.G09.1.454.CMB.1.raw
  modified_base (251)..(251): a, c, t, g, unknown or other
  misc_feature (251)..(251): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggatcccagccaggttcagcggcagtggttctgggacacatttcactctcaccatcagcagcctgcagcctgggatatttcgcgtacttattactgaccaaataattatttcttttttatccgttactaggttttcggaccgtaaggggtaaccaaggtccgtaggagtattacgaaaggtaactggtggctgctacctatctgtcttcattccttcccgctatctagatactatacttcgtctgacggcggtctcggcaacggcgatag

SEQ ID NO: 289026 - DNA, 519 bp, Homo sapiens
  misc_feature: GYAE6OF02JWMTL.44.75.G09.1.454.CMB.1.raw
  modified_base (426)..(426): a, c, t, g, unknown or other
  misc_feature (426)..(426): n is a, c, g, or t
  modified_base (466)..(466): a, c, t, g, unknown or other
  misc_feature (466)..(466): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtccccagccaggttcagcggcagtggttctgggacacatttcactctcaccatcagcagcctgcagcctgagtatttcgcgacttattactcgacctaaacaattatttctttttatccgttactagttttggccaggggtaccaagctgganatacaaggaactgtgctgcacatctgtctctatcttcccnctactctgtatacgtatacttgtactgagccgggtctggtacaggtcgctaag

SEQ ID NO: 289027 - DNA, 502 bp, Homo sapiens
  misc_feature: GYAE6OF02F6COU.44.75.G09.1.454.CMB.1.raw
  modified_base (499)..(499): a, c, t, g, unknown or other
  misc_feature (499)..(499): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtacttattactgcccaaataatattcttttttatccgttactagttttggcctaggggaccaagctggagatcaaagactgtgctgcaccatctgtcttcactcttcccgcatctgatatatactgtctgagcggctggcaaggcngag

SEQ ID NO: 289028 - DNA, 515 bp, Homo sapiens
  misc_feature: GYAE6OF02G4768.44.75.G09.1.454.CMB.1.raw
  modified_base (513)..(513): a, c, t, g, unknown or other
  misc_feature (513)..(513): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtccccagccaggttcagcggcagtggttctgggacacatttcactctcaccatcagcagcctgcagcctggagtatttcgcgtacttattactgaccaaacaattattcttttttatccgtactagttttggccgaggggaccaagctggagatacaaaggtaactgtgctgcacatctgtcttcacttccttcccgcctatctgtatatatactgtctgagcgggtctggacaaggcgnag

SEQ ID NO: 289029 - DNA, 547 bp, Homo sapiens
  misc_feature: GYAE6OF02JXLTZ.44.75.G09.1.454.CMB.1.raw
  modified_base (251)..(251): a, c, t, g, unknown or other
  misc_feature (251)..(251): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggttctgggacacatttcactctcaccatcagcagcctgcagcctggagatttcgcgtacttattactgaccaactaattatttacttttttactccgttactagtttttcggccgtaggggtacctaagccgtaggaagtagtacgaaaggtaactggtggtctgctaccatctgttcttactacttcctcccgactactctagtacttatactacttgtctgagcgggtcgtcggcgaggcgacgtacg

SEQ ID NO: 289030 - DNA, 572 bp, Homo sapiens
  misc_feature: GYAE6OF02GLRLG.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaacgcccctaagtccctgattcttttctggactccactttgaagagtggagtcccagccaggttcagcggcagtggttcgtgggacactatttcactctcaccatcagcagcctgcagcctggactatttcgcgtacttattactgaccaaactaattactttcttttttaactcccgttaacttaggttttcggacccgtaaggggtaccaaggtcgtagggagtaatacgaaagggtacttaggtcggtctcggacacctattctcgttcttctacttcccttcccgacctactctatatatacttacttgtctggacggcggtcgtggaccgacggcgataacg

SEQ ID NO: 289031 - DNA, 503 bp, Homo sapiens
  misc_feature: GYAE6OF02IVPPJ.44.75.G09.1.454.CMB.1.raw
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
  modified_base (501)..(501): a, c, t, g, unknown or other
  misc_feature (501)..(501): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctagcaaagcccctaagtcccctgatcttttctggatccactttgaagagtggagtcccagccaggttcagcggcagtggttctgggacacatttcactctcaccatcagcagcctgcagcctggagatttcgcgtacttatactgaccaaacaattattcttttttactccgttactagttttggccgtaggggaccaagctaggagatacaaaggactgtgctgcacatctgtcttcattctccncatctnatatatactgtctgagcggctggcaggcnag

SEQ ID NO: 289032 - DNA, 514 bp, Homo sapiens
  misc_feature: GYAE6OF02GJQ5F.44.75.G09.1.454.CMB.1.raw
  modified_base (471)..(471): a, c, t, g, unknown or other
  misc_feature (471)..(471): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtacttattactgacccaacactatgatggttcttctcctactactttcggtccgtaggggacgaagcgtggagatacaaacgaactgtggctgcaccatctgtcttctactcttcccnccactctgatatatactgtctgacgcggggggctcggcgacgg

SEQ ID NO: 289033 - DNA, 608 bp, Homo sapiens
  misc_feature: GYAE6OF02HHCXH.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaaagtcccctgattcttttctggatccactttgaagagtggagtcccagccaggttcagcggcagtggttctgggacacatttcactctcaccatcagcagcctgcagcctggatatttcgcgtacttattactgacccaaacgaattaatttccgttttttaatcccgttaactaggtttttacggccgtaacggggacctaaaggccttagggagtaagttacaaaaagggaacctaggtagggctacggccaaccctattctcgttcctttaccattccctttcccggacctattcctagtacttaacttaacttaacttcgttcgttaggaggtaccggggtcctgggtaccgtaagggccgacgtaacg

SEQ ID NO: 289034 - DNA, 629 bp, Homo sapiens
  misc_feature: GYAE6OF02JS0Z8.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggtctgggacacatttcactctcaccatcagcagcctgcagccgtggagtactttcgacgtacttattactgtaccaaactaattatttaccttttttaatcccgtttaacgttaggtttttaccgggaccgtaacgggggaacctaaaggtaccgttagggtaacgaagttccgtaaaaggtaaccgttggtcggacttaggccaacctattccgttagttctttacctactttccgttccccgccgtaattccttacgtaactttacgttactttaaccgttgttaccgtaggacggtccgggtcttacgggacgtaacgggcgaccgtaag

SEQ ID NO: 289035 - DNA, 506 bp, Homo sapiens
  misc_feature: GYAE6OF02GS648.44.75.G09.1.454.CMB.1.raw
  modified_base (503)..(503): a, c, t, g, unknown or other
  misc_feature (503)..(503): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagattttcgcgacttattactgccaacaatattcttttttatccgtactagttttggcctaggggtaccaagctaggagatacaaaggactgtggctgcacatctgtcttcatcttcccgcatctgatatatacttgtctgagcggctggcaacggtcgntag

SEQ ID NO: 289036 - DNA, 500 bp, Homo sapiens
  misc_feature: GYAE6OF02HDW6C.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggccagtcagagtattagtagttggttggcctggtatcagcagaaaccagggaaagcccctaaatcttgatctataaggcatctagtttggaaagtggggtcccatcaaggttcagcggcagtggatctgggacagaattcgctctcaccatcagcagcctgcagcctgatgattttgcaacttattactgccaacaatataatagtttttcgtggacgtttcggaccaagggactaaggtggaagtcaaacgaactgtggctgcacatctgtcttcatcttcccgcatctgatatatactgtctgagcgggctggcaaggcgcatag

SEQ ID NO: 289037 - DNA, 510 bp, Homo sapiens
  misc_feature: GYAE6OF02HLQD0.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtcccctgatcttttctggatccactttgaagagtggagtcccagccaggttcagcggcagtggttctgggacacatttcactctcaccatcagcagcctgcagcctggagatttcgcgtacttattactgccaacaatattcttttttatccgttactagtttttggacctaggggaccaaaggctggagatacgaaaggaactgtggctgacacatctgtcttcattcccg

SEQ ID NO: 289038 - DNA, 738 bp, Homo sapiens
  misc_feature: GYAE6OF02JWQIP.44.75.G09.1.454.CMB.1.raw
  modified_base (255)..(255): a, c, t, g, unknown or other
  misc_feature (255)..(255): n is a, c, g, or t
tcagacagtatatacacgaccggtgctcgatttagtatagacatcaggacttagggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttccagtcaggagcctggcaaagcccctaaggtccctgacttcttttcnggactcctactttgaagagtggagtccagccaggttcagtcgcagtggtctgggacacatttcactcgtacaccgatcagtcagtcctagcagtcctggactacgtttcgcgtacttagtactcgaccctaaacgtaatttactttcttttttaactacccgttaactttacggtttttacggcccgtaacggggtaaccctaaacggtcgttaacgggtaacgtaacgttaacggtaaaacgggtaaccttacgggttacgggtaccttacgggaaccttaacccgtaaagtttccgttacgggtttaccttttacctaaccgtttcccgtttacccccggacccgttactttaccgttaccggtaacttttaaccgttaacgtttaccctttaacgggtttcccgttacggtaaccgggttcccggggttaaccgttaccgggtaaccggtaaaccggggttccggtaaccgttaaacggg

SEQ ID NO: 289039 - DNA, 602 bp, Homo sapiens
  misc_feature: GYAE6OF02G15GH.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagattttcgcgtacttattactgaccaaactaattacttttactttacgtacctagtttcggtttcgacgggtacggaacgtacgtggtaggaagtacgtaaacggaaacggttacgttagggtcgtcgtcgacctaactcttcgtctttacttacttaccttcccgtcccgacttaccttacgtagttaacttagttaacttacgtttcgtacgtacgggtacgggtccggttcggtaggacggacggcgtagtaacg

SEQ ID NO: 289040 - DNA, 498 bp, Homo sapiens
  misc_feature: GYAE6OF02FKXXE.44.75.G09.1.454.CMB.1.raw
  modified_base (345)..(345): a, c, t, g, unknown or other
  misc_feature (345)..(345): n is a, c, g, or t
  modified_base (496)..(496): a, c, t, g, unknown or other
  misc_feature (496)..(496): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctgganatttcgcgtacttattactgccaacaatattcttttttatccgtactagttttggccgtaggggaccaagctggagatacaaagactgtgctgcaccatctgtcttcatcctccgccatctgatatatctgtctgagcggctggcaggcgnag

SEQ ID NO: 289041 - DNA, 719 bp, Homo sapiens
  misc_feature: GYAE6OF02I3H3H.44.75.G09.1.454.CMB.1.raw
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
tcagacagtatatacacgaccggtgctcgatttagtatagacatcagggacttaggggctttgccaggctcctgctgctctgtttccccggtgccaggtgtgacatcgagatgacccagtctccttccttcctgtcttcttctgttggaggcagcgtcaccatcacttgccgggcgagtcaggtcgttttcggtgctgttgcctggtttcaaacgaaaagggggagaggcccctaaggtcctcgtctctcgtgaaaccagactggaaggtagagtcccgtccaggttcagtgccagtccaggtggtgggccggagtcccactctcaccattagcgacctgcggctgaanttcngcaactttattctgtcagcagtatcaatacggtcgtccccgtttctacgtttttcgggacccgtacgggggaaccctaaacggtaccgttagggtaaaacgttaccgaaaaaccggtaaaccgttacgggttacgggtaccgttacggaccctaacccgtaacttccgttacggtttacctttacctaaccgtttaccctttacccccggtacccttaacgttcccgttacggtaactttaaacttaaacgtttaaccgttacggtttacccgttagggtaaccggggtccgggggttaccgttacgggggtaaccgtaacggggtacccggtaccgttaacggtacggtacgtacgtcgtagacg

SEQ ID NO: 289042 - DNA, 515 bp, Homo sapiens
  misc_feature: GYAE6OF02I2SSP.44.75.G09.1.454.CMB.1.raw
  modified_base (512)..(512): a, c, t, g, unknown or other
  misc_feature (512)..(512): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggttctgggacacatttcactctcaccatcagcagcctgcagcctggagatttcgcgtacttattactgaccaaacaattattcttttttaatcccgttaactagtttttcggacctaggggacctaaggtctagggagatacgaaaggactgtgctgcacatctgtctcatcctcccgcatctgatatattactgtctgagcggtctggcaggcgntag

SEQ ID NO: 289043 - DNA, 551 bp, Homo sapiens
  misc_feature: GYAE6OF02F6E3J.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgattcttttctggatccactttgaagagtggagtcccagccaggttcagcggcagtggttctgggacacatttcactctcaccatcagcagcctgcagcctggatatttcgcgtactttatactcgaccaacaattatttctttttatccgttactagttttcggccgtaggggtaccaaggctagggagatacgaaaggtactgtgctgcacatctgttccttacacttccttcccgcctacttcctacgtatacttactacttcgtctacggacggtcgggtctacgggacgtaacggccgataacg

SEQ ID NO: 289044 - DNA, 538 bp, Homo sapiens
  misc_feature: GYAE6OF02HNSHV.44.75.G09.1.454.CMB.1.raw
  modified_base (463)..(463): a, c, t, g, unknown or other
  misc_feature (463)..(463): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagtattttccgcgtactttattactgacccaaactaattactttcttttttacttcccgttaacttagtttttcggcccgtaaggggacctaaggcgtaggagtatacgaaaggacttgnggctgcacatctgtcttctatccttcccgcctatctgtatatatctgtctgaggcggcgtggcgaaggcgactag

SEQ ID NO: 289045 - DNA, 494 bp, Homo sapiens
  misc_feature: GYAE6OF02GXZO4.44.75.G09.1.454.CMB.1.raw
  modified_base (352)..(352): a, c, t, g, unknown or other
  misc_feature (352)..(352): n is a, c, g, or t
  modified_base (491)..(491): a, c, t, g, unknown or other
  misc_feature (491)..(491): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgtcgacattaggacttttttggcctggtttcagcaggagcctggcaaagcccctaagtccctgatcttttctggatccactttgaagagtggagtcccagccaggttcagcggcagtggtctgggacacatttcactctcaccatcagcagcctgcagcctggagtatttcgngacttattactgccaacatattctttttatccgttactagttttggcctagggaccagctggagatacaagactgtgctgcacatctgtcttcatctcccgcatctgtatatatactgtctgagcggctggctaggcgntag

SEQ ID NO: 289046 - DNA, 607 bp, Homo sapiens
  misc_feature: GYAE6OF02GFHS2.44.75.G09.1.454.CMB.1.raw
  modified_base (251)..(251): a, c, t, g, unknown or other
  misc_feature (251)..(251): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggttctgggacacatttcactctcaccatcagcagcctgcacgcctggacgatttcgacgtacttacttactgacctaaacgaattatttctttttactaccgttactagttttcggaccgtacggggtaccaaggtactacgggaagtatacgaaacggtaacttggtaggtctcgacctaaccgattaccgtacgttccttaccgtacttccgttcccgtaccgtacttacgtacgtacttacgttaacttaccgttacgttcgtaggtacggtcgggtcgtacgggacgtacgggtaccgacgtaacg

SEQ ID NO: 289047 - DNA, 502 bp, Homo sapiens
  misc_feature: GYAE6OF02F1EPO.44.75.G09.1.454.CMB.1.raw
  modified_base (459)..(459): a, c, t, g, unknown or other
  misc_feature (459)..(459): n is a, c, g, or t
  modified_base (475)..(475): a, c, t, g, unknown or other
  misc_feature (475)..(475): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagttaccatcacttgccgggcgagtgccgacattaggacttttttggcctggtttcagcaggagcctggcaaagccccctaagtccctgatcttttctggatccactttgaagagtggagtcccagccaggttcagcggcagtggttctgggacacatttcactctcaccatcagcagcctgcagcctggagatttcgcgactttatactgcccaacaatattcttttttatccgttactagttttggccaggggaccaagctggagatcaaaggactgtggctgcacatctgtctcattctccncatctgatatatactntctgagcgggctggcaaggcgacatag

SEQ ID NO: 289048 - DNA, 499 bp, Homo sapiens
  misc_feature: GYAE6OF02FF5YT.44.75.G09.1.454.CMB.1.raw
  modified_base (251)..(251): a, c, t, g, unknown or other
  misc_feature (251)..(251): n is a, c, g, or t
  modified_base (495)..(495): a, c, t, g, unknown or other
  misc_feature (495)..(495): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggtctgggacacatttcactctcaccatcagcagcctgcagcctggagtatttcgcgacttattactgccaacaatactcttttttatccgtactagttttggccaggggaccaagctaggagatcaaacgactgtgctgcacatctgtcttcatcttcccgctatctgatatatactgtctgagcgggctggcaggcnctag

SEQ ID NO: 289049 - DNA, 492 bp, Homo sapiens
  misc_feature: GYAE6OF02GEIVX.44.75.G09.1.454.CMB.1.raw
  modified_base (252)..(252): a, c, t, g, unknown or other
  misc_feature (252)..(252): n is a, c, g, or t
  modified_base (346)..(346): a, c, t, g, unknown or other
  misc_feature (346)..(346): n is a, c, g, or t
  modified_base (415)..(415): a, c, t, g, unknown or other
  misc_feature (415)..(415): n is a, c, g, or t
  modified_base (490)..(490): a, c, t, g, unknown or other
  misc_feature (490)..(490): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaaagcccctaagtccctgatcttttcnggatccactttgaagagtggagtcccagccaggttcagcggcagtggttctgggacacatttcactctcaccatcagcagcctgcagcctgganatttcgcgacttatactgccaacaatatctttttatccgtatagttttggcctagggaccaagctgganatcaaaggactgtgctgcaccatctgtcttcatctcccgcatctgatatatactgtctgagcggctggacaggcnta

SEQ ID NO: 289050 - DNA, 680 bp, Homo sapiens
  misc_feature: GYAE6OF02H7VZG.44.75.G09.1.454.CMB.1.raw
tcagacagtatatacacgaccggtgctcgatttagtatagacatcagggacttagggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggccttggtttcagcaggagcctggcaaagcccctaaagtccatgattcttttctggatccactttgaagagtggagtcccagccaggttcagcgcagtggtctgggacactatttcactctcaccatcagcagcctgcagcctggatatttcgcgtacttaatactcgaccaaataattactttactttttactaccgttaacttagttttcgggaccgtacggggaacctaaggtcgtaggaacgtaagtaccgaaaagggtaaccgttggtacggtaccgttacggtacctaacccgtacgttaccgttacgttacccttttacgtacctttacccgttacccccgtaccttaacgttccgttaacgttaacgtttaaactttaaccgtttaaccgttcggtttaaccgttacgggttaaccgggtacccggggttaccggttaaccggggtaacgtaaccggggtccggttaaccgg

SEQ ID NO: 289051 - DNA, 561 bp, Homo sapiens
  misc_feature: GYAE6OF02FUMXL.44.75.G09.1.454.CMB.1.raw
  modified_base (250)..(250): a, c, t, g, unknown or other
  misc_feature (250)..(250): n is a, c, g, or t
tcagacagtatatacacgaccggtgctcgatttagtatagacatcagggacttaggggctttgccaggctcctgctgctctgtttccccggtgtcaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagagtggagtcccagccaggttcagcggcagtggttctgggacacatttcactctcaccatcagcagcctgcagcctggagtatttcgcgtacttattactgaccaataattatttcttttttactccgttactaggttttcggccgtaggggtacctaaggtcgtagggagtacgtacgaaaggtaactggtcggctgctaccatctgttcttctacttccttcccgtacctacttctagtacttagtacttacttcgtctaggacggtcgggtctgggaccgtaggccgtacgtag

SEQ ID NO: 289052 - DNA, 529 bp, Homo sapiens
  misc_feature: GYAE6OF02JZFS9.44.75.G09.1.454.CMB.1.raw
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggtctggacacatttcactctcaccatcagcagcctgcagcctggatatttcgcgtacttattacngaccaaanaattattactttttatccgttactagttttcggcctagggaccaagtcgtaggagtatacaaaggtaactgtgtctgacactatctagtcttcgtacttcctcccgctattctagtatagtactacttgtactgacgcggtcgtggacgacggcgctag

SEQ ID NO: 289053 - DNA, 491 bp, Homo sapiens
  misc_feature: GYAE6OF02IH62R.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccttcctccctgtctgcttctataggagacagagtcgccatcacttgccgggcaagtcagaccattaacagctatttaaattggtatcagcagagaccagggaaagcccctgaactcctgatctctgctgcctccactctgcaaggtggagtctcttcaaggttcagtggcagtggatctgggacagatttcactctcaccatctccagtctgcaacctgaagattttgctaacttactactgtcaacagagttatactgccccgttcactttggtcggggaccaagctggagatacaaacgactgtggctgcaccatctgtcttcactcttcccgccatctgatatatactgtctgagcggctggacg

SEQ ID NO: 289054 - DNA, 525 bp, Homo sapiens
  misc_feature: GYAE6OF02GY2JE.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagtatttcgcgtacttatactgaccaaactaattattctttttactccgttactagttttcggccgtagggaccaagcgtaggagatacgaaaggactgtgctgcacctatctgtcttctacttcctcccgctactctagtatatatacttgtcgtgagtcggtcgtggacgaggcgagtag

SEQ ID NO: 289055 - DNA, 506 bp, Homo sapiens
  misc_feature: GYAE6OF02ICXSR.44.75.G09.1.454.CMB.1.raw
  modified_base (503)..(503): a, c, t, g, unknown or other
  misc_feature (503)..(503): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggcctggtttcagcaggagcctggcaaagcccctaagtccctgatcttttctggatccactttgaagagtggagtcccagccaggttcagcggcagtggttctggggacacatttcactctcaccatcagcagcctgcagcctggagatttcgcgacttatactgccaaacaattattcttttttatccgttactagttttggccaggggaccaagctggagatacaaaggactgtgctgcaccatctgtcttcactcctcccgcctatctgatatatactgtctgaggcggctggcaggcgntag

SEQ ID NO: 289056 - DNA, 538 bp, Homo sapiens
  misc_feature: GYAE6OF02HH1IP.44.75.G09.1.454.CMB.1.raw
  modified_base (251)..(251): a, c, t, g, unknown or other
  misc_feature (251)..(251): n is a, c, g, or t
  modified_base (345)..(345): a, c, t, g, unknown or other
  misc_feature (345)..(345): n is a, c, g, or t
  modified_base (535)..(535): a, c, t, g, unknown or other
  misc_feature (535)..(535): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggttctgggacacatttcactctcaccatcagcagcctgcagcctgganatttcgcgtacttatactgccaacaatattcttttttatcccgttactagtttttcggaccgtaggggacctaaagcgttagggagtagttacgaaaagggaaccttggtggctcggcaccattctgttcttcacttccttcccgcctacttctgattagtatacttgtctgacgcggctggcaggtcgntag

SEQ ID NO: 289057 - DNA, 530 bp, Homo sapiens
  misc_feature: GYAE6OF02GOFSP.44.75.G09.1.454.CMB.1.raw
  modified_base (354)..(354): a, c, t, g, unknown or other
  misc_feature (354)..(354): n is a, c, g, or t
  modified_base (399)..(399): a, c, t, g, unknown or other
  misc_feature (399)..(399): n is a, c, g, or t
  modified_base (512)..(512): a, c, t, g, unknown or other
  misc_feature (512)..(512): n is a, c, g, or t
  modified_base (528)..(528): a, c, t, g, unknown or other
  misc_feature (528)..(528): n is a, c, g, or t
tcagacagtatatacacgaccggtgctcgatttagtatagacatcagggacggttaggggctttgccaggctcctgctggctctgtttccccggtgccaggtggtgacatcgagatgacccagtctccgtcctcactgtctgcgtctagttggggacagagtcaccatcacttgccgggcgagtgccgacattaggacttttttggcctggtttcagcaggagcctggcaaagcccctaaagtccctgatcttttctggatccactttgaagagtggagtcccagccaggttcaagccggacagtggttctgggacacatttcactctcaccatcagcagcctgcagcctgganatttcgcgtacttattactgaccaaacaacttacttcttttttanccgttactagttttggcctaggggtaccaaggtcgtaggagtagtacgaaaggtactggtgctgcactatctgttcttcattcgtacccgctatcgtgatatatactgtctgngcggcgtggcaggcgnag

SEQ ID NO: 289058 - DNA, 501 bp, Homo sapiens
  misc_feature: GYAE6OF02GBY8U.44.75.G09.1.454.CMB.1.raw
  modified_base (472)..(472): a, c, t, g, unknown or other
  misc_feature (472)..(472): n is a, c, g, or t
  modified_base (498)..(498): a, c, t, g, unknown or other
  misc_feature (498)..(498): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgacttattactgccaacaatatctttttatccgtacagttttggccgtagggaccaagtctggagatacaaaggactgtggctgcaccatctgtcttcatccttccgcctatctgatatntactgtctgagcgggctggcaggcgntag

SEQ ID NO: 289059 - DNA, 522 bp, Homo sapiens
  misc_feature: GYAE6OF02F570Z.44.75.G09.1.454.CMB.1.raw
  modified_base (328)..(328): a, c, t, g, unknown or other
  misc_feature (328)..(328): n is a, c, g, or t
  modified_base (345)..(345): a, c, t, g, unknown or other
  misc_feature (345)..(345): n is a, c, g, or t
  modified_base (370)..(370): a, c, t, g, unknown or other
  misc_feature (370)..(370): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttctggatccactttgaagagtggatcccagccaggttcagcggcagtggttctgggacacatttcactctcaccatcancagcctgcagcctgganatttcgcgacttatactgaccaaanaattattcttttttactccgttactagttttcggcctaggggaccaagctaggagtatacaaaggaactgtggctgcacatctcgtcttcattccttcccgctatctagtactatactacttgtctgacgcgggtctggacacggcgatacg

SEQ ID NO: 289060 - DNA, 509 bp, Homo sapiens
  misc_feature: GYAE6OF02JFKTG.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtacttattactgaccaacaatattctttttatccgtactagttttcggccgaggggacctaagctggagatacaaaggaactgtgctgcacgatctgttctcacttcttcccgccatctgatatatactgtctgacgcgggtctggcaggcgctag

SEQ ID NO: 289061 - DNA, 508 bp, Homo sapiens
  misc_feature: GYAE6OF02FQXBJ.44.75.G09.1.454.CMB.1.raw
  modified_base (506)..(506): a, c, t, g, unknown or other
  misc_feature (506)..(506): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtccccagccaggttcagcggcagtggttctgggacacatttcactctcaccatcagcagcctgcagcctggagatttcgcgtacttattactgccaacaattatcttttttatccgtactagttttggcctaggggaccaagctggagatacgaaaggtactgtgctgcaccatctgtcttcacttcctcccgcctatctgatagtatactgtctgagcggctggcacggcgnag

SEQ ID NO: 289062 - DNA, 512 bp, Homo sapiens
  misc_feature: GYAE6OF02HJGEC.44.75.G09.1.454.CMB.1.raw
  modified_base (251)..(251): a, c, t, g, unknown or other
  misc_feature (251)..(251): n is a, c, g, or t
  modified_base (347)..(347): a, c, t, g, unknown or other
  misc_feature (347)..(347): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtccccagccaggttcagcggcagtggttctgggacacattttcactctcaccatcagcagcctgcagcctgganatttcgcgtacttattactgaccaacaatattactttttatccgttactagttttggcctaggggacaagctggagatacaaaggaactgtgctgcacatctgtcttcactccttcccgctatctgtatatatactgtctcgaggcggcgtggcgaaggcgctag

SEQ ID NO: 289063 - DNA, 689 bp, Homo sapiens
  misc_feature: GYAE6OF02H5BIR.44.75.G09.1.454.CMB.1.raw
  modified_base (279)..(279): a, c, t, g, unknown or other
  misc_feature (279)..(279): n is a, c, g, or t
tcagacagtatatacacgaccggtgctcgatttagtatagacatctaggggtacgttagggactttggccaggctcctgcgtgactctcgtttccccggtgccagggtcgtggaccacttcgacgactgacccagtcctccgtcctcactgtctgcggtctagttcgggacagagtcacatcacttcgcccggcgagtgccgacgacttaggactttttggccgttggttccagcaggagcctggacgaaacgcccctaagtccctagacttcgtttcnggtatccactttgaagagtggactacccagtccaggttcagccgacagtggttctgggtacacgatttacactctacaccactcgaacggccagcctgccacgcctgggaacgtcttttaccggcgtaactttagtacctacgaccctaaacctaacgtttacttacttttttactacccgttacgtacgtttttcggaccgtacgggtaccgaaggtcgtagggagacttacgtaaaacggtaacgttacgtacggactacgactaacctacgttcgttacggttcctttacctaacttacccttacccgtaccttacgttaccgttacgtaacgttaacgttaacttaccttacgttccgttacggtacggcgggtaccgacggtacccgtaaccggcgtacgtaacg

SEQ ID NO: 289064 - DNA, 507 bp, Homo sapiens
  misc_feature: GYAE6OF02GMC12.44.75.G09.1.454.CMB.1.raw
  modified_base (488)..(488): a, c, t, g, unknown or other
  misc_feature (488)..(488): n is a, c, g, or t
  modified_base (504)..(504): a, c, t, g, unknown or other
  misc_feature (504)..(504): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtccccagccaggttcagcggcagtggttctgggacacatttcactctcaccatcagcagcctgcagcctggagatttcgcgacttatactgccaaacaatattcttttttatccgttactagttttggccaggggaccaagctggagatacaaaggaactgtggctgcaccatctgtcttcatccttcccgccattctgatagtatactgtctgngcgggctggcaggcgntag

SEQ ID NO: 289065 - DNA, 505 bp, Homo sapiens
  misc_feature: GYAE6OF02F4OS3.44.75.G09.1.454.CMB.1.raw
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
  modified_base (501)..(501): a, c, t, g, unknown or other
  misc_feature (501)..(501): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtccccagccaggttcagcggcagtggttctgggacacatttcactctcaccatcagcagcctgcagcctggagatttcgcgacttattactgaccaacaatattcttttttatccgtactagttttggccaggggaccaaggctggagatacgaaaggaactggtgctgcaccatctgtcttcatcctccgctatctgntatntactgtctgagcggctggcaggcgntacg

SEQ ID NO: 289066 - DNA, 731 bp, Homo sapiens
  misc_feature: GYAE6OF02IPFVY.44.75.G09.1.454.CMB.1.raw
  modified_base (253)..(253): a, c, t, g, unknown or other
  misc_feature (253)..(253): n is a, c, g, or t
  modified_base (371)..(371): a, c, t, g, unknown or other
  misc_feature (371)..(371): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgattcttttcnggatccactttgaagagtggagtcccagccaggttcagcggcagtggttctgggacacatttccactctcaccatcagcagcctgcagcctggatactttcgacgtactttacttacncgacccaaactaatttactttacctttttttaactcccggtttaacttacggttttttcgggtacccgtaacgggggtaaccctaaagggtaccgttagggtaaacggtaacgttaaccgtaaaaaggggtaaccttagggtacgggtacgttacggaccgtaaccctaacgtttaccgttacggtttaccctttaccttaaccgttttcccgttacccccggtacccttacgtttcccgttacggttaactttaaccgtttaacgttaacccgttttacggttaccgtttacgggtaacgggttcccgggggtaccggtttaggggaacccgtaaccggggtacccggtacgttaacgg

SEQ ID NO: 289067 - DNA, 503 bp, Homo sapiens
  misc_feature: GYAE6OF02F7Q31.44.75.G09.1.454.CMB.1.raw
  modified_base (372)..(372): a, c, t, g, unknown or other
  misc_feature (372)..(372): n is a, c, g, or t
  modified_base (500)..(500): a, c, t, g, unknown or other
  misc_feature (500)..(500): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacgatttcactctcaccatcagcagcctgcagcctggagattttcgcgtacttattactgccaanaattattcttttttatccgttactagttttggcctaggggaccaagctggagatacaaagactgtgctgcaccatctgtcttcatcttccgcatcctgatatatactgtctgagcggctggcaggcgntag

SEQ ID NO: 289068 - DNA, 509 bp, Homo sapiens
  misc_feature: GYAE6OF02GMFPF.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctaactgtctgcgtctattggggacagagtcaccatcacttgccgggcgagtgccgacattaggacttttttggcctggtttcagcaggagcctggcaaagccccctaagtccctgatcttttctggatccacttttgaagagtggagtcccagccaggttcagcggcagtggttctgggacacatttcactctcaccatcagcagcctgcagcctggagatttcgcgacttattactgccaacaattattctttttatccgttactagttttggcctaggggaccaagctggagatacaaaggactgtgctgcaccatctgtcttcatccttcccgcctatctgatatatactgtctgagcgggctggcaaggcgacatag

SEQ ID NO: 289069 - DNA, 549 bp, Homo sapiens
  misc_feature: GYAE6OF02GK0NT.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttctggatccactttgaagagtggagtcccagccaggttcagcggcagtggttctgggacacatttcactctcaccatcagcagcctgcagcctggatatttcgcgtacttattactgaccaaactaattatttcttttttactccgttacttaggttttcggccgtaggggaccaagtcgtaggagagtacgaaaggtactggtgctgcaccattctgttcttctacttccttcccgctactctagtattatactacttcgtcgtggacggcgggtcgtcgggacgacggcgacgtaacg

SEQ ID NO: 289070 - DNA, 497 bp, Homo sapiens
  misc_feature: GYAE6OF02F7USC.44.75.G09.1.454.CMB.1.raw
  modified_base (495)..(495): a, c, t, g, unknown or other
  misc_feature (495)..(495): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagattttcgcgtacttatactgccaacaatatctttttatccgttactagttttggcctaggggaccaagctggagatcaaaggactgtggctgcacatctgtcttcatctccgcatctgatatatactgtctgtaggcggctggcaggcgnag

SEQ ID NO: 289071 - DNA, 584 bp, Homo sapiens
  misc_feature: GYAE6OF02FOMB3.44.75.G09.1.454.CMB.1.raw
  modified_base (256)..(256): a, c, t, g, unknown or other
  misc_feature (256)..(256): n is a, c, g, or t
  modified_base (355)..(355): a, c, t, g, unknown or other
  misc_feature (355)..(355): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgattcttttcnggatcctactttgaagagtggagtcccagccaggttcaggcggcaggtggttctgggacactatttcactctcaccatcagcagcctgcagcctggatntttcgcgtacttattactcgacccaaataattacttacttttttactaccgttacttaggttttcggaccgtaaggggtacctaaaggtccgttagggacgtaagtaacgaaaggtacgtggtggtctcgactacctattcctcgttcttctacttccttccccgtctacttctagtattactactacttcgtctaggtacggcgggtctaggacgacggtcgactacg

SEQ ID NO: 289072 - DNA, 535 bp, Homo sapiens
  misc_feature: GYAE6OF02GEERU.44.75.G09.1.454.CMB.1.raw
  modified_base (481)..(481): a, c, t, g, unknown or other
  misc_feature (481)..(481): n is a, c, g, or t
  modified_base (531)..(531): a, c, t, g, unknown or other
  misc_feature (531)..(531): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttctggatccactttgaagagtggagtcccagccaggttcagcggcagtggttctgggacacatttcactctcaccatcagcagcctgcagcctggagtatttcgcgtacttattactgaccaaacaatactttctttttatccgttactagttttcggccgtaggggaccaagcgtaggagtatacgaaaggactagtggatgacaccatctcgtcttctacttccttcccncctactctagtattatatactcgtctggtagtcgggcgtggacgaggcgntacg

SEQ ID NO: 289073 - DNA, 577 bp, Homo sapiens
  misc_feature: GYAE6OF02IJQ11.44.75.G09.1.454.CMB.1.raw
  modified_base (308)..(308): a, c, t, g, unknown or other
  misc_feature (308)..(308): n is a, c, g, or t
  modified_base (510)..(510): a, c, t, g, unknown or other
  misc_feature (510)..(510): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaagcccctaagtccctgattcttttctggactccactttagaagagtggagtcccagccaggttcagcggctagtggttcngggacactatttcactctcaccatcagcagcctgcagcctggagtatttcgcgtacttacttactgacccaaactaatttactttcttttttaacgtaccgttactagttttacggaccgtaagggtaaccaacgtcgtaggagtataacgtaaaggacttagtggtactgacacctatctcgttcttctacttccttcccncctactctagtacttagtacttacttcgtcgttacggaggtcggtcgtggaccgacggtcgagtacg

SEQ ID NO: 289074 - DNA, 576 bp, Homo sapiens
  misc_feature: GYAE6OF02GD8GF.44.75.G09.1.454.CMB.1.raw
  modified_base (570)..(570): a, c, t, g, unknown or other
  misc_feature (570)..(570): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcaagtcagaccattaacagctatttaaattggtatcagcagagaccagggaaagcccctgaactcctgatctctgctgcctcactctgcaaggtgagtctcttcaaggttcaggtggcaggtggatcgtgggacagtatttcactctcaccatcctcagtctgactaactgaagtatttgactaacttactactagtacaacagtacgtttactacgtcgtaccccgtttactaccggttttcgggacccggggtaacctaaggtccgtagggtaacgtacgtaaccgaaaacgtacgtggtacggtacctagacctaccgtattcgtcgttccttactacttccttcccgctacgtctagtactatacttacgtcgtcgtggacgtcgggtacgnggtacg

SEQ ID NO: 289075 - DNA, 526 bp, Homo sapiens
  misc_feature: GYAE6OF02HBPZR.44.75.G09.1.454.CMB.1.raw
  modified_base (524)..(524): a, c, t, g, unknown or other
  misc_feature (524)..(524): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggacgtatttcgcgtacttattactgacccaaataattattctttttatccgttactagttttcggccgaggggaccagctaggagatacgaaaggactgtgctgcaccatctgtcttcattccttcccgctactctagattacgtactacttcgtctgacgtcgggtctcggcgaacggcgnag

SEQ ID NO: 289076 - DNA, 545 bp, Homo sapiens
  misc_feature: GYAE6OF02GA26E.44.75.G09.1.454.CMB.1.raw
  modified_base (252)..(252): a, c, t, g, unknown or other
  misc_feature (252)..(252): n is a, c, g, or t
  modified_base (541)..(541): a, c, t, g, unknown or other
  misc_feature (541)..(541): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgatcttttcnggatccactttgaagagtggagtcccagccaggttcagcggcagtggttctgggacacatttcactctccaccatcagcagcctgcagcctggagtatttcgcgtactttattacctaaccaaactaattatttcttttttactcccgttaacttagttttacggccgtaggggacctaaggtcgtagggagatacgaaaggacgttggtggcgtcgccaccatctgttcttctactccttcccgctatctgtatatattactgtctgacgtcggcgtggacgaggcgngatg

SEQ ID NO: 289077 - DNA, 686 bp, Homo sapiens
  misc_feature: GYAE6OF02JLSM3.44.75.G09.1.454.CMB.1.raw
tcagacagtatatacacgaccggtgctcgatttagtatagacatcaggacttagggctttgccaggctcctgctgctctgtttcccggtgccaggtgtgacatcgagatgacccagtctccgtcctcactgtctgcgtctattgggacagagtcaccatcacttgccgggcgagtcgccgacagttacggtacttttttggccttgggtttcagtctaggacgccgttggccaaagccccctaaaggtcccctggacttccttttctggtactccacttttgaacgtagtggacgttcccagtcctaaggttccaggtccggactaggttcgggtttactggggaacctacgtactttccgaaccttctccacctattccgagccacgcctgacacgtcctaggactagttttcgacgtactttaattaccgtcgaccctaaactaactttactttacgttttttttaactacccggtttacttacggtttttcggacccgtaaggggtaccctaaaggtccgtaggtacgtaacttacggtaaaaggtaccttgggttacggtacttcggacctaacctagttcccgttagtttcccttagtacttcccgttacccgctattcctagtatacttaattactcgttaccgtgtacggccggttgtacggactacgggccgtatacg

SEQ ID NO: 289078 - DNA, 546 bp, Homo sapiens
  misc_feature: GYAE6OF02F50WF.44.75.G09.1.454.CMB.1.raw
  modified_base (354)..(354): a, c, t, g, unknown or other
  misc_feature (354)..(354): n is a, c, g, or t
  modified_base (373)..(373): a, c, t, g, unknown or other
  misc_feature (373)..(373): n is a, c, g, or t
  modified_base (542)..(546): a, c, t, g, unknown or other
  misc_feature (542)..(546): n is a, c, g, or t
tcagacagtatatacacgaccggtgctcgatttagtatagacatcagggacttaggggcgtttcgccaggctccctgctgctctgtttccccggtgccaggtggtgacatcgacgatgacccagtctccttccttcctgtcttcttctgttggaggcagcgtcaccatcacttgccgggcgagtcaggtcgttttcggtgctgttgcctggtttcaacaaaaagggggagaggccctaaggtcctcgtctctcgtgaaaccagactggaaggtagagtcccgtccaggttcagtgccagtccaggtggtgggccggagtccactctcaccattagcgacctgccggcctgaagnttctgctaactttatttcngtcagcagtatcatagtcgccccgtttctacgttttcggccgaggggaccaagcgtaggaaatacaaacgtacgtggtaggtctagccacgatctgttcttctactccttcccgcctactctagtatatatactgttctgacggcgggctgggacaggccgcacgtagnnnnn

SEQ ID NO: 289079 - DNA, 605 bp, Homo sapiens
  misc_feature: GYAE6OF02GUA2T.44.75.G09.1.454.CMB.1.raw
  modified_base (251)..(251): a, c, t, g, unknown or other
  misc_feature (251)..(251): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggttctgggacacatttcactctcaccatcagcagcctgcagcctgacgtatttcgcgtacttattactgaccaacaattaactttcttttttaatcccgttaactaggttttttcggaccgtacgggggtaacctaaggtccgttagggtacgaattaccgtaaaagggaaaccttggtagggccttaggccaacctattccgttcgttactttcctacttacccgttccccgtcctaacgttccttagtaacttagttacttaccttgttacctggacggcgggtcgtggaccgaaggcgacgtacg

SEQ ID NO: 289080 - DNA, 549 bp, Homo sapiens
  misc_feature: GYAE6OF02HJXQB.44.75.G09.1.454.CMB.1.raw
  modified_base (251)..(251): a, c, t, g, unknown or other
  misc_feature (251)..(251): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggttctgggacacatttcactctcaccatcagcagcctgcagcctggatatttcgcgtacttattactgaccaaactaattactttcttttttactaccgttactacgttttggccgtaggggaaccaacggtctagggagaagtacgaaaggaactgtggctcgccacctatcctgttccttctacttccttcccgcctatctacgtattataatacttgtctggacgtcgggcgtggacgacggcgactag

SEQ ID NO: 289081 - DNA, 639 bp, Homo sapiens
  misc_feature: GYAE6OF02I2ZKA.44.75.G09.1.454.CMB.1.raw
  modified_base (281)..(281): a, c, t, g, unknown or other
  misc_feature (281)..(281): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaagccctaccgtacctctatctttcttgatcacttagtagagtggtagccacgcngtgacgcggcgagtggttcgtcggacgacattctactcctcaccactcacgacacgcctcgcacgtccgtcggtacgtatttcgtcgtaactttacttactcgaccaacctaattaacttcttttttaactccggtaacttagttttcgggccgaacggggaaccgtaacgctgggaatagtactaaagggaacgttgtgggactcgaccgtaaccctagttactttcgttacgtttccaacttcccgtttccccgaccatttcttacgtatttaacttacgtttacccgttagttccggttaaggacgggtaccggggtccgttaccggggtacgaaccgggtacggtccctaaagg

SEQ ID NO: 289082 - DNA, 533 bp, Homo sapiens
  misc_feature: GYAE6OF02GEK41.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagtatttcgcgtactttattactgaccaaactaattactttcttttttactccgttactaggttttcggccgtaggggtaccaaggtcgtagggagtatacgaaaggtactgtggctgcaccatctgtcttcattccttccgctatctgatatatacttgtctgacggcgggcgtggacacggcgactag

SEQ ID NO: 289083 - DNA, 507 bp, Homo sapiens
  misc_feature: GYAE6OF02IHPOM.44.75.G09.1.454.CMB.1.raw
  modified_base (249)..(249): a, c, t, g, unknown or other
  misc_feature (249)..(249): n is a, c, g, or t
  modified_base (341)..(341): a, c, t, g, unknown or other
  misc_feature (341)..(341): n is a, c, g, or t
  modified_base (361)..(361): a, c, t, g, unknown or other
  misc_feature (361)..(361): n is a, c, g, or t
  modified_base (420)..(420): a, c, t, g, unknown or other
  misc_feature (420)..(420): n is a, c, g, or t
  modified_base (504)..(504): a, c, t, g, unknown or other
  misc_feature (504)..(504): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggacaagccctaagtccctgatcttttnggatccactttgaagagtggagtccagccaggttcagcggcagtgtctgggacacatttcactctcaccatcagcagcctgcagccctgganattttcgcgtacttattacngaccaactaattatcttttttatccgttactagttttgccgagggaccaagtcgtaggnatacgaaaggaactgtgctgcaccatctgttctcatccttccgctatctgatagtaatcttgcttggagtcggctggacaggcntag

SEQ ID NO: 289084 - DNA, 589 bp, Homo sapiens
  misc_feature: GYAE6OF02HCD65.44.75.G09.1.454.CMB.1.raw
  modified_base (257)..(257): a, c, t, g, unknown or other
  misc_feature (257)..(257): n is a, c, g, or t
  modified_base (308)..(308): a, c, t, g, unknown or other
  misc_feature (308)..(308): n is a, c, g, or t
tcagacagtatatacacgaccggtgctcgatttagtatagacatcagggacttaggggctttgccaggctcctgctgcgtctgtttccccggtgccaggtgtgacatcgagatgacccagtctccgtcctcactgtctggcgtctattggggacagagtcaccatcacttgccgggcgagtgccgacattaggacttttttggcctggtttcagcagggagccgtggacaaacgcccctaagtccctgatcttttcnggatccactttgaagagtggagtcccagccaggttcagcggcagtggttcngggacactatttcactctcaccatcagcagcctgcagcctggagtattttcgacgtactttattacgtcgacctaacaattactttcttttttatcccgttactaggtttttcggccgtacggggtaacctaaaggtccgtagggaagtaattaaccgaaaggtaacgttggtaggtcctaggacaaccgtattacgtgttcttactacttccttccccgctactctagtattataatacttgtactggtacgcgggtactcggacgaacgggtcgatacg

SEQ ID NO: 289085 - DNA, 506 bp, Homo sapiens
  misc_feature: GYAE6OF02HWRPA.44.75.G09.1.454.CMB.1.raw
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
  modified_base (504)..(504): a, c, t, g, unknown or other
  misc_feature (504)..(504): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtccccagccaggttcagcggcagtggttctgggacacatttcactctcaccatcagcagcctgcagcctggagatttcgcgtacttattactgaccaaacaatattcttttttatccgtactagttttggcctaggggaccaagctggagatcaaagactgtggctgcaccatctgtcttcattcttcccgcatctgatatatactgtctgagcgggntcggnaacggcgnag

SEQ ID NO: 289086 - DNA, 603 bp, Homo sapiens
  misc_feature: GYAE6OF02GXIUG.44.75.G09.1.454.CMB.1.raw
  modified_base (293)..(293): a, c, t, g, unknown or other
  misc_feature (293)..(293): n is a, c, g, or t
  modified_base (334)..(334): a, c, t, g, unknown or other
  misc_feature (334)..(334): n is a, c, g, or t
  modified_base (344)..(344): a, c, t, g, unknown or other
  misc_feature (344)..(344): n is a, c, g, or t
tcagacagtatatacacgaccggtgctcgatttagtatagacatcagggacttagggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgatcttttctggactccactttgaagagtggagtccagccaggttcagcggnagtgttctgggacacatttcactctcaccatcagcagcctncagcctgganattttcgacgactttattactcgaccaacaattgttcttttttataccgttactagttttggccgtaaggggtaccaagacgtggagtactacgaaaaggtacgtagtcggtactcggacctaacctaacgttccttgttaccttacctattacccgttcccgtaccctacgttaccgtattactttaataacccgttgttactacggtaacggtccggggtccgttagggccgtaaagggccggtactaacggttacg

SEQ ID NO: 289087 - DNA, 560 bp, Homo sapiens
  misc_feature: GYAE6OF02FZ75H.44.75.G09.1.454.CMB.1.raw
  modified_base (372)..(372): a, c, t, g, unknown or other
  misc_feature (372)..(372): n is a, c, g, or t
tcagacagtatatacacgaccggtgctcgatttagtatagacatcgagggacttaggggctttgccaggcgtcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagctgcagcctggatatttcgcgtattattactgaccaaanaattattacttttttatccgttactagttttggacctaggggaccaaagtcctaggagtacgtaacgaaaggtaacttgtcggctcgacacctatctcgtcttcacttccttcccgcctatcgtgtaatacgtacttactcgttcgtaggtacggtcggtcgtacggtaccgaacgggtcgacgtaag

SEQ ID NO: 289088 - DNA, 543 bp, Homo sapiens
  misc_feature: GYAE6OF02FW36C.44.75.G09.1.454.CMB.1.raw
  modified_base (417)..(417): a, c, t, g, unknown or other
  misc_feature (417)..(417): n is a, c, g, or t
tcagacagtatatacacgaccggtgctcgatttagtatagacatcagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcttggacagtcagtcaccatctcctgcactggcaccagcagtgacattggtggttataactttgtctcctggtaccaacacacccaggcaaagcccccaaattcatcatttatgatgtcagtaagcggccctcaggggtccctgactcgcttctctggctccaagtctggcaacacggcctccctgaccgtctcgtgggctccgaggctgaggatggaggctgacttattcngtctcctcatatgcgaggcgtactaggtttttatcgttcttcggaacgtgggaacccaggttccaccgttcctacgtcacgacccgaacggcccaaccccgtactcgtacctaccgtcttacccgg

SEQ ID NO: 289089 - DNA, 634 bp, Homo sapiens
  misc_feature: GYAE6OF02JIUOV.44.75.G09.1.454.CMB.1.raw
  modified_base (251)..(251): a, c, t, g, unknown or other
  misc_feature (251)..(251): n is a, c, g, or t
tcagacagtatatacacgaccggtgctcgatttagtatagacatcagggacttaggggctttgccagtctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcaggtggttctgggacactatttcactctcacatcagcagcctgcagcctggactatttcgcgtacttattaccgtgacccaacgtaattactttctttttactaccgttacttacgttttacggccgtacggggtaacctaagtacgtacggaagtaagtacgaaaaggtacgtcgtaggtctaggacctaccgaacttccgttacggttacctttacgtaactttcccgttacccgtaccctaacgttccttagtaacttacgttaacgttaaccttcggtaaccgttggtaaccgtccggggtcgtttaccggacggtaacggtaccgtaccgtaacgg

SEQ ID NO: 289090 - DNA, 600 bp, Homo sapiens
  misc_feature: GYAE6OF02H6Z0J.44.75.G09.1.454.CMB.1.raw
  modified_base (252)..(252): a, c, t, g, unknown or other
  misc_feature (252)..(252): n is a, c, g, or t
  modified_base (596)..(596): a, c, t, g, unknown or other
  misc_feature (596)..(596): n is a, c, g, or t
tcagacagtatatacacgaccggtgctcgatttagtatagacatcagggacttagggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggccttggtttcagcaggagcctggcaaagcccctaagtccctgatcttttcnggatcctactttgaagagtggagtcccagccaggttcagcggcagtggttctgggacacatttcactctcaccatcagcagcctgcagcctggatatttcgcgtaactttatactcgaccaaactaattatttaccttttttatcccgtttaacttacgtttttcggaccgtaaggggtaaccctaaggtccgttagggaagtaacgttacgtaaaacgggaacttggtacgggtcctacggaccgtaacctataccgtacgttccgttctacttcccgttcccgacccttatcctagtacttactattactgtctacgacgtcggtcgtggacgtacggcgtntacg

SEQ ID NO: 289091 - DNA, 652 bp, Homo sapiens
  misc_feature: GYAE6OF02G0FFC.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgccttggtttcaacgaaaagggggagacggaccccgtaaggtcctcgtctctcgtacgaaccagactaggaaggtagacgtcccgtcaggttcagtcgccagtccgaggtgggtcgggaccggacgtccacctcgtaccacctagttacgccgtaccgtggccggcccgtaggaacgtactttcgtagtaccttaaactttattttaccgtgttaccgacgtcgtaagttacttactaagttaagtccgtaccccggtttacttaccggtttttcggacccggtacggggtaaccaaggtcgttaacgggaaactaccgaaaacgtaccgttggtacggtactccggacctaccgtaacttccgttacgttcctttacgtacgttccccttacccggtcctacttaccg

SEQ ID NO: 289092 - DNA, 663 bp, Homo sapiens
  misc_feature: GYAE6OF02IY3AX.44.75.G09.1.454.CMB.1.raw
  modified_base (340)..(340): a, c, t, g, unknown or other
  misc_feature (340)..(340): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtgagtcccagccaggttcagcgcagtgtctggacacattcactctcaccatcagcagcatgcagcctggaantttcgcgtacttattactgacctaactaattacttactttttatccgttaacttacgttttacggccgtaagggggtaaccctaaaggtccgtagggaacgtaacgtacccgaaaaagggtaacctagggtacggtaccgtacggtaccgtaacccgtaagttccgttacgtttacccgtttacctaaaccgtttcccgtttacccccgaccttaaccgttaccgttacgggtaactttaacttaacgttaccgttaacggttccgtttacggtacggtaccggggtccgtttaggggaacccgtaagggttcccggtaacgg

SEQ ID NO: 289093 - DNA, 541 bp, Homo sapiens
  misc_feature: GYAE6OF02G662Q.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgattcttttctggatccactttgaagagtggagtcccagccaggttcagcggcagtggtctgggacacatttcactctcaccatcagcagcctgcagcctggagatttcgcgtacttatactgaccaatattattcttttttactccgttactacgttttggcctacggggtaccaagtcgtaggagtatacgaaaggtaactgtaggctgccacacttcgtgtcttcacttccttcccgcctactctgtatacttatacttgtcctaggaggtcgggcttggacgtacggcgactaag

SEQ ID NO: 289094 - DNA, 496 bp, Homo sapiens
  misc_feature: GYAE6OF02F6JP1.44.75.G09.1.454.CMB.1.raw
  modified_base (450)..(450): a, c, t, g, unknown or other
  misc_feature (450)..(450): n is a, c, g, or t
  modified_base (464)..(464): a, c, t, g, unknown or other
  misc_feature (464)..(464): n is a, c, g, or t
  modified_base (470)..(470): a, c, t, g, unknown or other
  misc_feature (470)..(470): n is a, c, g, or t
  modified_base (485)..(485): a, c, t, g, unknown or other
  misc_feature (485)..(485): n is a, c, g, or t
  modified_base (494)..(494): a, c, t, g, unknown or other
  misc_feature (494)..(494): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagccccctaagtccctgatcttttctggatccactttgaagagtggagtccccagccaggttcagcggcagtggttctgggacacatttcactctcaccatcagcagcctgcagcctggagatttcgcgtacttattactgccaacaatatcttttttatccgtactagttttggccagggaccaagctggagatacaaaggactgtgctgcacatctgtcttnatcctcccgcatcngatatntactgtctgagcggntggcaggcnag

SEQ ID NO: 289095 - DNA, 560 bp, Homo sapiens
  misc_feature: GYAE6OF02H91OZ.44.75.G09.1.454.CMB.1.raw
  modified_base (251)..(251): a, c, t, g, unknown or other
  misc_feature (251)..(251): n is a, c, g, or t
  modified_base (302)..(302): a, c, t, g, unknown or other
  misc_feature (302)..(302): n is a, c, g, or t
  modified_base (556)..(556): a, c, t, g, unknown or other
  misc_feature (556)..(556): n is a, c, g, or t
tcagacagtatatacacgaccggtgctcgatttagtatagacatcagggacttagggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggcctggtttcagcaggagcctggcaaagcccctaagtccctgatcttttcnggatccactttgaagagtggagtcccagccaggttcagcggcagtggttcngggacacatttcactctcaccatcagcagcctgcagcctggagatttcgcgtacttattactcgaccaaacaatttactttctttttttactaccgtttactacggtttttcggaccgtaaggggtaccaaggtcgtagggagtaactacgaaaaggtaacttggtcggctggcaacctatctgttcttctacttcctcccgctagtctagtatatactacttgtcgtagaggtcggcgtggccgaaggtccgntaag

SEQ ID NO: 289096 - DNA, 591 bp, Homo sapiens
  misc_feature: GYAE6OF02G7JBD.44.75.G09.1.454.CMB.1.raw
  modified_base (312)..(312): a, c, t, g, unknown or other
  misc_feature (312)..(312): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaacgcccctaagtccctgacttcttttctggatccactttgaagagtggagtccagccaggttcagcggcagtggttctggacactnttcactctcacatcagcagctgcagcctggatatttcgctacttatctcacaactaattatttctttttactccgttacttacgttttcggaccgtaacgggtaccaacgtcgtaggagtaagtacgaaacggtaacgtggtacgcgtcgactacctagttcgtacgttaccttactacttccttcccgaccttactaccgtacgtaacttactaacttaccttacggttaccgtagggtacggccgggtcgtacgggtactacgggtccgtagtaacg

SEQ ID NO: 289097 - DNA, 842 bp, Homo sapiens
  misc_feature: GYAE6OF02JS4TE.44.75.G09.1.454.CMB.1.raw
  modified_base (260)..(260): a, c, t, g, unknown or other
  misc_feature (260)..(260): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagccgtggcaaacgcccctaagtcccctagtacttcttttcnggtacttcctacttttgaaagagtgggaacgttccccgaagtcccgacggtttcgacggtccgggacctaggttcgggttcgttggggacctaaccgtacgttttccaacttccgttcccaaccacttccgaagtccacggtcctgccgagtcccgttaggagttaacgttttccggaccggttaacttttaacgtttacccgtcggtaacccctaaacgtaaaacttttaacgttttacctttttttaaaccgttaccccgttttaaccgtttaacgggtttttttacccgggtacccgggtaacgggggttaaacccgtaaacgggttacccggttaagggtaaacggttaacgttaaccggtaaaacgggtaacgtttacgggacggttaaccgttggaacccgttaccgtaacgtaccgttaccgtttcttaaccttacgttaccccgtttaccccgaacccttaccgttacgttacttaacgtttaacgtttaaccgttaaccgtttcgttacggttaacggtaccggtcggggttaccctacggggttaaccgacgggtacccgtaacggtaacgg

SEQ ID NO: 289098 - DNA, 543 bp, Homo sapiens
  misc_feature: GYAE6OF02H2XD7.44.75.G09.1.454.CMB.1.raw
  modified_base (224)..(224): a, c, t, g, unknown or other
  misc_feature (224)..(224): n is a, c, g, or t
  modified_base (406)..(406): a, c, t, g, unknown or other
  misc_feature (406)..(406): n is a, c, g, or t
  modified_base (540)..(543): a, c, t, g, unknown or other
  misc_feature (540)..(543): n is a, c, g, or t
tcagacagtatatacacgaccggtgctcgatttagtatagacatcagggacttaggggctttgccaggctcctgctgctctgtttccccggtgccaggtgtgacatcgagatgacccagtctccttccttcctgtcttcttctgttggaggcagcgtcaccatcacttgccgggcgagtcaggtcgttttcggtgctgttgcctggtttcaacaaaaagggggngaggccctaaggtcctcgtctctcgtagaaaccagactgggaaggtagagtcccgtccaggttcagtgccagtccaggtggtgggccggagtcccactctcaccattacgcgacctgcggcctgaagattctgctaactttatttctgtcagcaagttatcaattacgtcgtcccccgtttnaaccgtttttggccgaggggaccaagcgtaggaaatacgaaacgactgtaggtctgacaccatctcgtcttctatccttcccgcctactctgtatatatactgtctgaggcggctgggcaaggcgacagtagannnn

SEQ ID NO: 289099 - DNA, 548 bp, Homo sapiens
  misc_feature: GYAE6OF02ISJTL.44.75.G09.1.454.CMB.1.raw
  modified_base (268)..(268): a, c, t, g, unknown or other
  misc_feature (268)..(268): n is a, c, g, or t
  modified_base (348)..(348): a, c, t, g, unknown or other
  misc_feature (348)..(348): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaacgcccctaagtccctgattctttctggatccactttgaagngtggagtccccagccaggttcagcggcagtggttctgggacacatttcactctcaccatcagcagcctgcagcctggatntttcgcgtaacttattactgaccaaactaatttacttcttttttaactccgttactagttttcggaccgtagggaccaagctaggagactacgaaagactgtcgctgacacatctcgttcttcacttcctcccgactactctagtatagttaactacttgtctaggacggtcgggtcgtcggtacgaacggtccgatacg

SEQ ID NO: 289100 - DNA, 863 bp, Homo sapiens
  misc_feature: GYAE6OF02FF8SW.44.75.G09.1.454.CMB.1.raw
tcagacagtatatacacgaccggtgctcgatttagtatagacatctagggtacttacgggcctttgccaggcgtcctgctcgctctggtttccccgtgcccaggtgtgacatcgaggatggaccccagtctcggtctcgacctggtctcgcgtcctattcggggacagagtcaccatcgacttcgcccgggcgagtgccgacgtatttaggacgtttttggccgttcgggtttcagccacggaggaccgtggcgaaagcccctaaagtcccgtaggtattccttttcctggattccgtacgtttggaacgtagttacggagtcccctagcccaggttaccaggtccggacacgtacggttctagggacctaccgtagtttaccaaccgttcctaccaaccctaaattcccgaacggtttccccaaggaccccgttaggccgtaaggttccccttaggggtacggtaaccgttttcccggaccggtaacgtttaacgttaacccggttcggtttaaccctaaacccgtaagtttacgttaccgtttttttaacgtacccgggttaacgttacggttttttaacgggtacccgttaaagggggtaacccgtttaaacgggtaccgtttaggggtaaacggtttaaccgttaacccgaaaaaccgggttaaacgttacgggttacggggtacccgggttacggtacccgtaaccccgtacgggttacccgttacgggttacctttaccgtacgttcccttaccccggtcctaccgttccgtacgtacctacgttaacgtaccttacggttccgttacgtacccggtcgggcccgttaccggtaccgtaaccggtacgacgtaaccg

SEQ ID NO: 289101 - DNA, 554 bp, Homo sapiens
  misc_feature: GYAE6OF02IAUQ1.44.75.G09.1.454.CMB.1.raw
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
  modified_base (380)..(380): a, c, t, g, unknown or other
  misc_feature (380)..(380): n is a, c, g, or t
  modified_base (548)..(548): a, c, t, g, unknown or other
  misc_feature (548)..(548): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacatttaggacttttttggcccttggtttcagcaggagcctggcaaagcccctaagtccctgattcttttcnggatccactttgaagngtggagtcccagccaggttcagcgcagtggttcngggacncatttcatctcaccatcagcagcctgcagcctggatactttcgcgtaacttattactgaccaacaattnttctttttactccgtactagttttcggacctagggaccaagctaggagacgtacgaaaggtactggtcgctcgaccactactctcgttcttcacttccgtcccgacctatctacgattactaacttctagttactcggtacggccggtcgtcggtacgacgggtacgngtaacg

SEQ ID NO: 289102 - DNA, 562 bp, Homo sapiens
  misc_feature: GYAE6OF02H4XUP.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcggatccactttgaagagtgagtcccagccaggttcagcggcagtggttctggggacacgatttcactctcaccatcagcagcctgcagcctggatatttcgcgtacttattactgaccaaacaatactttacttttttagtacccgttactacggtttttggacccgtaaggggtaacctaaggaccgtgggaagtatacgaaacgggaatggtgtactagaccaccatctagttcttccgtattccttccccgcctattctagatattactacttgtctgaggtcgggcgtcggacgaacggtcacgtaag

SEQ ID NO: 289103 - DNA, 797 bp, Homo sapiens
  misc_feature: GYAE6OF02HGXM9.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttgggacagagtcaccatcacttggccgggcgagtgccgactattaggtacttttttggccgttggtttcagcgaggacgtccgtggacaaacgtccccttaaacgtcccctgtacttcctttttcgtcgggtacttccctaacgttttaggaaaggtaggttacgggtaccgttaccccgacggtaccccgttagggtttaccaacgggccgggtaccgttaaggggtttcggggttttccggttacggggggtaacctaaccgttacgtttttacccaacctttccttaccctaacccgtacttaccgacggtaccgaacggtccccttggacctaacgggtcccgttaggggaacgttacgtttttccggaccgttaacttttaactttacgtacgaaccctaaactaattttacttttacttttttacgttaccgtttaacgtttacgggtttttcggacccggtaacggggtaacctaaaggtcgttacgggagtaacgtaacgtaaaacggtacgtggtacggtctacgaccacctacttcgttacgttcctttactacttcccttcccgaccttacttcctacgttactaacttacttacgttcgtcgtacggacggtccgggtcgtggacgacgggcgacgtag

SEQ ID NO: 289104 - DNA, 842 bp, Homo sapiens
  misc_feature: GYAE6OF02GGELC.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacgttcggccgggcgagtcgaccgactagttaggttactttttggccttggtttcagtcgaggacgccgtggacaaaccgtaccccgtaacgtccccgtagtactttcctttttcgtcgggtaccttcccgttaacgttttaggaaaggtacggttacgggtaaccgttaccccgaggtacccggttaacgggtttaccgaacggggtcccggtaacgtacggggttttcgggtttaccggttacggggggtaaaccctaacgtttaacgttttaccaacccgtttcccttaacccgtaaaccctacgtaaccgtaacggacccgtaacggtccccttaggacccgtaaccggtcccggttaaggggtaacttacgttttacccggaccgtttaactttaacgtttaccgtaccggaaccctaaaacgtaaacttttacctttttaccgtttttttaaccgacccggtttaacgtttacgggtttttaccggacccgggttaacgggggtaaccctaaaggttccggtagggtaacgtacgtaacggtaaaacgggtaccgttaggttacgggccttacggaaccctaaccgttacgttaccgttacggtttccctttaccgaccttttcccccgg

SEQ ID NO: 289105 - DNA, 530 bp, Homo sapiens
  misc_feature: GYAE6OF02IJAZX.44.75.G09.1.454.CMB.1.raw
  modified_base (252)..(252): a, c, t, g, unknown or other
  misc_feature (252)..(252): n is a, c, g, or t
  modified_base (465)..(465): a, c, t, g, unknown or other
  misc_feature (465)..(465): n is a, c, g, or t
  modified_base (480)..(480): a, c, t, g, unknown or other
  misc_feature (480)..(480): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgatcttttcnggatccactttgaagagtggagtcccagccaggttcagcggcagtggttctgggacacatttcactctcaccatcagcagcctgcagcctggatacttttcgcgtacttattactgaccaactaatttactttcttttttactaccgttactagttttcggaccgtagggacctagtcgtggagagtacgaaagtactgtgctgcactatctntcttcacttcctccncctatctagtatatatactgtcgtgacgtcggcgtggacgacggcgatag

SEQ ID NO: 289106 - DNA, 523 bp, Homo sapiens
  misc_feature: GYAE6OF02FXJGL.44.75.G09.1.454.CMB.1.raw
  modified_base (465)..(465): a, c, t, g, unknown or other
  misc_feature (465)..(465): n is a, c, g, or t
  modified_base (474)..(474): a, c, t, g, unknown or other
  misc_feature (474)..(474): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagtatttcgcgtacttattactgaccaactattatttcttttttatccgttacttagttttcggccgtagggaccaaggtcgtaggatatacgaaaggtactgtgctgcacatctgtcttcncttcctccnctatctagatagtattactgtctggaggcgggtctggacgaggcgctag

SEQ ID NO: 289107 - DNA, 597 bp, Homo sapiens
  misc_feature: GYAE6OF02IPI0C.44.75.G09.1.454.CMB.1.raw
  modified_base (256)..(256): a, c, t, g, unknown or other
  misc_feature (256)..(256): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggacaaagcccctaagtcccctgacttcttttcgnggactcctactttaggaagagtggacgtccccagccctaggttcacggtcggctaggtggttcctaggggacacgtatttcactctaccacatcagcagcctgaccagcctggactattttccgcgtaactttacttacgtcgaccctaaactaattactttacttttttaactccgttactagttttcggaccgtacgggacctaaggccgtaggagatacgaaaggtactgtgtctacgctactactcgtcgttcttctacttccgttcccgactacttctgtaatacgtaactactagttccgtagcggtacggtcgtacggacgacggtcctgtacg

SEQ ID NO: 289108 - DNA, 603 bp, Homo sapiens
  misc_feature: GYAE6OF02F90BB.44.75.G09.1.454.CMB.1.raw
  modified_base (330)..(330): a, c, t, g, unknown or other
  misc_feature (330)..(330): n is a, c, g, or t
  modified_base (339)..(339): a, c, t, g, unknown or other
  misc_feature (339)..(339): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtcgccgacattaggtactttttggccttggtttcagcaggagcctggcaaacgcccctaagtccctgattcttttctggactcctactttgaagagtggacgtcccagcctaggttcagcggcaggtggttcgtgggacactatttcactcncaccatcancagcctgcagcctggagtactttcgacgtacttattacgtcgaccaaactaatttactttacttttttacgtaccgttacgttaggttttcgggaccgtaacggggacctaacggtcgtagggagtaagttaacgaaaggtacgttaggtcggactgacctaacctattcttcgttccttactacttcccttcccgacctacttctagtacttacttaacttacttcgtactggacggtcggtcgtggacgacggtctacgtag

SEQ ID NO: 289109 - DNA, 635 bp, Homo sapiens
  misc_feature: GYAE6OF02IFY2R.44.75.G09.1.454.CMB.1.raw
  modified_base (249)..(249): a, c, t, g, unknown or other
  misc_feature (249)..(249): n is a, c, g, or t
tcagacagtatatacacgaccggtgctcgatttagtatagacatcagggacttagggctttgccaggctcctgctgctctgtttccccggtgccaggtgtgacatcgagatgacccagtctccgtcctcactgtctgcgtctattggggacagagtcaccatcacttgccggcgagtgccgacattaggacttttttggccttggtttcagcaggagcctggcaaagcccctaagtccctgatcttttntgatccactttgaagagtggagtcccagccaggttcagcggcagtggttctgggacacatttcactctccacatcagcagcctgcagcctggagtattttcgacgtactttattactgacccaactaattactttactttttttagccgtttaactggtttttacggccgtaggggtacctaaggcgttagggaacgtagttaacgtaaaaggtaaccgttggttacgggtactacgtacctaaccgtattaccgtgttacctttacgtacgttcccttacccgccgtaatttccgtacgtaacttaactttaacgtaccgtttcgttacgttacggtaacggtccgggtacgttacggtaccgtaacgggtcccgtacgtaacgg

SEQ ID NO: 289110 - DNA, 676 bp, Homo sapiens
  misc_feature: GYAE6OF02JF1PX.44.75.G09.1.454.CMB.1.raw
  modified_base (252)..(252): a, c, t, g, unknown or other
  misc_feature (252)..(252): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgatcttttcnggatccactttgaagagtggagtcccagccaggttcagcggcaggtggtctgggacacatttcactctcacatcagcagcctgcagcctggactatttcgcgtactttatactgaccaaatattattaccttttttactcccgttactacgtttttcgggacctacgggggtaacctaaggtccgtacgggtaagtaacgttacgtaaaagggtaaccgttggtcgggtaccttaggtaccctaacccgtaacgtttccgttaccggttaccgttttaccctaacgtttcccgttttaccccggcccttaacgtttccgttagttaacgttaacgtttaacttaaccggtttcgttaaccgttagggtaccggtaccggggttcgttaaccgggccggttaaaccgggccggtacccgtaacgg

SEQ ID NO: 289111 - DNA, 568 bp, Homo sapiens
  misc_feature: GYAE6OF02IEBNI.44.75.G09.1.454.CMB.1.raw
  modified_base (367)..(367): a, c, t, g, unknown or other
  misc_feature (367)..(367): n is a, c, g, or t
  modified_base (383)..(383): a, c, t, g, unknown or other
  misc_feature (383)..(383): n is a, c, g, or t
tcagacagtatatacacgaccggtgctcgatttagtatagacatcagggacttaggggctttgccaggctcctgctgctctgtttccccggtgccaggtgtgacatcgagagtgacccagtctccgtccgtcactgtctgcgtctattggggacagagtcaccatcacttgccgggcgagtgccgacattaggacttttttggcctggtttcagcaggagcctggcaaagcccctaagtccctgatcttttctggatccactttgaagagtaggagtcccagccaggttcagcggcagtggttctgggacacatttcactctcaccatcagcagcctgcagcctggagactttcgcgacttattacngaccctaaacaatttnttactttttttatacccgttactacgtttttggaccgtagggacctaagcgtaggagagtacgaaaggtatgtggctcgcaaccatctacgtcttctactcttcccgcctactcctagtacttaatacttaacttcgtacctcgtacggtccgggtccgtcgggtaccgaaggtccgactaacgg

SEQ ID NO: 289112 - DNA, 598 bp, Homo sapiens
  misc_feature: GYAE6OF02I8HPJ.44.75.G09.1.454.CMB.1.raw
  modified_base (315)..(315): a, c, t, g, unknown or other
  misc_feature (315)..(315): n is a, c, g, or t
  modified_base (351)..(351): a, c, t, g, unknown or other
  misc_feature (351)..(351): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgttctagttgggacagagtcaccatcacttgccgggcagtcgccgacagttaggtactttttggccttggtttcagcaggagcctggacaaacgccctaagtccctgattctttctggactccactttagaagngtggacgtccagtctagtcagcggcagttggttcgngggtacactatttcgacttcgtacacctatcagcacgtcctgcacgtccgtggacgtacgtttcgacgttacttagttaccgcaacctaaacttaacttacttttacctttttactacccgtttacgttagttttccgggaccgtaacggggtaccaacgtcggttaggaacgtactacggtaaaggtaaccgttggtacggactcggacctaccgtcttacgttcgtaccttactacgtttccccg

SEQ ID NO: 289113 - DNA, 659 bp, Homo sapiens
  misc_feature: GYAE6OF02I3Y1Q.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggacaaagcccctaagtccctgattcttttctgatcctactttgaagagtggagtcccagccaggttcagcggcagtggttcgtgggacactagtttcactctcaccatcagcacgcctgcagccgtaggacgtattttcggcgtactttaattacgttcgacctaaacaatttaacgtttcttttttttaacttacccggtttaacgttacggttttcggtacccggtaacgggggtaaccctaacggtccgtagggtaacgtaacgttaacggtaaaacggtaacgttggttacgggtcgtacggacctaaccgactttccgtacgttccgttttacacctttccgttaccccgtaccgtacttcctagtacttaataacttaacttgtccgtaggtacggtacggtcgttacggacgtaacgggcgacgtaacg

SEQ ID NO: 289114 - DNA, 535 bp, Homo sapiens
  misc_feature: GYAE6OF02HE4XI.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacactatttcactctcaccatcagcagcctgcagcctggagtatttcgcgtactttatactgaccaacaattacttcttttttatccgttactagttttcggaccgtacgggaccaagtctggagtatacgaaaggactgtgctcgcaccactctcgttcttctacttccttcccgcctactctagtactattactacttgtctgaggtcggcgtggacgacggcgatag

SEQ ID NO: 289115 - DNA, 503 bp, Homo sapiens
  misc_feature: GYAE6OF02ILDAY.44.75.G09.1.454.CMB.1.raw
  modified_base (252)..(252): a, c, t, g, unknown or other
  misc_feature (252)..(252): n is a, c, g, or t
  modified_base (476)..(476): a, c, t, g, unknown or other
  misc_feature (476)..(476): n is a, c, g, or t
  modified_base (501)..(501): a, c, t, g, unknown or other
  misc_feature (501)..(501): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgatcttttcnggatccactttgaagagtggagtcccagccaggttcagcggcagtggttctgggacacatttcactctcaccatcagcagcctgcagcctggagatttcgcgtacttatactgaccaaacaattattcttttttatccgttactagttttggcgtaggggaccaagcgtaggagatcaaaggactgtgctgcacatctgtcttcatctcccgccatctgatatntactgtctgagcggcgtggcaggcnag

SEQ ID NO: 289116 - DNA, 544 bp, Homo sapiens
  misc_feature: GYAE6OF02HD5KS.44.75.G09.1.454.CMB.1.raw
  modified_base (218)..(218): a, c, t, g, unknown or other
  misc_feature (218)..(218): n is a, c, g, or t
  modified_base (521)..(521): a, c, t, g, unknown or other
  misc_feature (521)..(521): n is a, c, g, or t
  modified_base (540)..(540): a, c, t, g, unknown or other
  misc_feature (540)..(540): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggancctggcaaagcccctaaagtccctgatcttttctggatccactttgaagagtggagtcccagccaggttcagcggcagtggttctgggacacatttcactctcaccatcagcagcctgcagccctggacgattttcgcgtaactttattacctgaccaacgaatttacttcttttttactccgtttactagtttttcggacccgtaggggacctaaaggtctagggagattacaaaggtactggtaggctggacaccatctgtcttcattccttcccgcctatcctgattatatactgtctgngccgggtctggacaggcgntacg

SEQ ID NO: 289117 - DNA, 693 bp, Homo sapiens
  misc_feature: GYAE6OF02HH9QQ.44.75.G09.1.454.CMB.1.raw
  modified_base (250)..(250): a, c, t, g, unknown or other
  misc_feature (250)..(250): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccggcgagtgccgacattaggacttttttggcctggtttcagcaggagcctggcaaagcccctaagtccctgatcttttcnggatccactttgaagagtggagtcccagccaggttcagcggcagtggttctgggacacatttcactctcaccatcagcagcctgcagcctggatattttcgcgtaactttattaccgtgaccctaaactaaactttatttaccttttttttaactacccgtttacttagggtttttacggacccggtaagggggtaacccaaaggtccgttagggaagtaagttaacggaaaaggtaaaccgttggttgggtacgtcggtacccgtaaccgtaacgttccgttacggtttcctttaccgtaacgtttcccgtttacccccggtaccctaacgttcccttaggttaacttttaactttaacgttaaccttacggttaccgttacgggtaaccggttccggggtccggttacgggtacccggtaaagggtcccggtacgtaacgg

SEQ ID NO: 289118 - DNA, 691 bp, Homo sapiens
  misc_feature: GYAE6OF02JAX4H.44.75.G09.1.454.CMB.1.raw
tcagacagtatatacacgaccggtgctcgatttagtatagacatcagggacttaggggctttgtcaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccatgattcttttctggatccactttgaagagtggactcccagccaggttcagcggcaggtgtctgggacacatttcactctcaccatcagcagcctgcacgcctggagtatttcgcgtacttattacacgacctaaactaacttactttaccttttttaactaccgttaacgttaacggtttttcgggacccgtaacggggtaccctaaacggtccgtacgggtaacgtaacgttaaccgaaaaggtaaccgttgggtacggtacgttacggtaccctaaccgtacttaccgttacggtttacctttaccgttaacgttcccgtttaccccggtacccttaaccgttaccgttaacggtaactttaacgtttaaccgttaaccgttacggtttaccgttacggtaaccgggtccgggtaccggttacgggtaccgtaacgggtccgtaaccg

SEQ ID NO: 289119 - DNA, 518 bp, Homo sapiens
  misc_feature: GYAE6OF02GN073.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttctggatccactttgaagagtggagtcccagccaggttcagcggcagtggttctggacacatttcactctcaccatcagcagcctgcagcctggagatttcgcgtacttattactgaccaacaatattcttttttatccgttactagttttggacctaggggaccaagtctggagattacgaaaggtactgtagctgcaccatctgtcttcatcctccgcatctgatactatactgtctgagtcgggtctcggacgaacggtcgataag

SEQ ID NO: 289120 - DNA, 562 bp, Homo sapiens
  misc_feature: GYAE6OF02IZQBL.44.75.G09.1.454.CMB.1.raw
  modified_base (297)..(297): a, c, t, g, unknown or other
  misc_feature (297)..(297): n is a, c, g, or t
  modified_base (395)..(395): a, c, t, g, unknown or other
  misc_feature (395)..(395): n is a, c, g, or t
  modified_base (554)..(554): a, c, t, g, unknown or other
  misc_feature (554)..(554): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccgggcgagtcgccgacattaggtacttttttggccttggtttcagcaggagcctggcaaagcccctaagtccctgtatcttttcnggtatccactttaggaagtagtggagtcccaggcctaggttcaggccggctaggtggttctgggacactatttcactctcaccatcagcagcctgcgngcctggacgtactttcgacttacttattacgtgacctaactaattactttctttttaatccgttaactaggttttcggaccgtacggggtaacctaaggtccgtaggactacgtacgaaagggtaactggtcggactcgacacctagtccttgtccttnacttcccg

SEQ ID NO: 289121 - DNA, 600 bp, Homo sapiens
  misc_feature: GYAE6OF02JAPOH.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctagttggggacagagtcaccatcacttggccgggcgagtcgccgtcattaggtactttttggccttggtttcagcaggagcctggacaaagcccctaagtccctgattcttttctggactcctactttagaagtagtggagtcccagccgaggttcaggcggcaggtggttcgtgggacactatttcacttctcacctatcagcacgcctgcagcctggactatttccgcgtaactttattactcgacctaaactaattactttactttttttacgtacccgttaacgttaggtttttcggaccgtaacggggaacctaaggtcgtagggaacgtagtaacgaaaacgggtacgttggtacggtacgtacgacctaaccgtagttaccgttgttaccgtttacctacgtttccccg

SEQ ID NO: 289122 - DNA, 731 bp, Homo sapiens
  misc_feature: GYAE6OF02JEJSX.44.75.G09.1.454.CMB.1.raw
  modified_base (357)..(357): a, c, t, g, unknown or other
  misc_feature (357)..(357): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctagttggggacagagtcaccatcacgttggcccgggcgagtcgccgactattaggactttttggccttggtttccagctaggagcctggcaaacgtcccctaagtccctgtactcttttctggactcctactttggaaacgtgtcggagtcccagcccgtaggttcagtcggntaggttgtctgggacacgtatttcaactcctcacctattccgatccgacgtaccgtgacccgtacgtacccgttggaacgtagtttttacccgacggttaacctttaacgtttaccttaaccgggacccttaaaacgttaaacgtttactttttaacccgttttttaaccttacccggtttaaccgtttacgggttttttaccgggaacccgttaggggggtaaaccctaaacggttaccggttagggtaaacgttaccgttaaccggtaaaaccgggttaacggttacgggttcgggtaaccgttaccggaaccgttacccgttaaccgtttccgttaccgggttttcctttaaccgaccgtttttacccccg

SEQ ID NO: 289123 - DNA, 666 bp, Homo sapiens
  misc_feature: GYAE6OF02HBC6F.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgattcttttctggatccactttgaagagtggagtcccagccaggttcagcggcaggtggttctgggacacatttcactctcaccatcagcagcctgcagcctggagtatttccgcgtactttattacctgacccaaactaatttatttacttttttactacccgtttacttaggtttttcgggacccgtaagggggtaaccctaaaggtccgttagggaacgtaacgttaaccgaaaacgggtaaaccgttggttacgggtacctcggacctaacccgtaacttaccgttgttacctttcctaactttcccgtttaccccgacctacgttccgtacgtaacttaacttaacttaccgttacggttacgtacgggtacggtccggggttcggtcgggtaccggtaacgggtaccgtacgtaacgg

SEQ ID NO: 289124 - DNA, 570 bp, Homo sapiens
  misc_feature: GYAE6OF02H3U1M.44.75.G09.1.454.CMB.1.raw
  modified_base (253)..(253): a, c, t, g, unknown or other
  misc_feature (253)..(253): n is a, c, g, or t
  modified_base (310)..(310): a, c, t, g, unknown or other
  misc_feature (310)..(310): n is a, c, g, or t
  modified_base (374)..(374): a, c, t, g, unknown or other
  misc_feature (374)..(374): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagccccctaagtccctgattcttttcnggatccactttgagagtggagtcccagccaggttcagcggcagtggttctgggacanatttcactctcacatcagcagcctgcagcctggagtattttcgcgtacttattactgacccaanaattatttcttttttactccgtactagttttggaccgtagggaccaagtcgtaggagtatacgaaaaggactggtagctcggacaccaattcgtcgttccttactacttcccttcccgacctacttccttagtacttaacgtacttaacttcgtacttagtcggtccgggacggttcggacgaaggtccgactaag

SEQ ID NO: 289125 - DNA, 607 bp, Homo sapiens
  misc_feature: GYAE6OF02H87WD.44.75.G09.1.454.CMB.1.raw
  modified_base (365)..(365): a, c, t, g, unknown or other
  misc_feature (365)..(365): n is a, c, g, or t
  modified_base (423)..(423): a, c, t, g, unknown or other
  misc_feature (423)..(423): n is a, c, g, or t
tcagacagtatatacacgaccggtgctcgatttagtatagacatcagggggggggtctcaggaggcagcgctctcaggacgtcaccaccatggcctgggctctgctcctcctcaccctcctcactcaggacacagggtcctgggcccagtctgccctgactcagcctccctccgcgtccgggtcacctggcagtcgatcaccatctcctgcattggaaccagcagtgacattggtgttataactatgtctcctggtaccaacaacaccaggacaaacgcccccaaatcatgattcatgatgtcagtaatcggcctgagggtttctggtcgcttctctggtctcaagtctggcaacgcgcctccgngaccatctcgtgggcctccgaggctggaggacgaggctagactattactgcagtctanaattaaagtaaaaaggaacgcaaacctacttagtttaaattacgttacgggacgggtaacgggtaaccaacggtccgttaacggaccccggttaccgttaacgggtaccctaaccggaccccgtaaacgggtcccgttaccccgggtacccccccgttacgggtttaccccacgtttaccccgg

SEQ ID NO: 289126 - DNA, 731 bp, Homo sapiens
  misc_feature: GYAE6OF02JV48D.44.75.G09.1.454.CMB.1.raw
tcagacagtatatacacgaccggtgctcgatttagtatagacatcagggacttaggggctttgccaggctcctgctgctctgtttccccggtgcccaggtgtgacatcgagatgacccagtctccgtcctcactgtctgcgtctattgggacagacgtcaccatcacttgccgggcgagtcgccgacagttaggacttttttggcccttggtttacctaggcctagggacgtcccgttggaaccaaaacggtcccccgtaaggtccccctaggacttccgtttttcgcggtacttcctaccttttgaagtaggtggacgttccccagccctaggttcagcgggtcaggtggttactgggaccacgtagtttcactccgtacacgtactctacgcacgtccctagccgaacgccttaggaacgtgttttaccgcggtactttaacgttactcggaccctaacgaatttacgtttacctttttactacccgtttacttacggttttacggtacccggtaacggggtaccctaaggttaccggtaggtacgtacgttacgtaaacggtacgttacggtggtacctacggtccgtaaccgtacttaccgtacggttacctttacctaacgtttcccgttacccgtactacttacggtacttaacgttaactacgttaacttcgttaccttaggtacgtcccgggtacgttaccggacgtaacggtcggtacctag

SEQ ID NO: 289127 - DNA, 649 bp, Homo sapiens
  misc_feature: GYAE6OF02JYRLZ.44.75.G09.1.454.CMB.1.raw
  modified_base (240)..(240): a, c, t, g, unknown or other
  misc_feature (240)..(240): n is a, c, g, or t
  modified_base (267)..(267): a, c, t, g, unknown or other
  misc_feature (267)..(267): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccggcgagtgccgacattaggtacttttttggcctggtttcagcaggagcctggcaaagccctaagtcccngatcttttctggactccactttgaagngtggagtcccagccaggttcaggcgcagtgtcgtggacacattcacgtctcacatcagcagcctgcacgctggatacgtttcgacgtacttatcgtcgaccaaactaattatttctttttaacgtccgttaacttacggtttttacgggacccgtaacggggtacctaaaggtaccgttagggtaaacgtacgttaccgtaaaagggtaaccttagggtacggtaccgttagaaccgtaaccgtaacttccgttacggttccttaccggtaaaccttcccgtttccccgtccgtaacttccgtacgtacttaacgttacttaaccgttgtaccgttaggtaccgtacgggtccgtagggtacgtaacgggtacgacctaagg

SEQ ID NO: 289128 - DNA, 525 bp, Homo sapiens
  misc_feature: GYAE6OF02GIJWK.44.75.G09.1.454.CMB.1.raw
  modified_base (251)..(251): a, c, t, g, unknown or other
  misc_feature (251)..(251): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggtctgggacacatttcactctcaccatcagcagcctgcagcctggagtatttcgcgtacttattactgacctaaacaattaattctttttatccgttactagttttggaccgtagggacctaaggctggagatcaaaggactgtgctgacaccatctgtctctatcttcccgctacttctgtatataactactcgtctcgaggtcggacgtggacctaggccgatacg

SEQ ID NO: 289129 - DNA, 562 bp, Homo sapiens
  misc_feature: GYAE6OF02I0VQ5.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccacttttgaagagtggatcccagccaggttcagcggcagtggttctgggacacatttcactctcaccatcagcagcctgcagcctgggactatttcgcgtacttaattactgacccaaactaatttatttcctttttttaactcccgttaactaggtttttcggaccgtaggggtacccaaggtctaggagaagtacgaaaggtaacgtggtggctcgacacctatctgttccttctacttccttcccgcctactctagatattattactgtctagtacggcgggtacgtcggcaacggcgctaag

SEQ ID NO: 289130 - DNA, 556 bp, Homo sapiens
  misc_feature: GYAE6OF02I84VL.44.75.G09.1.454.CMB.1.raw
  modified_base (253)..(253): a, c, t, g, unknown or other
  misc_feature (253)..(253): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggccttggtttcagcaggagcctggcaaagcccctaagtccctgatcttttcnggatccactttgaagagtggagtccccagccaggttcagcggcagtggttctgggacacatttcactctcaccatcagcagcctgcagcctggatatttcgcgactttattactgacccaataattatttccttttttactccgttactagtttttcggccgtacggggacctaagcgtaggagtattacgaaagggtactaggtggactgccgaccattcgtgttactttccattccttcccgcctctctacgattattacttactgtcttggagtccgggcgtggcgaaggccgactaacg

SEQ ID NO: 289131 - DNA, 606 bp, Homo sapiens
  misc_feature: GYAE6OF02GJ1EQ.44.75.G09.1.454.CMB.1.raw
  modified_base (254)..(254): a, c, t, g, unknown or other
  misc_feature (254)..(254): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaagcccctaagtccctgattcttttcnggactccactttgaagagtggagtcccagccaggttcagcggcagtggttctgggacacatttcactctcaccatcagcagcctgcagcctggatatttcgcgtacttattactgaccaataatttatttcttttttactcccgttattacggttttcggccgtaggggtaccaaggtcgtggagtacgttaacgaaaggtacttggtcgctcggactaccgacttccgtcgttccttacgtacttcccttcccgtacctacttccgtagtaactttaacttaacgttaacttcgttacgttacggtagggtcccgggtacgtccgggaacggtacgggtccgagttaacgg

SEQ ID NO: 289132 - DNA, 613 bp, Homo sapiens
  misc_feature: GYAE6OF02J0BGT.44.75.G09.1.454.CMB.1.raw
  modified_base (251)..(251): a, c, t, g, unknown or other
  misc_feature (251)..(251): n is a, c, g, or t
  modified_base (267)..(267): a, c, t, g, unknown or other
  misc_feature (267)..(267): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagngtggagtccccagccaggttcagcggcagtggtctgggacacatttcactctcaccatcagcagcctgcagcctggagactttcgcgtactttattacctgacccaaacaattactttctttttactccgtactagttttggcccgtaagggtaccaaacggtcttagggacgtaattaccgaaaaggtaccgtagggtggtacgtacgcaccgtatcgttcgttcctttaccactttcccttccccgtaccaccttctacgtaactttacttaacgtttaaccttggttaccgttaggtacggtaccggggttcgtccgggtaacgtaacgggcggtactaacgg

SEQ ID NO: 289133 - DNA, 656 bp, Homo sapiens
  misc_feature: GYAE6OF02HJUAN.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcccttggtttcagcaggagcctggcaaagcccctaagtccctgattcttttctggattccacttttgaagtagtggagtccccagccaggttcagcggcagtggttcgtgggacactatttcactctcaccatcagcagcctgcacgcctaggagtactttcgacgtactttacttactcgaccaaatactttactttacttttttactaccgttacgttacggttttcggacccggtaacgggtacctaacgtacgtagggtagtaacgttaacgaaacggtaacgttagtcggtacgtcgactaacctatccgtttcgttccgttacttaaccgtttcccttcccgtaccctacttccgttagtaacttaacgtttaaccttacgttaccggttctacgggtacgggtcccggggtacgttccgggacggtaacgggtaccgtacgtaacgg

SEQ ID NO: 289134 - DNA, 523 bp, Homo sapiens
  misc_feature: GYAE6OF02HHNX5.44.75.G09.1.454.CMB.1.raw
  modified_base (249)..(249): a, c, t, g, unknown or other
  misc_feature (249)..(249): n is a, c, g, or t
  modified_base (519)..(519): a, c, t, g, unknown or other
  misc_feature (519)..(519): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggttcagcaggagcctggcaaagcccctaagtccctgatctttcnggatccactttgaagagtggagtcccagccaggttcagcggcagtggtctgggacacgatttcactctcgaccatcagcagcctgcagcctggagtatttcgacgtacttattactgaccaaactaattattcttttttatcccgttatacgttttggccgtaaggggtaccaaagctaggaacgtatacgaaaggaactgtagctgcacatctgtcttcatcctccgctatctgatactatacttgtactgagcggctggacgaggcgntacg

SEQ ID NO: 289135 - DNA, 644 bp, Homo sapiens
  misc_feature: GYAE6OF02IB148.44.75.G09.1.454.CMB.1.raw
  modified_base (251)..(251): a, c, t, g, unknown or other
  misc_feature (251)..(251): n is a, c, g, or t
  modified_base (320)..(320): a, c, t, g, unknown or other
  misc_feature (320)..(320): n is a, c, g, or t
  modified_base (330)..(330): a, c, t, g, unknown or other
  misc_feature (330)..(330): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggcctggtttcagcaggagcctggcaagcccctaagtccctgatcttttcnggactccactttgaagagtggatccagccaggttcagcggcagtcggttctgggacacatttcacttcncaccatcgancagcctgcacgcctggagtactttcgcgtactttatacgtcgacctaaataatttactttacttttttactacccgtttactacgtttttcggaccgtaacggggtacccaaggactgggagtaataccgtaaaggtaacgttaggtcgggacttcggactaaccgtacgttaccgttcggtttacctttaccttaacgtttccccgttaccccggtaccttacttacttacggtaactttaacttaacgttaacgttacgttcgttaacggcgggtccgggtcgtacgggtacgaacgggtacgacgtaacgg

SEQ ID NO: 289136 - DNA, 693 bp, Homo sapiens
  misc_feature: GYAE6OF02FOV8Q.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagattttcgcgtacttattactgacccaaacaattactttctttttttaactcccgttaacgttaggtttttacgggcccgtaagggggaaccctaaggtccgtagggaacgtaacgttacgaaaacgggtaaaccgttggtacgggccttacgggacctaacccgtaagttcccgttacggtttccctttaccgtaacgtttccctttacccccggaccttaacgttccctttacggaactttaaccgtttaaacttaacccgtttaggttacccgtttacgggtaaccgggtaccgggggtccggttaccggggtaccggtaaacgggggttacccggtacgtaacgg

SEQ ID NO: 289137 - DNA, 671 bp, Homo sapiens
  misc_feature: GYAE6OF02F5H2D.44.75.G09.1.454.CMB.1.raw
  modified_base (251)..(251): a, c, t, g, unknown or other
  misc_feature (251)..(251): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcgcagtggtctggacacatttcactctcaccatcagcagcctgcagcctggagtattttcgcgtactttattactcgacctaaacaatttatttactttttttaactcccgttaacgttacggtttttcgggaccgtaacgggggtaaccctaaggtccgtagggtaagaacgttacgaaaagggtaaccgttggtacgggtcttacggacctaacccgtagttccgttaggttccctttacgtaacctttcccgttcccccggtacctaaccgtttccgttacgtaactttaacgtttaacgttaacctttacggttaccgttacggtaaccgggtccggggtacgttaccggggaccgtaacgggtccggtacgtaacgg

SEQ ID NO: 289138 - DNA, 525 bp, Homo sapiens
  misc_feature: GYAE6OF02F2IN5.44.75.G09.1.454.CMB.1.raw
  modified_base (521)..(521): a, c, t, g, unknown or other
  misc_feature (521)..(521): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgagagtggagtcccagccaggttcagcggcagtggttctgggacacatttcactctcaccatcagcagcctgcagcctgggagtattttcgcgtacttaattactgaccaacaattattcttttttatccgttactagttttcgccgtagggaccaagctggagatacaaaggactgtgctgcaccatctgtcttcacttcctcccgcctatctgtatattatacttgtctggacgtcgggtcgtacggcgaaggtcgntacg

SEQ ID NO: 289139 - DNA, 632 bp, Homo sapiens
  misc_feature: GYAE6OF02IJ6YZ.44.75.G09.1.454.CMB.1.raw
  modified_base (256)..(256): a, c, t, g, unknown or other
  misc_feature (256)..(256): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggccttggtttcagcaggagccgtggcaaagcccctaagtcccctgactcttttcnggactccactttgaagtagtggagtcccagccaggttcagcggcagtggttctgggacacgtatttcactctcaccatcagcagcctgcacgcgtggacgtatttcggcgttaacttattactcgaccaaataattatttccttttttaatccgttacttaggttttacggacccgtaggggtaaccaacgtcgtagggaacgtataacgtaaacggtaacttggtacgacgtacgactaacccgtattaccgttcgtttccttacgtactttacccgttaccccgcccttaacgttccttagaatttacgtaactttaaccgttcggttacgtacggacgggttcggcgtcgggtaaccgtaggccgtacgtaag

SEQ ID NO: 289140 - DNA, 510 bp, Homo sapiens
  misc_feature: GYAE6OF02F3Y8I.44.75.G09.1.454.CMB.1.raw
  modified_base (474)..(474): a, c, t, g, unknown or other
  misc_feature (474)..(474): n is a, c, g, or t
  modified_base (507)..(507): a, c, t, g, unknown or other
  misc_feature (507)..(507): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtacttattactgaccaacaattattctttttatccgtactagttttggcctaggggaccaagcgtaggagatacgaaaggtactgtggctgcaccatctgtcttcattcctcccgcatctnatactatactgtctgagtcggctggcgaggcgntag

SEQ ID NO: 289141 - DNA, 660 bp, Homo sapiens
  misc_feature: GYAE6OF02HKG0D.44.75.G09.1.454.CMB.1.raw
tcagacagtatatacacgaccggtgctcgatttagtatagacatcagggggaggaatcagacccagtcaggacacagcatggacatgagagtcctcgctcagctcctggggctcctgctgctctgtttccccggtgccaggtgtgacatcgagatgacccagtctcccgtcctcactgtctgcgtctattggggacagagtcaccatcacttggccgggcgagtgccacatttaggtacttttttggccttggtttcagcgaggacgcctggacaaacgccccctaagtcccctgacttcttttctggacttcctactttagaagaggtggacgtcccagtccaggttcaggcggcagtggttcgtgggacactatttcacctctccgaccatccagcacgtcctcgcacgccgtagggaagtacgtttaccggaccgtaactttaacttaccgtcgtacccaaacttaacttaacttttccgttttttaactacccggtttaaacgttaggttttccgggtaacccgtaacggggggtaaccctaacggtcggttacggggtaactacggttaacgtaaaacgggtacggttacggtcggggtacctccggtactaccccgtattcccgttcggttacctttaccgaccgtttaccccg

SEQ ID NO: 289142 - DNA, 759 bp, Homo sapiens
  misc_feature: GYAE6OF02I6ZLI.44.75.G09.1.454.CMB.1.raw
  modified_base (222)..(222): a, c, t, g, unknown or other
  misc_feature (222)..(222): n is a, c, g, or t
  modified_base (275)..(275): a, c, t, g, unknown or other
  misc_feature (275)..(275): n is a, c, g, or t
  modified_base (696)..(696): a, c, t, g, unknown or other
  misc_feature (696)..(696): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttgggacgagagtcaccatcacgttgccggcgagtgccgactattaggtacgttttggtccgttggtttcgagcganacggacgtacgtacgaaccgaaccgtaccgtaacgtaccgttacgttacttcntttcggtacgtacgtaccttacgttaaggaagtaggtacggtaccgtaccgaccgtaccggttacggtacggacggacggtacggttacggttacggttacggtacggtaacgtacttacttacctaccgtacctacctaacctacgtacgacgacgtaccgtacgtacgacgtaccgtacggtacggtacgtacgttacgtacgttaacgttaacgttacgtaccgtaactaacttaactttaacttttacgtttaccgttaacgttaacgttacggttacggtaaccggtaaccggtaacgtaacgtacgtacgtaacgtaacgtaaacgtaaacggtaacgtacgtacgtacgtaccgtaaccgtaacgtacgttacgtacgttaccgtaccgttaccgttacccgtaccgtacctancgttacgtaacgttaacgttaacgttacgttacgtacgtacggtacggtacggtacggtacgg

SEQ ID NO: 289143 - DNA, 591 bp, Homo sapiens
  misc_feature: GYAE6OF02FYYZE.44.75.G09.1.454.CMB.1.raw
tcagacagtatatacacgaccggtgctcgatttagtatagacatcagggggggggtctcaggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcactggaaccagctaatttcattggtaatcatgactatgtctcctggtaccagcatcacccaggcacagcccccagactcgtgtatttttgaggtcaataagcgcccctgacgggtcccgatcggttctctgctcagtctgcacgacgcctccctgaccgtctcgtggcctccgaggctgacgatgacggctggattagttactgctagcctccgtagtggacggcaccgtatgtagtttcgtacgttttcggacgggtacgggtaccgacggtacgtcggaacccggttacccgttaacgggttacccgtacggtaccccgtaacgggtcccgttacccgggtcccccccgtttacgggtccctacccgtttcccccgg

SEQ ID NO: 289144 - DNA, 750 bp, Homo sapiens
  misc_feature: GYAE6OF02JZRA4.44.75.G09.1.454.CMB.1.raw
  modified_base (666)..(666): a, c, t, g, unknown or other
  misc_feature (666)..(666): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggcttttttggccttggtttacagcaggacgccgttggacgaaacgccccgttaaagtcccctaggtatttccgtttttcgtacggtaacttcctacttttacggaaagtaggttaccggtaacggttccccgaagtcccggaaggttttcgaacgggccgggtcaacgggtttcgggttaccgtaggggtaccgaacgtcttttaccgacctttccgacctaccgaacttccgaacgtccaggtacccttggacctacgccgttagggacgttactttcggccttaacgtttattccctagacccctaaacgtaattttcttcttttttaacctcgttacttaacgttttcggaccgtagggtaccaacggtacgttaggaactagtacgtaaaggtctacggtagtacgtcgtaaccgtaccgtaactccgttacgttcctacttacttaccggtcctaccgtacttccggttanaccgtttaagtaacgttaccgtttacgtacgttacggaccggtttaccgggtacggtaccggtacggacggttacggactaagg

SEQ ID NO: 289145 - DNA, 652 bp, Homo sapiens
  misc_feature: GYAE6OF02IJDG9.44.75.G09.1.454.CMB.1.raw
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
  modified_base (505)..(505): a, c, t, g, unknown or other
  misc_feature (505)..(505): n is a, c, g, or t
  modified_base (524)..(524): a, c, t, g, unknown or other
  misc_feature (524)..(524): n is a, c, g, or t
  modified_base (537)..(537): a, c, t, g, unknown or other
  misc_feature (537)..(537): n is a, c, g, or t
tcagacagtatatacacgaccggtgctcgatttagtatagacatcagggacttaggggctttgccaggctcctgctgctcttcgtttcccggtgccgaggtgtgacatcgagatcgacccagtcctccgtcctcactgtctgcgtctagtgggacagacgtccaccatctacgttcggccgggacgagtcgcccgatagttaggttcttttttcggccttgggtttacagcgaaggtcgcgtggaacaaccgtaccctaacgtccagttcttcctttgaggtcctaccttagtttaagaagtggtacgtaccgtccacgaccgtaggtcacggcgcgtagttcggttcgaggacctattacttcnccttcnccaactacacgacgcacggtctgaaccgtgtacgtaagggaatttaccgtttgacgtttaaagtttactcggtctccgaagtacgaagttaatagtcgacgtccgtcccttccggtacgaacgtaaggccacgngtaggactaagttaaccgngtgtacgccgtanacctactgtcgtacgttacctcgttaccctcccgtaccattacgtcgtaattacgttacgtacgttaccgtgtaccggtacggtacggtccggtagaccggaacgtacggtatcg

SEQ ID NO: 289146 - DNA, 524 bp, Homo sapiens
  misc_feature: GYAE6OF02IS6K4.44.75.G09.1.454.CMB.1.raw
  modified_base (251)..(251): a, c, t, g, unknown or other
  misc_feature (251)..(251): n is a, c, g, or t
  modified_base (363)..(363): a, c, t, g, unknown or other
  misc_feature (363)..(363): n is a, c, g, or t
  modified_base (420)..(420): a, c, t, g, unknown or other
  misc_feature (420)..(420): n is a, c, g, or t
  modified_base (438)..(438): a, c, t, g, unknown or other
  misc_feature (438)..(438): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtccccagccaggttcagcggcagtggttctgggacacattcactctcaccatcagcagcctgcagcctggagatttcgcgtattattacngaccaacattattcttttactccgttactagttttcggctagggaccaacgctgganagtacaaaggactgtgcngcacctactctagtcttcacttcttcccgacctatctgatatattacttcgtctaggagtcggtacgtcggacgaaggtcgatacg

SEQ ID NO: 289147 - DNA, 548 bp, Homo sapiens
  misc_feature: GYAE6OF02G5G1I.44.75.G09.1.454.CMB.1.raw
  modified_base (480)..(480): a, c, t, g, unknown or other
  misc_feature (480)..(480): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcaggcggcagtggttctgggacactatttcactctcaccatcagcagcctgcagccgtggagtatttcgcgtacttattactgaccaataattacttctttttatccgtactagttttcgccgtagggacctagtcgtagagtatacgaaagactgtgctcgcacctatctgttccttactattccgttacccncctatctagtaatacgttacttacgttcgtctggacggtcgggtcgttcggacgaacggtcgactaag

SEQ ID NO: 289148 - DNA, 643 bp, Homo sapiens
  misc_feature: GYAE6OF02HPDCI.44.75.G09.1.454.CMB.1.raw
  modified_base (270)..(270): a, c, t, g, unknown or other
  misc_feature (270)..(270): n is a, c, g, or t
  modified_base (376)..(376): a, c, t, g, unknown or other
  misc_feature (376)..(376): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatctacttcggccgggcgagtcgccgaactagttaggttacttttttggccttggtttcagcagggagccgtggacaaacgtccctaacgtccctgtacttcttttcgnggtactcctacgtttagaaggtagtggacgtcccagccgtaggttcaggcggctaggttcggttcgtgggacactactttcactctacaccatcacgcagcctgcncgtccgtaggatactttcgacgtactttatctacgactaaactaatttactttcttttactaccgttaacgttacggttttcgaccggtaacgggtaacctaaggtcggtagaagtacgtaacgaaaggtacgttcggtagtctcgacctacctacttcgttacgttcctactacttcccgtacccaccttactcgtagtacttacgttaacttacgtacgtcgtacggtacggtcggtcgtacggaccggtaagtccgtagtaacg

SEQ ID NO: 289149 - DNA, 636 bp, Homo sapiens
  misc_feature: GYAE6OF02HEQ5K.44.75.G09.1.454.CMB.1.raw
  modified_base (278)..(278): a, c, t, g, unknown or other
  misc_feature (278)..(278): n is a, c, g, or t
tcagacagtatatacacgaccggtgctcgatttagtatagacatcagggggggggtctcaggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcacatctcctgcactggaaccagctaatttcattggtaatcatgactatgtctcctggtaccagcatcacccaggcacncgccccagacctgtgtattttgaggtacaataagccgcccctagacggggtcccgatccggttctctggcctcaagtctggacaacgacgccctcctcgacccgtctccgtgggctccgtaggcttgaccgagtgacggtctagatttaattacgttagccgtaagtcttaccggagttcgggaacgggtacctaacccttagttacggttaacgttttcgtttccggttttacgggccgggttaagggtaccctacgggtacgtaccggtaccccggttaccgttaagggttccgaacggaccccgtaagggtccccgtaccggccccccgttacgggttcccaacccgtttcccgg

SEQ ID NO: 289150 - DNA, 538 bp, Homo sapiens
  misc_feature: GYAE6OF02F5PQF.44.75.G09.1.454.CMB.1.raw
  modified_base (267)..(267): a, c, t, g, unknown or other
  misc_feature (267)..(267): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagngtggagtcccagccaggttcagcggcagtggttctgggacacgatttcactctcaccatcagcagcctgcagcctggacgtatttcgcgtacttattactcgaccaaactaattatttctttttataccgttactagttttcggccgtaggggaaccaggtcgtggagtatagaaaggtactgtgctgacctacattctgttcttctacttcctcccgctactctagattactatactgtctggacgtcgggcgtggacgacggcgcgtag

SEQ ID NO: 289151 - DNA, 621 bp, Homo sapiens
  misc_feature: GYAE6OF02HH7ZJ.44.75.G09.1.454.CMB.1.raw
  modified_base (324)..(324): a, c, t, g, unknown or other
  misc_feature (324)..(324): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctagttggggacagagtcaccatcacttgccgggcgagtgccgactagttaggtacttttttggccttggtttcagcaggagccgtggacaaacgcccctaagtcccctgtacttcttttctggtactcctactttgaagngtggacgtcccagccaggttcaggcggctaggtggttcgtagggactacgtatttcactctcaccatcacgcagtcctgccagtccgtaggagtagtttcgacgtaactttactttacctcgtaaccaaactaatttacttttaccttttttaacacccgtttacttaggtttttcgggacccgttaacgggggtaacctaacggtcgtacgggtagtacgtaacgtaaaacgggtacgtgggtacgtccgtacgacctaacccgtattccgttcgttacctttaccgactttcccg

SEQ ID NO: 289152 - DNA, 527 bp, Homo sapiens
  misc_feature: GYAE6OF02FO958.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaaagcccctaagtccctgatcttttctggatccactttgaagagtggagtcccagccaggttcagcggcagtggttctgggacacatttcactctcaccatcagcagcctgcagctggatatttcgcgtacttattactcgaccaaactaattatttctttttactaccgtacttaggttttggccgaaggggaccaaaggtcgtaggagatacgaaagactgtgctgacaccatctgtctctactccttccgcctatctacgtatatatactgtctgagcgggctggacacggcgacgtag

SEQ ID NO: 289153 - DNA, 567 bp, Homo sapiens
  misc_feature: GYAE6OF02IXMVA.44.75.G09.1.454.CMB.1.raw
  modified_base (371)..(371): a, c, t, g, unknown or other
  misc_feature (371)..(371): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgatctttctggactccactttgaagagtggacgtccccagccaggttcaggccggacaggttggtttcgtggggacacgatttcactctcaccatcagcagcctgcagcctggagtatttcgctacttntactgacctaacatttattctttttactaccgttacttacgttttggccgtacgggacctaagccgtaggagtatacgaaaggtactagtcggtctgacacctatcgtacgtcttcacttccctcccgtcctacttctagtattatactacttcgtacgtcggagaccgggtcgtggacgaacggtccgtagtacg

SEQ ID NO: 289154 - DNA, 655 bp, Homo sapiens
  misc_feature: GYAE6OF02FSOE4.44.75.G09.1.454.CMB.1.raw
  modified_base (254)..(254): a, c, t, g, unknown or other
  misc_feature (254)..(254): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaagcccctaagtccctgattcttttcnggatcctactttgaagtagtggagtcccagccaggttcagcggcaggtggttctggacacatttcactctcaccatcagcacgcctgcagcctaggagtactttcgacgtactttacttactgacccaaataatttatttacttttttactacccgttaacgttaggtttttcggaccggtaacggggtaacctaaggtaccgttagggaagtaacgttaacgtaaaacgggtaacgttacggtagggtaccgtcgaccctaaccgtacttcgtcgtttcttactacttacccttaccccggtacctacgttccgtagtaacttagttaacttaacttcggttaccgttagggtacggtaccgggtacgtacgggtaccggtaacgggaccgttacgaacg

SEQ ID NO: 289155 - DNA, 552 bp, Homo sapiens
  misc_feature: GYAE6OF02HDN0N.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcaagtcagagcattaggaactctttaaattggtatcagcagaggccagggaaacgcccctcaactcctgatctatgctgcgtccattttgcaaagtgggtcccatcaaggttcagtggcagtggatcgtgggacaggtatttcactctcaccatcagcagtctgcaacctgaagtactttcgctagtctttattattcgtacaacgagagtgaacaatactcccgcttctacgtttcgggacggtacgggacctagttggtaggagtaactacgaaacgtaacgtggtacgctgacctaccgtattctgttccttctacttcccgttcccgacctacttctagtattacttacttaccgttgtcgttgacggtccggg

SEQ ID NO: 289156 - DNA, 700 bp, Homo sapiens
  misc_feature: GYAE6OF02GX3Y9.44.75.G09.1.454.CMB.1.raw
  modified_base (268)..(268): a, c, t, g, unknown or other
  misc_feature (268)..(268): n is a, c, g, or t
tcagacagtatatacacgaccggtgctcgatttagtatagacatcagggacgttaggggctttgccgaggctcctgctgctctggtttccccggtgccaggtgtgacatccgagatgaccccagtctccgtcctcactgtctgcgtcgtattggggactagtagtcgaccatcacttgccgggcgagtgccgactattaggtacttttttggcctggtttcagcaggagcctggacaaacgcccctaagtccctgacttccttttcgnggactcctacctttgaacgagtggagtcccagccaggttcagccgcagtggttctgggactacgatttacacctctcaaccatccagcctagcctgccacgccgtggagtatttcgacgtactttattacctgacccaaagtaactttacgtttccttttttaactacccggttaacgttaacggttttcgggtaccggtaagggggtaacctaaacgggtcgttagggtaacgttacgtaacgtaaaagggtaaccgttcgggtagggtaccgtacggtaccgtaaccgtacttccgtacgttacccgttacgtacgttcccgttcccgtacctacgttaccgtagtaacgttaaccttaacttaccgttaccgtcgttacggtaccggacgggttcgttaccgggtaccgtaaccgggtcctacgtaacg

SEQ ID NO: 289157 - DNA, 523 bp, Homo sapiens
  misc_feature: GYAE6OF02FISFE.44.75.G09.1.454.CMB.1.raw
  modified_base (519)..(519): a, c, t, g, unknown or other
  misc_feature (519)..(519): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcaggtggttctgggacacatttcactctcaccatcagcagcctgcagcctggagtatttcgcgtacttattactgccaactaatattcttttttactccgttaactagttttcggccgtaggggacctaaggtctggagtatacgaaaggactgtggctgcacatctgtcttcacttccttcccgcctatctgtatatatactgtctgaggcgggtctggcaggcgntacg

SEQ ID NO: 289158 - DNA, 541 bp, Homo sapiens
  misc_feature: GYAE6OF02G1WGZ.44.75.G09.1.454.CMB.1.raw
  modified_base (344)..(344): a, c, t, g, unknown or other
  misc_feature (344)..(344): n is a, c, g, or t
tcagacagtatatacacgaccggtgctcgatttagtatagacatcagggacttaggggctttgctaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggttctgggacactatttcactctcacatcagcagcctgcagcctgganatttcgcgtacttattactcgaccaactaatttacttcttttttactcccgtacttagttttacgggccgtaaggggtaccaagtcgtaggagatacgtaaaggactgtcgctgcaccatctgtcttcactccttcccgctactcctgactagtctactcgtcgtgacggcggtcgtcggacgtaggcctcgtaacg

SEQ ID NO: 289159 - DNA, 665 bp, Homo sapiens
  misc_feature: GYAE6OF02HWODY.44.75.G09.1.454.CMB.1.raw
  modified_base (311)..(311): a, c, t, g, unknown or other
  misc_feature (311)..(311): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaagcccctaagtccctgatcttttctggatccactttgaagngtgagtcccagccaggttcagcgcagtgtctggacacatttcactctcaccatcagcagcctgcacgccgtggacgtagtttccgacgtaactttaattacttacgacctaaactaaactttaatttacttttttttaacttacccggtttaacctttacggttttttacgggacccggtaacgggggtaaccctaaacggtaccgttacggggtaaacggtaacgttaacgtaaaaaacgggtaaaccgtttacgggttacggggtacccgtttacgggaccccttaaaccccggttaacgtttaccccgtttacggttttacccgttttacccgttaaccttttaccccccg

SEQ ID NO: 289160 - DNA, 830 bp, Homo sapiens
  misc_feature: GYAE6OF02GQ70Q.44.75.G09.1.454.CMB.1.raw
  modified_base (226)..(226): a, c, t, g, unknown or other
  misc_feature (226)..(226): n is a, c, g, or t
  modified_base (414)..(414): a, c, t, g, unknown or other
  misc_feature (414)..(414): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtcaggtcgttttcggtgctgttgcctggtttacaacgaaaaagggggngacggccctaaggtcctcgtctctcgtagaaaccagactggaaggtagacgtcccgtccaggttcagtgccagtccaggtggtcgggccggagtccactctcacctattacgcgacctgccggcctggaagattctgactaacttatttctgtacagctagtactcagttacgtcgtacccccgtttntaccgtttttcgggacccgtacggggggtaaccctaaacgggtacgttaacgggtaaaacttaacccgaaaaaccggtaaaccgttacgggttacgggtacccgttacgggtaacccctaaacccggtaacgttttacccgttacggttttaacccgttttacccgttaaccgttttacccccgtttttacccccccgggtaccccgtttaaacgtttaccccgtttaacgggttaaaacttttaaaaccgtttaaccgttttaaacccggttttccgggtttaaccgttttaccgggggtaaaccgggggttacccggggggtacccggttttacggggggaaaccccggttaaaccggggggtaccccggttaaccgggttaaaacggtttaacggacggttaccgtacggtcg

SEQ ID NO: 289161 - DNA, 545 bp, Homo sapiens
  misc_feature: GYAE6OF02HGYL5.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccgggcgagtgccgacattaggactttttggccttggtttcagcaggagcctggcaaagcccctaagtcccctgatcttttctggatccactttgaagagtggagtcccagccaggttcagcggcagtggtctgggacacatttcactctcaccatcagcagcctgcagcctgatgtatttgactaactttattactgaccaacagtaataagtatttacttctactagttacgttttcggaccgtaaggggtacctaaggccgtaggtaacgtaagtaccgtaaaacgaacgttggtaggtacctcggtacctaaccgagttacctgttaccc

SEQ ID NO: 289162 - DNA, 599 bp, Homo sapiens
  misc_feature: GYAE6OF02HHKJ2.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttggccgggcgagtgccgacattaggacttttttggcctggtttcagcaggagcctggcaaagcccctaagtccctgatctttctggatccactttgaagagtggatcccagccaggttcagcggcagtggttctgggacacgatttcactctacaccatcagcagcctgcacgcctggagtagtttcgcgtacttatactgaccaactaattactttactttttactaccgttacgtacgttttcggaccgtacgggtaacctaaggtcgtaggagtaattacgaaaggtacgttggtaggctagctaccatctagttccttacgtacttccttcccgtacctattccgtagttaacttacgtaacttaccttacgttccgttaggtaccggtcgggtaccgtacgggtaaccgacgggtacggtactaacg

SEQ ID NO: 289163 - DNA, 761 bp, Homo sapiens
  misc_feature: GYAE6OF02IASR8.44.75.G09.1.454.CMB.1.raw
  modified_base (389)..(389): a, c, t, g, unknown or other
  misc_feature (389)..(389): n is a, c, g, or t
tcagacagtatatacacgaccggtgctcgatttagtatagacatcagggacttagggctttgccaggctcctgctgctctgtttccccggtgccaggtgtgacatcgagatgacccagtctccgtcctcactgtctgcgtctattggggacagagtcaccatcacttggccgggcgagtgccgacattaggtactttttttggccttggtttcagcaggagcctggacaaacgcccctaaagtccctgtattcttttctggtatcctatttaggaagtaggtggacgttcccagcctaggttcaggcggactaggtggttctgggacactatttcactctacaccatcagcagcctgacacgcctggaagtatttcgacgtaaactttnttaacctacgacctaaactaaattttacttttacttttttacgtacccgtttaacgttaacgggtttttacgggacccgggtaaaggggtaaccctaacgggtaccgtaaggggtaagtaacgtaaacgtaaaaacgggtaacgttagggttacgggtacctacggtacctaaccgtacgttaccgttacgtttccgtttaaccgtttaaccttacccccgtttaccccggtaacccttaaccgttacgtttaaccggttaaactttaacgttaaactttaccgtttacggttaccccgttaggggaacccgggttccgggtaccgggttaccgggtacccgggtaaaccggggtaccgtacggttaaacgg

SEQ ID NO: 289164 - DNA, 581 bp, Homo sapiens
  misc_feature: GYAE6OF02FXF22.44.75.G09.1.454.CMB.1.raw
  modified_base (394)..(394): a, c, t, g, unknown or other
  misc_feature (394)..(394): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggacaaagccccctaaagtcccctgattcttttctggtactccctactttgaaagtagtggactcccagcctaggttcagcggcagtggttctgggacactatttcacttctcaccatcagcagcctgcngctggatatttcgctacttattactgacctaaacaattatttacttttttacaccgttacttaggtttttcggacccgtaaggggtaacccaaggtcgtagggaacgtataaccgaaaagggtactaggtacggtaccttaggacccaaccgtacttccgttcgttacctttacctactttcccccg

SEQ ID NO: 289165 - DNA, 665 bp, Homo sapiens
  misc_feature: GYAE6OF02FVGMU.44.75.G09.1.454.CMB.1.raw
  modified_base (254)..(254): a, c, t, g, unknown or other
  misc_feature (254)..(254): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaagcccctaagtccctgattcttttcnggatccactttgaagagtggagtcccagccaggttcagcggcagtggttctgggacacgatttcactctcaccatcagcagcctgcagcctggactatttcgcgtacttattactgacccaaatactttactttctttttttactaccgttacttacggtttttcgggacccgtaacgggggaaccctaaggtccgttacgggaagtacgttaaccgtaaaacggtaaaccgttagggttacgggtacctacgggaccctaaccgtaacttccgttacgtttccgtttactaacgttccctttccccgcccttaactccgttacgtaacgttacttaacttacgttcggttacgttacgggtaacggtcggggtaccggtacgggtaccgaacgggtacccgtagtaacgg

SEQ ID NO: 289166 - DNA, 779 bp, Homo sapiens
  misc_feature: GYAE6OF02GG4K2.44.75.G09.1.454.CMB.1.raw
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
tcagacagtatatacacgaccggtgctcgatttagtatagacatcagggggggggtctcaggaggcagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcacgtacggaaccagactaatttcatttaggtaatcatnactatntctcgtcgtacaacataccaccagcaccaccgaccccagtacgtcgtgttagttttcggacggttacaaagtaacgcccgaccccgtacggtaccggggtacccgtacgttccggttacctcgttcggtacccttaccgtaacgttcgtacggacctaaccgtaccggtccccttacccgtcggtacccgttcgttccggtcgggtccctaccggacgggtccgtaacggtaacggtacggtacgggtacggtacgttaggttaacgtttacttacggtcgtaccgtacggtacccgtaccgggtaaggtacgggaacggtaccttaaccgttaggttacgttacgtttttacggttccgggttttaccgggacgggtacgggaaccctaagggtaccgttacccggtacccgggtttaaccggttaaccgggtaccgtaacccggtcccggaacccggttccccgtacccccgggttccccggtaccggttacccgttaccggttccccggtttacccccgg

SEQ ID NO: 289167 - DNA, 663 bp, Homo sapiens
  misc_feature: GYAE6OF02I7JCT.44.75.G09.1.454.CMB.1.raw
  modified_base (257)..(257): a, c, t, g, unknown or other
  misc_feature (257)..(257): n is a, c, g, or t
  modified_base (319)..(319): a, c, t, g, unknown or other
  misc_feature (319)..(319): n is a, c, g, or t
  modified_base (333)..(333): a, c, t, g, unknown or other
  misc_feature (333)..(333): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcgaggagcctggacaaacgcccctaagtccctgattcttttcnggactccactttgaagtagtggagtcccagccaggttcagcggcagtggttctgggacactntttcactctcaccntcagcagcctgcagcctaggacgtatttccgcgtactttattactcgaccaaactatttactttacttttttactcccgttaacttaggtttttacggacccgtaaggggtacccaaggtcgtgggaagaacgttaacgaaaaggtaaccttggtacgggtcttacggacctaaccgtacgttaccttacgttacctttaccgtaacctttcccgttaccccgtacctactttacctagttaactttaacgttaaccgttacgttacgttaccgttagggaccggttcggggtaccgttacgggaaccgtaacggggtccgacgtaacgg

SEQ ID NO: 289168 - DNA, 583 bp, Homo sapiens
  misc_feature: GYAE6OF02G0TBA.44.75.G09.1.454.CMB.1.raw
  modified_base (197)..(197): a, c, t, g, unknown or other
  misc_feature (197)..(197): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagngtcaccatcacttgccggcgagtgccgacattaggacttttttggccttggtttcagcaggagcctgcaaagcccctaagtccctgattcttttctggactcctactttgaagtagtggacgtcccagccaggttcagcggcagtgtctgggacactacttcactctcacctatcagcagcctgcagtccgtggaacgtctttacgcgtaacttacttacgtcgaccctaactaatttacgtttcttttttactacccgttacgttagttttcggacccgtaggggtacctaagtcgtagggtacgtagttaccgaaagggtaactaggtcggtactacggaccaccttacgtctttacggttaccttttactcccgtttaccccg

SEQ ID NO: 289169 - DNA, 517 bp, Homo sapiens
  misc_feature: GYAE6OF02FZL1T.44.75.G09.1.454.CMB.1.raw
  modified_base (512)..(512): a, c, t, g, unknown or other
  misc_feature (512)..(512): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttctggatccactttgaagagtggagtcccagccaggttcagcggcagtggttctttgggacacatttcactctcaccatcagcagcctgcagcctggagtatttcgcgtacttattactgaccaataattattcttttttatccgtactagttttggccgtaggggaccaagctggagatacaaaggactgtgctgacaccatctgtcttcactcctcccgctatctgtatatatactgtctgagcgggtctggcgaaggcgntaacg

SEQ ID NO: 289170 - DNA, 677 bp, Homo sapiens
  misc_feature: GYAE6OF02GDQDO.44.75.G09.1.454.CMB.1.raw
  modified_base (296)..(296): a, c, t, g, unknown or other
  misc_feature (296)..(296): n is a, c, g, or t
  modified_base (341)..(341): a, c, t, g, unknown or other
  misc_feature (341)..(341): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttctggactcctactttgaagagtggagtcccagccaggttcagcggnagtggttctgggacactatttcactctcaccatcagcagcctgcngcctggagtatttcgacgtactttattactacgacctaaactaaatttactttacctttttttaacttacccgttaacttaggtttttacgggacccgtaaacgggggtacctaaacggtcgtagggtaacgtaagttaaccgaaaagggtacctagggttacggtcgtacggacctaacctaacgttccgtttacggttacctttaccgtaacgttcccttaccccgtaccttacgttaccgttagtaacttacgttaacgttacctttcggttaccgttacggaacggtccggggtaccgttacggggtaccgtaacgggccggtacgtaacgg

SEQ ID NO: 289171 - DNA, 526 bp, Homo sapiens
  misc_feature: GYAE6OF02GEBG6.44.75.G09.1.454.CMB.1.raw
  modified_base (371)..(371): a, c, t, g, unknown or other
  misc_feature (371)..(371): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtccccagccaggttcagcggcagtggttctgggacacatttcactctcaccatcagcagcctgcagcctggatatttcgcgtacttattctgaccaanaattattcttttttaatcctaactagttttcggaccgtaggggtaccaagctggagatagaaaggactggtgctgcacatctcgtcttcgtactcttcccgactactctgtactaatatacttcgtctgaggtccggtcgtggacaggcgactag

SEQ ID NO: 289172 - DNA, 622 bp, Homo sapiens
  misc_feature: GYAE6OF02HHAP6.44.75.G09.1.454.CMB.1.raw
  modified_base (252)..(252): a, c, t, g, unknown or other
  misc_feature (252)..(252): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttcnggatccactttgaagagtggagtcccagccaggttcagcggcaggtggttctgggacacatttcactctcaccatcagcagcctgcagccgtggacgtagttttcgcgtaactttaattacctcgacccaaacgaactttactttaccttttttaacttacccgttacgttaggtttttcgggacccgtaacggggtaccaaaggtcgtagggagtaacgtacgtaaacggaacttaggtcggtactcgacacctaattcttcgtcctttactacttcccttcccgtcctacttctacgtaattacgtaacttaccttcggttcgtacggtacggtccgggtcgttacggacgaacgggtccgacgtaag

SEQ ID NO: 289173 - DNA, 620 bp, Homo sapiens
  misc_feature: GYAE6OF02JDMAN.44.75.G09.1.454.CMB.1.raw
  modified_base (367)..(367): a, c, t, g, unknown or other
  misc_feature (367)..(367): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgattcttttctggatccactttgaagagtggagtcccagccaggttcagcggcagtggttctgggacactattcactctcaccatcagcagtcctgcagcctggatatttcgcgtacttattacncgacctaaactaatttactttctttttttactacccgttacttacggttttcggaccgtaggggtacctaaggtccgtaggaacgtacttacgaaacgggtaactgtcgggtcgtcgaccaccgtacttcgtcgttctttaccactttcccttaccccgtcctaacttccgtagtacttaacttacgttaccttacggttacgttacggacggtacggggtccgtacgggaccggaacgggtaccacgtaacg

SEQ ID NO: 289174 - DNA, 505 bp, Homo sapiens
  misc_feature: GYAE6OF02GCL7J.44.75.G09.1.454.CMB.1.raw
  modified_base (344)..(344): a, c, t, g, unknown or other
  misc_feature (344)..(344): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttggcctggtttcagcaggagcctggcaaagcccctaagtccctgatcttttctggatccactttgaagagtggagtcccagccaggttcagcggcagtggttctgggacacatttcactctcaccatcagcagcctgcagcctgganatttcgcgtacttattactgaccaacaatattcttttttatccgttactagttttggcctaggggaccaagctggagatacaaaggactgtgctgcaccatctgtcttcatcctccgcctactctgatatatactgtctgagtcggctggcaaggcgatag

SEQ ID NO: 289175 - DNA, 577 bp, Homo sapiens
  misc_feature: GYAE6OF02IGSX7.44.75.G09.1.454.CMB.1.raw
  modified_base (251)..(251): a, c, t, g, unknown or other
  misc_feature (251)..(251): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggttctgggacacatttcactctcaccatcggcagcctgcagccgtggacgtatttcgcgtaactattactagacctaactaattactttcttttttactccgttactagttttcggaccgtacggggacctaaggtccgtagggagtagtacgaaaggtaacgtggtcggtacgtcgacctaccattaccgtgtcttctacttcccttcccgacctactctagtacttacttactacttcgtcgtggacgtcggtcgtggaccgaaggcgtacgagtacg

SEQ ID NO: 289176 - DNA, 333 bp, Homo sapiens
  misc_feature: GYAE6OF02H25ZN.44.75.G09.1.454.CMB.1.raw
  modified_base (223)..(223): a, c, t, g, unknown or other
  misc_feature (223)..(223): n is a, c, g, or t
  modified_base (260)..(260): a, c, t, g, unknown or other
  misc_feature (260)..(260): n is a, c, g, or t
  modified_base (321)..(321): a, c, t, g, unknown or other
  misc_feature (321)..(321): n is a, c, g, or t
  modified_base (329)..(333): a, c, t, g, unknown or other
  misc_feature (329)..(333): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtcgccgactattaggtactttttttggccttggtttcagcaggancctggacaaacgcccctaaagtccctgattcttttcnggatccatttgaagagtggacgtccccagccaggttcagcggacagtggtcgtgggacacntttcactnnnnn

SEQ ID NO: 289177 - DNA, 503 bp, Homo sapiens
  misc_feature: GYAE6OF02IOID9.44.75.G09.1.454.CMB.1.raw
  modified_base (251)..(251): a, c, t, g, unknown or other
  misc_feature (251)..(251): n is a, c, g, or t
  modified_base (464)..(464): a, c, t, g, unknown or other
  misc_feature (464)..(464): n is a, c, g, or t
  modified_base (502)..(502): a, c, t, g, unknown or other
  misc_feature (502)..(502): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccggcgagtgccgacattaggacttttttggcctggtttcagcaggagcctggcaaaagcccctaagtccctgatcttttcnggatccactttgaagagtggagtcccagccaggttcagcggcagtggttctggggacacatttcactctcaccatcagcagcctgcagcctggagatttcgcgacttattacctgccaaacaaatattctttttattcccgtacagttttggccaggggaccaagctggagattcaaaggaactgtggctgcacatctgtcttcatcttcccncatctgatatatactgtctgagcgggctggcaaggcgna

SEQ ID NO: 289178 - DNA, 632 bp, Homo sapiens
  misc_feature: GYAE6OF02GR0ZJ.44.75.G09.1.454.CMB.1.raw
  modified_base (265)..(265): a, c, t, g, unknown or other
  misc_feature (265)..(265): n is a, c, g, or t
  modified_base (322)..(322): a, c, t, g, unknown or other
  misc_feature (322)..(322): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctagttggggacagagtcaccatcacttgccgggcgagtcgccgacattaggtacttttttggccttggtttcagctagganccgtggacaaaggccccctaagtcccctgattcttttctggactcctactttgaagngtggagtcccagccaggttcagcggcaggtggttctgggacactatttcaacttctcgaccatcagcacgtcctagcgagtcctggacgtagtttcgcgtaactttattacctcgtaccaaactaatttactttaccgtttttttaacacccgtttacgttacgggtttttacgggaccgtaacgggggttaacccaaaggtcgttacgggaacgtacgttaaccggaaaagggttacgttacgggttcggaccgtttacggaacccttacctagtttccttacggttccttttaccacgttttcccccg

SEQ ID NO: 289179 - DNA, 532 bp, Homo sapiens
  misc_feature: GYAE6OF02IW7WZ.44.75.G09.1.454.CMB.1.raw
  modified_base (251)..(251): a, c, t, g, unknown or other
  misc_feature (251)..(251): n is a, c, g, or t
  modified_base (346)..(346): a, c, t, g, unknown or other
  misc_feature (346)..(346): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagagtggagtcccagccaggttcagcggcagtggttctgggacactatttcactctcaccatcagcagcctgcagcctgganatttcgcgtaactttatacctgaccaaactaattaattcttttttatccgttaatagttttggccgaggggaccaagctaggagagtacgaaacggactggtgctgacgacattctgttcttcacttcctcccgacctatcgtatatatattacttgtctgacggcggtcgtggacaacggcgata

SEQ ID NO: 289180 - DNA, 723 bp, Homo sapiens
  misc_feature: GYAE6OF02F4G9Z.44.75.G09.1.454.CMB.1.raw
tcagacagtatatacacgaccggtgctcgatttagtatagacatctaggggtacgttaggggctttagccaggctcctgcttgcctctggtttccccggtgccgaacggtgtgacatcgagattcgacccagtcctccgtcctcactcgtctgcgtcctattgggtacagtagtcaccatcacttgccgggcgagtcgccgactattacggtacgttttttaggccttcggtttccacgcaggacgtccgtggacaaacgcccctaaacgtccctagacttcttttctggactccactttgaagagtggacgtcccagccaggttccagccgtcagtggttctgggactactcttcactctccacgatccacgcacgtctgcgacgccgtggacgtagtttcgcgtaacttacttaccgtcgaccctaaacgtacttaacgtttaccttttttacgtacccgttaacgttacggtttttacggcccgtaacggggtaacctaaacggtccgttagggaacgtaagttaaccgtaaaacggttaacttacgggtacgtaccgtacgaccttaaccgtacgttaccgtacgtttaccgttacgttaccgttcccgtttacccgtccgttaaccgttcgttacgtaacttaacgttaacgttaaccgttacgttcgtacgggtacggtacggtccgtacgggaccgtaacgggtccgtacgttacg

SEQ ID NO: 289181 - DNA, 737 bp, Homo sapiens
  misc_feature: GYAE6OF02JSLYE.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccggcgagtgccgacattaggacttttttggccttggtttcagtcaggagcctggcaaacgccctaagtccctgattcttttctggactccgactttgaagtagtggacgtcccagccgtaaggttcagcggcaggttggttcgtgggacacgtattcacgtctcaccgtatcacgcagtcctgcacgcctaggactatttccggacgtactttattactcggtaccctaactaacttacttttccgttttttaacgtacccgtttaacgtttaacgggtttttccgggaccgttaacgggggtaaacccttaacggtacgttacggggaacgttaacggttaaccgtaaagggtaaaccgttggtaacgggttctacgggtacctaaccgtagttaccgttcggttaccttaccgtaacgtttccccgttacccggtacccttacgtacccgtttgtaaaccgttttactaaggtttaccgttaaccggttcgttaaccgggtaacgggttcccggggtaccgttaacgggtaccccggttaaaggggttcccccggattaaaccgg

SEQ ID NO: 289182 - DNA, 592 bp, Homo sapiens
  misc_feature: GYAE6OF02JGU5X.44.75.G09.1.454.CMB.1.raw
  modified_base (359)..(359): a, c, t, g, unknown or other
  misc_feature (359)..(359): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcacatcacttgccgggcgagtcgccgacagttaggtacttttttggccttggtttcagcaggagcctggcaaacgcccctaagtccctgatcttttctggtatccactttgaagagtggagtcccagccaggttcagcggcagtggtcgtgggacacgtntttcacttctcgaccatcagcagcctgcagcctggagtactttccgcgtactttattactgaccaactaagtactttcttttttacacccgttactttacggttttcggtaccgtacgggggtaaccctaaaggtccgttagggtaagtacgttaacggaaaacgggtaacgttggacggtccgttacggacctaccgtagttcccttagtttacccttcgaacctttccccg

SEQ ID NO: 289183 - DNA, 537 bp, Homo sapiens
  misc_feature: GYAE6OF02FKOTF.44.75.G09.1.454.CMB.1.raw
  modified_base (485)..(485): a, c, t, g, unknown or other
  misc_feature (485)..(485): n is a, c, g, or t
  modified_base (508)..(508): a, c, t, g, unknown or other
  misc_feature (508)..(508): n is a, c, g, or t
  modified_base (531)..(531): a, c, t, g, unknown or other
  misc_feature (531)..(531): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaacgcccctaagtccctgatcttttctggactccactttgaagagtggagtccccagccaggttcagcggcaggtggttctgggacacatttcacttctcaccatcagcagcctgccagcctggagtatttcgcgtacttacttactgacccaactaatattcttttttactccgttactagttttcggccgtaggggacctaagcgtggagtagtacaaaggtactgtgctgcaccatctgtcttctactcctcccnctactctagatatatacttcgtntgaggcgggtctggccgaggcgngtaacg

SEQ ID NO: 289184 - DNA, 620 bp, Homo sapiens
  misc_feature: GYAE6OF02H7A5Z.44.75.G09.1.454.CMB.1.raw
  modified_base (254)..(254): a, c, t, g, unknown or other
  misc_feature (254)..(254): n is a, c, g, or t
  modified_base (350)..(350): a, c, t, g, unknown or other
  misc_feature (350)..(350): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaacgcccctaagtccctgattcttttcnggatcctactttgaagtagtggacgtcccagccaggttcagcggcagtcggttctgggacactatttccactctccacatcagcagctgcacgtcnggatacgtttcgcgtacttagttactacgtaccaaactaattattttaccttttttactaccgtttaacttacggtttttcggacccggtacggggtaaccaacggtcgtagggagtaacgtaacgtaaacgggtacgtggtacgggtactcggactaacctacgttctcgttaccttcgtaccttcccttcccgacctacttctacgtattacgtattacctcgttcgtacggtggtaccgggtcgtagggccgtaacgggcctagtac

SEQ ID NO: 289185 - DNA, 617 bp, Homo sapiens
  misc_feature: GYAE6OF02JBKEE.44.75.G09.1.454.CMB.1.raw
  modified_base (253)..(253): a, c, t, g, unknown or other
  misc_feature (253)..(253): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgattcttttcnggactccactttgaagagtggagtccagccaggttcagcggctagtggttctgggacacgtatttcactctcaccatcagcagcctgcagcctggactatttcgacgtacttattactgaccaactaatttactttctttttactccgttacttagttttcggaccgtaggggtacctaaggtcgttaggagtacttacgaaaaggtaacgtgtagtctaggaccaccgtactcgttgttccttacgttacttcccgtttcccgacctacttcgttacgtaattaagttacgttacttacggtaccgttaggtaaccggttccggggtacgtttacgggaccgtaacgggtccgtacgtaacgg

SEQ ID NO: 289186 - DNA, 649 bp, Homo sapiens
  misc_feature: GYAE6OF02JTW5K.44.75.G09.1.454.CMB.1.raw
  modified_base (252)..(252): a, c, t, g, unknown or other
  misc_feature (252)..(252): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttcnggatccactttgaagagtggatcccagcctaggttcagcggactaggttcggttcgtgggacacgtactttccactctcaccatcagcacgcctgcctagccgtagggactacgtttccgacgtactttacttactcgacctaaagtaatttcttttacttttttacgacccgtttaacgttaggttttaccggaccggtaacgggtaacctaagtccgtaagggaacgtacgttaacgtaaacggtacgttcggtacggtacttcggaccctaacgtaccttacgtccttacttacctacctttcccgtacccgtacctacgttccgttacgtaacttacttacgttaccttcgttacgtcggacggtcggtacgtcggtacgacggcgtacgtag

SEQ ID NO: 289187 - DNA, 669 bp, Homo sapiens
  misc_feature: GYAE6OF02FTQBS.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggacgcctggcaaacgcccctaagtccctgattcttttctggactcctactttgaagaggttggagtcccagccaggttcagcggcagtggttctggacacatttcactctcaccatcgagcagcctgcagcctggacgtagtttcgacgtactttattacgtcgaccaaactaatttactttacgtttttttactacccgtttaacgttacgttttcggtaccgtaagggggtaaccgtaaacggtccgtacgggaacgtaacgttaaccgtaaaaccggtaaacgttaggtacgggtaccgtacgtaccgtaaccgtacttcgtttacgtttacctttaccgttacttcccgttaccccgtcctaacgttccttagtaacttaacgttacttaccttcggttaccgttcggtacggtccgggtcgtacgggacgtacggtaccgtactaacgg

SEQ ID NO: 289188 - DNA, 644 bp, Homo sapiens
  misc_feature: GYAE6OF02GCJRP.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgtacttcttttcgtggactcctacttttgaagtagtggagtcccagccaggttcagcggcagtggttctgggacactatttcactctcacatcagcagcctgcagcctggagtactttcgcgtacttattactcgaccaaataacttatttacttttttactaccgttacttagttttcggaccgtacggggtaccaaggtcgtaggacgtaagtaacgaaagggtaacgtggtcggtactacggacctaccgtattccgttcgttccttaccttacgttcccttaccccgacctacgttaccttaggtaacttaacgttaacttaccgttacggttaccgttacgggtaaccggtcggggtaccgttacgggacggtaacggggtccgtacgtaacgg

SEQ ID NO: 289189 - DNA, 538 bp, Homo sapiens
  misc_feature: GYAE6OF02F2HQS.44.75.G09.1.454.CMB.1.raw
  modified_base (497)..(497): a, c, t, g, unknown or other
  misc_feature (497)..(497): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctgggttcagcaggagcctggcaaagcccctaagtccctgattcttttctggatccactttgaagagtggagtccccagccaggttcagcggcagtggttctgggacacatttcactctcaccatcagcagcctgcagcctgggatatttcgcgtacttattactgaccaacaattatttcttttttatccgttactgttttacggccgtaggggtaccaaggtctaggagtatacgaaacggtactgtacggtctcgacacctatctgttcttctcttcctcccgcactctanatataactactgtctgaggcggtctcggacacggtcgatag

SEQ ID NO: 289190 - DNA, 711 bp, Homo sapiens
  misc_feature: GYAE6OF02JE9AX.44.75.G09.1.454.CMB.1.raw
  modified_base (252)..(252): a, c, t, g, unknown or other
  misc_feature (252)..(252): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttggcctggtttcagcaggagcctggcaaacgcccctaagtccctgattcctttcnggatccactttgaaagcgtggacgtcccagccaggttcaggcggctaggttggttcctggggactacgtatttccacttcctccgtaaccctagtccaggccaacggtcccctggcctaacggccttagggacgttaaccttttccggaccggttaactttactaacccgttggaacccctaaacgttaaactttacttttaccctttttttaaccgtaccgtttaacgtttacggttttaccggggtaccggtaacggggtaaccgtaaacgtcccggttagggtaacgtaacgtaccggtaaaacgtacggttacgtccggtacgtcgtaaccacgtactacgttactccgttacgacttccctttacccgcccttaacttcctacgtaacttacttagtaaccttcggtcttacggtacggtccggttacggtacggtcgaacggtcgtccgtaag

SEQ ID NO: 289191 - DNA, 605 bp, Homo sapiens
  misc_feature: GYAE6OF02HRA96.44.75.G09.1.454.CMB.1.raw
  modified_base (254)..(254): a, c, t, g, unknown or other
  misc_feature (254)..(254): n is a, c, g, or t
  modified_base (341)..(341): a, c, t, g, unknown or other
  misc_feature (341)..(341): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgatctttcnggactcctactttgaagagtggagtcccagccaggttcagcgcagtggttctgggacacatttcactctcaccatcagcagcctgcngcctggagtatttcgacgtactttattactacgacctaactaattactttacttttttacgtaccgttaacttaggttttcggaccgtagggaacctaagcgtaggagtataacgaaaggtaactggtacgtcgtagacaccgtattcgtcgttcttacgtacttccgttcccgactactacgtacgttaataacgttattaaccgtttgtaccgttaggtaacggtccgggcgtaccgggtaccgaacgggtccgcgtaacgg

SEQ ID NO: 289192 - DNA, 579 bp, Homo sapiens
  misc_feature: GYAE6OF02HBUO3.44.75.G09.1.454.CMB.1.raw
  modified_base (376)..(376): a, c, t, g, unknown or other
  misc_feature (376)..(376): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaacgcccctaagtcccctgacttcttttctggatcccacttttgaagaggtggagtcccagccaggttcaggcggcagtggttctgggacacatttcactctcaccatcagcagcctgcagcctaggacatttcggacgtactttattacngcccaaactaattattaccttttttatcccgtttactaggttttcggcccgtaaggggacccaaggtcgtagggagacgtacgaaagggaacttaggtggtccgtgacctaccgattccgtgttctttacacttcctccctccgtatctcgtattatacttacgtgtactggtagtcgggcgtcggcgaaggtccgtataacg

SEQ ID NO: 289193 - DNA, 1028 bp, Homo sapiens
  misc_feature: GYAE6OF02GFZWF.44.75.G09.1.454.CMB.1.raw
tcagacagtatatacacgaccggtgctcgatttagtatagacatcagggtacgttaggggccttgccaggctcctgctggctctcgtttccccggtgccacggtgtgacatcgagatcgacccagtcctccgtcctcactgtctgcgtctagttggggacctagagtccaccatcacttcgccgggcgtagtcgccgactagttacggtacttttttggccgttggtttcacgcaggtacgccgtggaccaaacgtccccgtaaacgtccctggtacttccgttttcgtaggtacttaccgtacgttttgaaacggtaggttacggtaaccgtaccccgacggacccgtaacgggtttcccaaaggtcccgggaccttaaggtttcggggtttaccggtacggggtaaccctaacggtaccgttttccgtaaccggttcctaccgtaacccgtacttaccgacggtccgtaaccggtcccgttacggcctaacgggtacccgttaggggtaaccgttaccgttttcccggaaccggtttaaccttttaaacgttacccgttaccggtaaacccgttaaaacgttaaaccgttttaacgtttttacccgtttttttaaccgtaacccgggttttaaccgtttaacggggtttttacccgggaacccggtttaaacgggggttaaaccgttaaaccgggttaccgggttaaccgggtaaaccggttaaaccggttaaaaccggttaaaaccggggttaacccggttagggttaaacccgggttccggtttaaccgggtaaccccgttaaaccgggtcgttttaacccggttccggtttaaccggtttaacccggttacccggttttaccccgtttaccccggaaccgtttaacccgtttaccggttaaccgttaacgtttaaccggtttaaccgttaccgggtttcccggttaaccggttacggggtaccgggttaccgggttacccggttccgggtaacccgtacccgggttacgtaaccgttaccggg

SEQ ID NO: 289194 - DNA, 570 bp, Homo sapiens
  misc_feature: GYAE6OF02IPQP4.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaacgcccctaagtccctgatctttctggatccactttgaagagtggagtccccagccaggttcagcggctagtggttcgtgggacagatttcactctcaccatcagcagcctgcagcctggacgatttccgcgtaacttatttactgacccaaacattacttcttttttactccgttactagttttggccgagggtaccaagtctggagacttacgaaaggaactgtgctgcacacttcgtcttcttctacttccgttcccgactacgttcctagtactacgtaattcttaggttctacggtacgtcggggtccgttagggaccgtaacgggccgtacgtaacg

SEQ ID NO: 289195 - DNA, 526 bp, Homo sapiens
  misc_feature: GYAE6OF02GH5CD.44.75.G09.1.454.CMB.1.raw
  modified_base (268)..(268): a, c, t, g, unknown or other
  misc_feature (268)..(268): n is a, c, g, or t
  modified_base (336)..(336): a, c, t, g, unknown or other
  misc_feature (336)..(336): n is a, c, g, or t
  modified_base (502)..(502): a, c, t, g, unknown or other
  misc_feature (502)..(502): n is a, c, g, or t
tcagacagtatatacacgaccggtgctcgatttagtatagacatcaggggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagngtggagtcccagccaggttcagcggcagtggttctgggacacatttcactctcaccatctagcagccngcagcctggagatttcgcgtacttattactgaccaacaattattacttttttatcccgttactagttttggccgtaggggaccaagtcgtggagatacaaagtactgtgctcgcaccatctgttctctatccttccgcctactctgatacgtaatactgtactcgngtcgggctgggcgaacggcgctag

SEQ ID NO: 289196 - DNA, 769 bp, Homo sapiens
  misc_feature: GYAE6OF02HY1U6.44.75.G09.1.454.CMB.1.raw
  modified_base (278)..(278): a, c, t, g, unknown or other
  misc_feature (278)..(278): n is a, c, g, or t
  modified_base (317)..(317): a, c, t, g, unknown or other
  misc_feature (317)..(317): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagttcccctgattcttttctggactccacttttgaagagtggngtcccagccaggttcagcggcagtggttctgggacactntttcactcacaccatcagcacgcctgaccagccgtggtaacgtacttttccgacgttaacctttactttaaccgtcgaaccctaaacgtaatttacgttttacctttttttaacgttcccgtttaacgttacggttttttacgggacccggtaacgggggtaaccctaacggtacgttacgggaacgtaacgttaaccggtaaaacgggtaaccgttagggttacgggtaccgttaccgacccgtaaacccgtaacgtttccgttacgtttacccgtttacccttaccgtttaccccgtttccccggtaaccccgttacgtttacccgtacggtttacttaaacgtttaaccgtttaacccgttacggtttcccggttacgggtaccgggttaccggggttaccgggttacggggtaaacccggtaacccggggtccggtaaccgtaaacgg

SEQ ID NO: 289197 - DNA, 671 bp, Homo sapiens
  misc_feature: GYAE6OF02GDGNX.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtcttcgtcctcactgtctgcgtctattggggacagagtcaccatcacttgccgggcgagtgccgacattaggtacttttttggccttggtttcagcaggagcctggcaaagcccctaagtccctgattcttttctggatccacttttgaagagtggagtccccagccaggttcagcggcagtggttctgggacacgatttcactctcaccatcagcagcctgcagcctggagtatttcgcgtacttattactgaccctaacaattacgtttcttttttaactcccgtttacttacgtttttcggacccgtaacgggggtaccctaaagggtccgttagggaagtacgttaaccgaaaacgggtaacgttcggtacgggtacctacggaccctaacccgtacttaccgttcgtttacctttacctacgtttccctttaccccgacccttaacttccgttacgtaacttacgttaacttaaccgtttcgttaccgttacggtaacgggtccggggtccgttacggggtaaccgaacgggtccggtaccgtaagg

SEQ ID NO: 289198 - DNA, 654 bp, Homo sapiens
  misc_feature: GYAE6OF02HF0H2.44.75.G09.1.454.CMB.1.raw
  modified_base (252)..(252): a, c, t, g, unknown or other
  misc_feature (252)..(252): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttcnggactcccacttttgaagagtggagtcccagccaggttcagcggcagtggttctgggacactattcactctcaccatcagcagcctgcagcctggagtactttcgcgtactttattacctgacctaaactaatttactttacttttttactacccgttacgttagtttttcgggacccgtaaggggtaacctaacggtccgtagggtaacgtacttaacggaaaacggtaaccgttggttacgggtccgttacgaccgtaaccgtacgttccgtttacgttcctttactaaccgtttcccctttaccccgtaccttacgttccttagtaactttacgttaacttaccttcggttacgttggaacggtccgggtcggtcggtaccgaacgggtccgataacgg

SEQ ID NO: 289199 - DNA, 602 bp, Homo sapiens
  misc_feature: GYAE6OF02HNYUT.44.75.G09.1.454.CMB.1.raw
  modified_base (253)..(253): a, c, t, g, unknown or other
  misc_feature (253)..(253): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgattcttttcnggatccactttgaagagtggatcccagccaggttcagcggcagtggttctggggacacgatttcacttctcaccatcacgcagccctgccagcctaggacgtattttccggctactttattacctgacccaaactaatttactttcttttttaactacccgtttaacgttagtttttcgggaccgtaaggggtaaccctaaggtcgtaggaagtagtaacgaaaggtaactggtcggactggacctacccgatcttcgttccttctacttccgttcccctctaactctagtacttacgttatacctagtccgttagacggtccggcgtaggaccgaacggtcgactacg

SEQ ID NO: 289200 - DNA, 526 bp, Homo sapiens
  misc_feature: GYAE6OF02GT24R.44.75.G09.1.454.CMB.1.raw
  modified_base (314)..(314): a, c, t, g, unknown or other
  misc_feature (314)..(314): n is a, c, g, or t
  modified_base (358)..(358): a, c, t, g, unknown or other
  misc_feature (358)..(358): n is a, c, g, or t
  modified_base (400)..(400): a, c, t, g, unknown or other
  misc_feature (400)..(400): n is a, c, g, or t
  modified_base (443)..(443): a, c, t, g, unknown or other
  misc_feature (443)..(443): n is a, c, g, or t
  modified_base (510)..(510): a, c, t, g, unknown or other
  misc_feature (510)..(510): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtcctccgtcctcactgtctgcgtctagttggggacagagtcaccatcacttgccgggcgagtgccgacattaggtactttttggccttggtttcagcaggagcctggcaaacgccccctaagtccctgatcttttctggatccactttgaagngtggagtcccagccaggttcagcggctaggtggttcgtgggacnctatttcactctcaccatcagcacgcctgcagcctggacgtntttcgcgtactttattactgaccaataattatttctttttacnccgttactgttttcggaccgtaggggacctagcgtaggagtatacgaaggtactggtggctgccacntctgtcttcattcccg

SEQ ID NO: 289201 - DNA, 510 bp, Homo sapiens
  misc_feature: GYAE6OF02F7YTN.44.75.G09.1.454.CMB.1.raw
  modified_base (255)..(255): a, c, t, g, unknown or other
  misc_feature (255)..(255): n is a, c, g, or t
  modified_base (376)..(376): a, c, t, g, unknown or other
  misc_feature (376)..(376): n is a, c, g, or t
  modified_base (422)..(422): a, c, t, g, unknown or other
  misc_feature (422)..(422): n is a, c, g, or t
  modified_base (439)..(439): a, c, t, g, unknown or other
  misc_feature (439)..(439): n is a, c, g, or t
  modified_base (472)..(472): a, c, t, g, unknown or other
  misc_feature (472)..(472): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtactttttggccttggtttcagcaggagcctggtaaacgccccctaagtccctgattcttttcnggatccacttttgaagagttggatccagccaggttcagcggcagtggttctgggacacatttcactctcaccatcagcagcctgcagcctggagtatttcgcgtacttattactgaccaanaatatttctttttatcctactagttttgcaggggaccaagctgganatagaaagactgtgctncacatctgttcttcattccttcccgccattctntatatatactgtctgagcggctggacgaggcgcatacg

SEQ ID NO: 289202 - DNA, 613 bp, Homo sapiens
  misc_feature: GYAE6OF02IWRN2.44.75.G09.1.454.CMB.1.raw
  modified_base (353)..(353): a, c, t, g, unknown or other
  misc_feature (353)..(353): n is a, c, g, or t
  modified_base (577)..(577): a, c, t, g, unknown or other
  misc_feature (577)..(577): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacatagtcaccatcacttgccgggcgagtgccgacagttaggacttttttggcctggtttccagcagagcctggcaaagacccctaagtccctgtactctttctggatcctactttcgaagagtaggacgtcccgagccctaggttcacgacggctaggtcggttacgtagggacacatttcactctacaccatcagcagccngcacgctaggagtatttcgactactttattactcgacctaaactaatttactttactttttactaccgttacgttagtttacggtaccgaagggtaccaaggtccgttaggaagacgtacaaacggtacgttgtaggtctacggacctaccgtatcgttcgttaccttcgtactttccgtacccgctacgttctagtacttataacgttactcgtacgttacgnggtccggtcgtacggaccgtaacggccgtactaacg

SEQ ID NO: 289203 - DNA, 682 bp, Homo sapiens
  misc_feature: GYAE6OF02HQGBO.44.75.G09.1.454.CMB.1.raw
  modified_base (251)..(251): a, c, t, g, unknown or other
  misc_feature (251)..(251): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaagcccctaagtccctgattcttttcnggatccacttttgaagagtggagtcccagccaggttcagcggcagtggttcgtgggacacatttcactctcaccatcagcagcctgcagccgtaggactattttccgcgtaactttactttaccgtcgaccctaaaacgtaacttttaacgttttccttttttttaacgtaccccggttttaaacgtttaacgggttttttccgggacccggttaacggggggtaaaccctaaacgggtccgttaacggggtaacgtaacgttaaacgaaaacgggtaaccgttaggtacgggtaccgttcggacctaacccgtattccgttcgttccttactaccttcccgttcccgaccttatcgttagtattaacgtacttaccgttgtcgttacggacggtcgggtacgtcggtaccggacggtccgtacgtaacgg

SEQ ID NO: 289204 - DNA, 633 bp, Homo sapiens
  misc_feature: GYAE6OF02GSNQM.44.75.G09.1.454.CMB.1.raw
  modified_base (346)..(346): a, c, t, g, unknown or other
  misc_feature (346)..(346): n is a, c, g, or t
tcagacagtatatacacgaccggtgctcgatttagtatagacatcagggacttaggggctttgccaggctcctgctgctctgtttccccggtgccaggtgtgacatcgagatgacccagtctccttccaccctgtctgcatctgtaggagacagagtcaccatcacttgccgggccagtcagagtattagtagttggttggcctggtatcagcagaaaccagggaaacgcccctaaaactcctgatctataaggcatctagtttggaaagtggggtcccatcaaggttcagcggcagtggtctgggacacatttcactctcaccatcagcagcctgcagcctgganatttcgcgtacttattactgaccaacaaattacttctttttactacccgttactagttttcgggtaccagggggtaacctaaggaccgtagggagtaacgttacgaaaacggtaacgttggtacggtactacggacctaacccgtattccgttcgttaccgttacgtaactttcccgttccccgtacccttacgttcccgttaggtaacttaacgttaacttaaccgttggttacgtacggtacgggtccgggtccgttacgggaacgtaacgggtaccgactaacg

SEQ ID NO: 289205 - DNA, 734 bp, Homo sapiens
  misc_feature: GYAE6OF02HA99M.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgaccctagtcctccgtcctcactgtctgtcgttacgtaggttcgggacaggtacgtccacctatcctacgttcggccgggacgacgtcgaccgactagttacggtttacgtttttcggccgttggttcacgcgaggcgtccgtaggaaccaaaccgtcccctaacgtccccgtagtactttccgttttcgtaggtaccttaccgttacgtttaggaaggtacggtacggtaccgtacccgacggtaccgtaggttcgacggccggtacgtagggtttcggttcggaggaacctacgttactttaccaccttcctaccaacctactacgacgtaccgaccgtccgtacgccgtacggtccggtagggtacgttacgttccgtacgttaactttagttaccgcgaacctaaagttacttactttttacgttttaccgtaccgtttacgttaggtttaccggacggtaaccgggtaactacggtcgtagggaactacgtaaacgtaaacgggttcgttggtacggtacctaccggtaacctaccgttacgttcgttaccgttacttacccgtacctttccccg

SEQ ID NO: 289206 - DNA, 723 bp, Homo sapiens
  misc_feature: GYAE6OF02IHLR1.44.75.G09.1.454.CMB.1.raw
  modified_base (218)..(218): a, c, t, g, unknown or other
  misc_feature (218)..(218): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggancctggcaaaacgcccctaaagtccctgattcttttctggatccactttgaagagtggagtcccagccaggttcagcgcagtggttctgggacacatttcactctcaccatcagcagcctgcacgcctgggacgattttcgacgtactttaatactagacccaaactaagttaactttcttttttaatcccgttaactaggtttttagggacccgtaagggggaacctaaacggtccggttagggaacggtaacgttaaccgtaaaaacggggtaaccttagggtacgggtcgttaccgggaacctaaacccggtaacttaccgtttacggttacccgttttaccgtaacctttaccccgtttacccccgtaccccgttaacttaccgtacgttaaactttaaacgttaagttaaacccgtttcgggttaccgtttacggaaccggggttccgggggtacccgttaccggggttaacccgaaacggggttcccggaaccgtaacgg

SEQ ID NO: 289207 - DNA, 539 bp, Homo sapiens
  misc_feature: GYAE6OF02FPHRI.44.75.G09.1.454.CMB.1.raw
  modified_base (252)..(252): a, c, t, g, unknown or other
  misc_feature (252)..(252): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgatcttttcnggatcctactttgaagagtggagtcccagccaggttcagcggcaggtggttctgggacacatttcactctcaccatcagcagcctgcagcctggatagtttcgcgtacttattactgacccaaactaattatttcttttttactccgttactagttttcggccgtaggggacctaagctaggatagtacgaaaggtaactgtgtctgacactatctgttcttcactccttccgcctattctgtatatatactgtctaggcggtcggtcgtacggcacggtcgatacg

SEQ ID NO: 289208 - DNA, 600 bp, Homo sapiens
  misc_feature: GYAE6OF02G94SI.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggtctgggacacatttcactctcaccatcagcagcctgcagcctggagtatttcgcgtacttattactgaccaactaatttactttcttttttacgtccgttacgttacggtttttcgggacccgtaggggtaaccaaggtcgttagggagtacgttaacgaaacgggtaacgttaggtacggcgtgacctaccgtacttcgtacgttccttacgtacttccgttcccgcctactcgttagtattaacgtacttacctcgttcgtcggtacggtccgggtctcgggacgtaacgggcgacgtag

SEQ ID NO: 289209 - DNA, 665 bp, Homo sapiens
  misc_feature: GYAE6OF02JDXGY.44.75.G09.1.454.CMB.1.raw
  modified_base (221)..(221): a, c, t, g, unknown or other
  misc_feature (221)..(221): n is a, c, g, or t
tcagacagtatatacacgaccggtgctcgatttagtatagacatcagggacttaggggctttgccaggctcctgatgctctgtttccccggtgccaggtgtgacatcgagatgacccagtctccgtcctcactgtctgcgtctattggggacagagtcaccatcacttgccgggcgagtgccgacagttaggtacttttttggccttggtttcagcagganccgtggcaaacgcccctaagtccctgattcttttctggactcctactttgaaagtagtggagtcccagccagggttcaggcggctagtggttcgtgggacacgtatttcacttcctcaccatcagcacgcctgctacggcctaggacgtacgtttcgacgtactttatacctcgaccctaaactaattactttacctttttaacttaccgttacttacgttttcgggccggtaacggggtaaccgtaacggtcgtagggaagtaagttaccgtaaaagggtacgttacggtacggtcgtacgtaccgtaaccgactttaccgtcgtttaccttaccgtacttccgttcccctaccgtacttccgttagtaacttaacgttacttaacgttcgttacgttacggacggtccgggacgtcgggtaccgtagggaccgtcgtaacgg

SEQ ID NO: 289210 - DNA, 792 bp, Homo sapiens
  misc_feature: GYAE6OF02I3SEY.44.75.G09.1.454.CMB.1.raw
  modified_base (221)..(221): a, c, t, g, unknown or other
  misc_feature (221)..(221): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggagacagagtcaccatcacttgccgggcgagtgccgacattaggacttttttggccttggtttcagtccaggancctggcaaacgccccctaagtcccctgacttccttttctggaacttccgaacttttggaaacgtagtcggaagtccccagccctagggttcacggccggctaggttcggttctggggaacctactacgttttccaaccttctaccaccgactcacggacacggccttgacgacgtcccgtaggacggttattttccggaccgttaaccttttaaagttacccttacggacccctaaaactaaagttttacttttaccgtttttttaacgttaccccgtttaacgtttacggtttttacgggtacccggtaaagggggtaaccctaacggtaccggtaacgggtaacgtaaacgttaccgtaaaacgggtaacccgttaggttaacggccgttaacggccctaaacccgtaacggtttccttcggtttaccctttaccgttacttacccccggtttccccgaaccttacttaccggttgttaaacctaccgtttaacaccggtttcttaaccggttacgggtaccgtccgggggtacccggttacgggaacccggtagggacccgttaacgg

SEQ ID NO: 289211 - DNA, 596 bp, Homo sapiens
  misc_feature: GYAE6OF02IXB72.44.75.G09.1.454.CMB.1.raw
  modified_base (218)..(218): a, c, t, g, unknown or other
  misc_feature (218)..(218): n is a, c, g, or t
  modified_base (253)..(253): a, c, t, g, unknown or other
  misc_feature (253)..(253): n is a, c, g, or t
  modified_base (373)..(373): a, c, t, g, unknown or other
  misc_feature (373)..(373): n is a, c, g, or t
  modified_base (560)..(560): a, c, t, g, unknown or other
  misc_feature (560)..(560): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtctttttggccttgggtttcagcaggngcctggcaaacgcccctaagtccctgatcttttcnggatccactttgaagagtggatcccagccaggttcagtcggactaggtggttcgtggggacactattcactctacaccatcagcacgctagcagcctggagtatttcgcgtaattactcncgtaccaaacaattacgttcttttttactaccgttacttaggtttttaccgaccggtaagggtaacctaaacggtctagggagtacgtacgaaaacggtaacgtcggtagtccgttacgaccgaacctattcgtcggttcttcgttactccgtcccgtcctacgtactagtacgtactagttacctntcgtacgaggtcggactggacgacggtcgccgtaag

SEQ ID NO: 289212 - DNA, 568 bp, Homo sapiens
  misc_feature: GYAE6OF02FH9XM.44.75.G09.1.454.CMB.1.raw
  modified_base (253)..(253): a, c, t, g, unknown or other
  misc_feature (253)..(253): n is a, c, g, or t
  modified_base (486)..(486): a, c, t, g, unknown or other
  misc_feature (486)..(486): n is a, c, g, or t
  modified_base (493)..(493): a, c, t, g, unknown or other
  misc_feature (493)..(493): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacatttaggacttttttggccttggtttcagcaggagcctggcaaagcccctaagtccctgatcttttcnggatccactttgaagagtggagtcccagccaggttcagcggcaggtcggttctgggacactatttcactctcaccatcagcagcctgcagccgtggatagtttcgcgtacttattacctgaccaaactaattactttcttttttatccgttattaggttttcggccgtaggggacctaagcgtagggatagtaacgaaaggtaacgtggtcggtctagacaccgtatccgttnttccttntacttcccttcccgctacttcagtatattatactcgttcgtgaggtcgggcgtcgggacgacgggtccgagtacg

SEQ ID NO: 289213 - DNA, 516 bp, Homo sapiens
  misc_feature: GYAE6OF02H8RHE.44.75.G09.1.454.CMB.1.raw
  modified_base (184)..(184): a, c, t, g, unknown or other
  misc_feature (184)..(184): n is a, c, g, or t
  modified_base (319)..(319): a, c, t, g, unknown or other
  misc_feature (319)..(319): n is a, c, g, or t
  modified_base (361)..(361): a, c, t, g, unknown or other
  misc_feature (361)..(361): n is a, c, g, or t
  modified_base (460)..(460): a, c, t, g, unknown or other
  misc_feature (460)..(460): n is a, c, g, or t
  modified_base (475)..(475): a, c, t, g, unknown or other
  misc_feature (475)..(475): n is a, c, g, or t
  modified_base (481)..(481): a, c, t, g, unknown or other
  misc_feature (481)..(481): n is a, c, g, or t
  modified_base (495)..(495): a, c, t, g, unknown or other
  misc_feature (495)..(495): n is a, c, g, or t
tcagacagtatatacacgaccggtgctcgatttagtatagacatcagggacttagggctttgccaggctcctgctgctctgtttccccggtgccaggtgtgacatcgagatgacccagtctccgtcctcactgtctgcgtctattggggacagagtcaccatcacttgccgggcgagtgccganattaggacttttttggcctggtttcagcaggagcctggcaaagcccctaaagtccctgatcttttctggatccactttgaagagtgagtccagccaggttcagcggcagtggttctgggacacatttcactctcnccatcagcagcctgcagcctggagatttcgcgacttattacngccaaacaattacttcttttttatccgttactacgtttttggcctaggggacctaagcttaggagtatacgaaagaactgtagctgctaccatctcgtntcgtatctccactanctgatntaatactgtcttgngtcggctggctaggcgctacg

SEQ ID NO: 289214 - DNA, 593 bp, Homo sapiens
  misc_feature: GYAE6OF02JLYRT.44.75.G09.1.454.CMB.1.raw
  modified_base (310)..(310): a, c, t, g, unknown or other
  misc_feature (310)..(310): n is a, c, g, or t
  modified_base (318)..(318): a, c, t, g, unknown or other
  misc_feature (318)..(318): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaacgcccctaagtccctgattcttttctggactccactttgaagagtggacgtcccagccaggttcacggcggcagttggttcngggacacntttcactctcaccatcagcacgcctgcagcctagggatacgtttcgacgtactttatactcgaccaaactaattactttctttttactaccttactagttttcggaccgtaacggggaccaagtcgtaggtaagtagtaacgaaaggaactggtcgtactcgaccacctatactgttccttactacttcccttcccgacctacttacctgtactacttaactacgttctacgtaggtcggtaccggtcgtacgggacgaacggtccgtactaacg

SEQ ID NO: 289215 - DNA, 630 bp, Homo sapiens
  misc_feature: GYAE6OF02GUUFF.44.75.G09.1.454.CMB.1.raw
  modified_base (257)..(257): a, c, t, g, unknown or other
  misc_feature (257)..(257): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtcgccgacattaggtacttttttggccttggtttcagcaggacgcccggcaaacgcccctaagtccctgattcttttcnggatccactttagaagtagtggacgtcccagcctagggttcaggcggcaggttggttctgggacactatttcactctcaccatcagcagccctgcacgccgtggacgtatttccggcgtacttttaattacctcgacccaaactaattacttttcttttttaactccgttacgttaggttttcggaccggtaggggacctacgtacgtaggacgtagtaacgaaaaggtacgtggtcggcttgacctaccattctcgtacttcacttcccttcccgacctaacttccgttagtacttaagtaccttaacgttcgttacgttcggaacgggtccgggtacggtacgggaccgtaagggtcccgtactaggtacg

SEQ ID NO: 289216 - DNA, 888 bp, Homo sapiens
  misc_feature: GYAE6OF02IBO4T.44.75.G09.1.454.CMB.1.raw
tcagacagtatatacacgaccggtgctcgatttagtatagacatcagggacttagggctttgccaggctcctgctgctctgtttccccggtgccaggtgtgacatcgagatgacccagtctccgtcctcactgtctgcgtctattgggacagagtcaccatcacgttggccgggcgtaggtcgaccgactagtttaggtaccttttttcggccgttggtttaccaggcgtagggactccgtaggacctaaacgtacccccgttaagtccccgtaggtaacttttccgttttacgtacggtacgttaccccgtaacgttttagggaaaacggtacggttacggggaaccggtttaccccccgaggtacccccgtaaaggggttttcccaacgggtaccgggtacccgttaagggttccggggttttaaccgtacgggggtaaccctaccgttaaccgtttttcccggaaccttcccggttaccctaaacccgtacgttaccggtaaccgtaccggtaaccgtcccttggaaacccgtccgggtacccggttaagggaccggttactttcccggtacggttaaccttttacgttaacgtaccggtaccctaaacgtaaattttaccgtttacctttttacgtacccggttactttacgggttttcggaccgtaagggtacctagcggttaggagtaaccgttacgaaacgtacgtcggtaggtactacgtaccgaacctacggttccttaccgggttactttaccgtaccgttcccgttaccctaaccgtagttccgttaacgaattttacccgtaagttaccggtggttaaacccgttcgggaacggttccgggtctaaccgggtaccacgggttaccacggttaccgg

SEQ ID NO: 289217 - DNA, 559 bp, Homo sapiens
  misc_feature: GYAE6OF02I3KZD.44.75.G09.1.454.CMB.1.raw
  modified_base (255)..(255): a, c, t, g, unknown or other
  misc_feature (255)..(255): n is a, c, g, or t
  modified_base (308)..(308): a, c, t, g, unknown or other
  misc_feature (308)..(308): n is a, c, g, or t
  modified_base (330)..(330): a, c, t, g, unknown or other
  misc_feature (330)..(330): n is a, c, g, or t
  modified_base (502)..(502): a, c, t, g, unknown or other
  misc_feature (502)..(502): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaacgcccctaagtccctgattcttttcnggtactccactttgaagagtggagtcccagccaggttcagcggcagtggttcngggacacatttcactctcaccntcagcagcctgcagcctggatatttcgacgtactttattactcgaccctaaactaattactttcttttttactccgttacttaggttttcggccgtacggggacctaaggctaggagtactacgaaaggtactgtacggctagctaccattctagtcttcattcccttcccnctacttctactatactataccttgtctagcggtcggcgtggacgacggtcgactacg

SEQ ID NO: 289218 - DNA, 793 bp, Homo sapiens
  misc_feature: GYAE6OF02JMBHM.44.75.G09.1.454.CMB.1.raw
  modified_base (221)..(221): a, c, t, g, unknown or other
  misc_feature (221)..(221): n is a, c, g, or t
  modified_base (259)..(259): a, c, t, g, unknown or other
  misc_feature (259)..(259): n is a, c, g, or t
tcagacagtatatacacgaccggtgctcgatttagtatagacatcagggacttagggctttgccaggctcctgctgctctgtttccccggtgccaggtgtgacatcgagatgacccagtctccgtcctcactgtctgtcgtctattgggacagagtcaccatcacttcgccgggcgagtgcccgacattaggtacttttttggccttggttcagtcaggancctggactaaacgcccctaagtccctgacttctttcgnggtactccactttgaagtagtggtacgtccgagtcctaggttcaacggccgggtactaggttcggttctggggtaaccattacgtttcctaactccgtccaaccacttccaggtacccaggccccttagtaccgacgtacccgtggggtaacttacgttttaccgggcccgttaacgtttaacgtttaaacccgtcggaaccccttaaataaaacgttttactttttaccctttttttaaccgtttacccgtttaaccgttttaacgggttttttacccggtacccgttaacggggtaacccgtaacggttaccgttacggtacgttaacgtaacgtaaacggtaacgttagtcgggtacctacggtacctaacccgtattaccggttacgttacctttacgttacctttcccgttaccccgttaccgtactttaccgttacgtaacttacgtttaaaccgttacgttccgtttaccgtacggttacgggtaccgggtcggttaccggtaccggtaacggggccttacgaacgg

SEQ ID NO: 289219 - DNA, 617 bp, Homo sapiens
  misc_feature: GYAE6OF02JI2RY.44.75.G09.1.454.CMB.1.raw
  modified_base (258)..(258): a, c, t, g, unknown or other
  misc_feature (258)..(258): n is a, c, g, or t
  modified_base (419)..(419): a, c, t, g, unknown or other
  misc_feature (419)..(419): n is a, c, g, or t
tcagacagtatatacacgaccggtgctcgatttagtatagacatcagggacttagggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgacttcttttcnggatccaactttgaagagtggagtccccagccaggttcaggcggcaggtggttcgtgggacactatttcactctcacatcagcagcctgcacgccgtggacgtatttcggcgttaacttattaactcgacccaaagtagtaataagtagtttacttcgtanagttagttttcggaccgaaggggaccaagtcgtaggaagtactaacgaaacgtaacgtgtacggtctacgacctaccgtattaccgttcgttccttactaccgttccttacccgtacctacttacgtacggtaacttaagttaacttacgttagttcgttacggcggtccgggtacgtacgggtacgtaacggtaccg

SEQ ID NO: 289220 - DNA, 679 bp, Homo sapiens
  misc_feature: GYAE6OF02IFMZ8.44.75.G09.1.454.CMB.1.raw
  modified_base (217)..(217): a, c, t, g, unknown or other
  misc_feature (217)..(217): n is a, c, g, or t
tcagacagtatatacacgaccggtgctcgatttagtatagacatcagggggaggaatcagacccagtcaggacacagcatggacatgagagtcctcgctcagctcctggggctcctgctgctctgtttccccggtgccaggtgtgacatcgagatgacccagtctccgtcctcactgtctgctctagttggggacagagtcacatcacttgccgggnagtcgccgactattaggtacttttttggccttggtttcagcaggagccgtggacaaacgtcccctaagtcccctagtactttctttttcgtggtactcctacgtttagaagtagtggacgtcccagtccgaggttcaggcggcgtaggttcggttcgaggactacgtatttccactcctcaccatcgacgcacgccctgcacgccgtaggagtacgtttccgacttaacgtttacttaccgtacgaccctaaacgttatttacttttactttttttaacgtacccggtttagtttacggtttttcgggtaccgggtaacggggtaacctaaagggtccgttagggtaagtaacgtaaccggtaaaagggtaccgttacgggttacggacccgtttacgaacccgttacccgttacgtttacccgtttacggtttaccctttaccgtaccttttaccccccgg

SEQ ID NO: 289221 - DNA, 881 bp, Homo sapiens
  misc_feature: GYAE6OF02HEAEU.44.75.G09.1.454.CMB.1.raw
  modified_base (183)..(183): a, c, t, g, unknown or other
  misc_feature (183)..(183): n is a, c, g, or t
  modified_base (215)..(215): a, c, t, g, unknown or other
  misc_feature (215)..(215): n is a, c, g, or t
tcagacagtatatacacgaccggtgctcgatttagtatagacatcaggacttagggctttgccaggctcctgctgctctgtttcccggtgccaggtgtgacatcgagatgacccagtctccgtcctcactgtctgcgtctagttgggacagagtcaccatcacttgccgggcgagtcgccganagttagactttttggccttggttcagcagganccgtgacaacggccctaaggtccctaggtacttctttacgtggaacttccgtacgtttaggaacgtaggtcggtaacgttacccgtacgtaccggtaggttaccgtaggaccggtcggtaacggttcgggtttcgtaccgggggtacctaacgtaacttttccgtaaccttccggttaacctaaccccaagtttacccaaggttaccccgaacggtaccgtttcggaccttaacgcccggttagggtaaaccgttcgttttacccggaccgttaaacgttttacgttaaccttacgtacccgtaaaaaccgtaaattttacgtttttaccgttttttaccgttaccctttaacgtttaacggttttttacgggccccgttaaaggggttaaacccgtaaaccggtacgttaacggggtaaacgtaaacggtttaaccggaaaaaacgggttaacctttcgggggtacgttaacccgggtacgttaaacccgtaccctaaccgttttaccgggtccgttaccgtttaaccttaaccgtttccccgtttaccccggtacccttagttaccgttcgtaaactttaaccgttaaacttaccgttagttttacccgacggttaaccggcggttaccgttacgggacccgtaacggtcggaacccgttaagg

SEQ ID NO: 289222 - DNA, 698 bp, Homo sapiens
  misc_feature: GYAE6OF02GHL11.44.75.G09.1.454.CMB.1.raw
  modified_base (220)..(220): a, c, t, g, unknown or other
  misc_feature (220)..(220): n is a, c, g, or t
  modified_base (281)..(281): a, c, t, g, unknown or other
  misc_feature (281)..(281): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgacattaggtacttttttggccttggtttcagcaggngcctggaccaaacgcccctaagtccctgtacttcttttcgtggtactcctactttagaagngtggacgtcccagcctaggttcacggcggacgaggtggttcgtagggacacgtatttcactctacaccatcagcgacgcctgcagccgtggacgtacgtttcgacgttactttatttacgtcgaccctaaactaactttacttttacctttttttacgttaccccgtttaacgtttacgggtttttacgggtacccggtaacgggggtaacctaacgggtcgtagggtaagtaacgttaaacgtaaaacgggtacgttacgggttacgggaccgttacgacctaacctactttacgttccgtttaccgttaccgtacgtttcccgtttccccgtacctaacgttctacgttattaacgttacttaacgttcgttacgttgaccgggtcggtacggtcggacgaacggtacggctaag

SEQ ID NO: 289223 - DNA, 530 bp, Homo sapiens
  misc_feature: GYAE6OF02H26ZE.44.75.G09.1.454.CMB.1.raw
  modified_base (375)..(375): a, c, t, g, unknown or other
  misc_feature (375)..(375): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggcctggtttcagcaggagcctggcaaagcccctaagtccctgatcttttctggatccactttgaagagtggagtcccagccaggttcagcggcagtggttctgggacacatttcactctcaccatcagcagcctgcacgcctggactatttcgcgtacttattactgaccaaanaattattactttttatccgttactagtttttggccgtaggggacctaagctggagatacgaaagactgtgctgcacatctgtcttcactcttcccgctatctagatatattactgtcgtcgtaggcgggtcgtcggacaacgggtcgtactaacg

SEQ ID NO: 289224 - DNA, 441 bp, Homo sapiens
  misc_feature: GYAE6OF02HTDIN.44.75.G09.1.454.CMB.1.raw
  modified_base (366)..(366): a, c, t, g, unknown or other
  misc_feature (366)..(366): n is a, c, g, or t
  modified_base (397)..(398): a, c, t, g, unknown or other
  misc_feature (397)..(398): n is a, c, g, or t
  modified_base (400)..(441): a, c, t, g, unknown or other
  misc_feature (400)..(441): n is a, c, g, or t
tcagacagtatatacacgaccggtgctcgatttagtatagacatcagggacttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtaataagagttattctcagtagtttttggccaaggggaccaagctggagatacaaacgactgtggctgccaccatctagtccttacactccttcccgccactctgtatatactactgttcctgtacggcgggntcgggacaaggggccgactaagttagctagnngnnnnnnnnnnnnnnnnnnnnnnnnnnnnnnnnnnnnnnnnnn

SEQ ID NO: 289225 - DNA, 562 bp, Homo sapiens
  misc_feature: GYAE6OF02JB65N.44.75.G09.1.454.CMB.1.raw
  modified_base (270)..(270): a, c, t, g, unknown or other
  misc_feature (270)..(270): n is a, c, g, or t
  modified_base (312)..(312): a, c, t, g, unknown or other
  misc_feature (312)..(312): n is a, c, g, or t
  modified_base (498)..(498): a, c, t, g, unknown or other
  misc_feature (498)..(498): n is a, c, g, or t
  modified_base (521)..(521): a, c, t, g, unknown or other
  misc_feature (521)..(521): n is a, c, g, or t
  modified_base (557)..(557): a, c, t, g, unknown or other
  misc_feature (557)..(557): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgattcttttctggactccactttgaagngtgagtcccagccaggttcagcgcagtggttctgggacactntttcactctcaccatcagcagcctgcagccttggagtactttcgactactttattactgacccaaataacttatttactttttactacccgttactaggtttttcggccgtaaggggtaccaagtccgtagggaagtatagaaaggtaacttggtagtactggacctaaccgacttcgtgttcttntcttacctcccgctactccgtanattatatactgttctgaggcggctggactacggacntaacg

SEQ ID NO: 289226 - DNA, 537 bp, Homo sapiens
  misc_feature: GYAE6OF02GKR3C.44.75.G09.1.454.CMB.1.raw
  modified_base (255)..(255): a, c, t, g, unknown or other
  misc_feature (255)..(255): n is a, c, g, or t
  modified_base (440)..(440): a, c, t, g, unknown or other
  misc_feature (440)..(440): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattagtacttttttggccttggtttcagcaggagcctggacaaacgcccctaagtccctgattcttttcnggactccactttgaagagtggagtcccagccaggttcagcggcaggttggttctgggacactatttcactctcaccatcagcagcctgccagcctggagtactttcgacgtacttattaccgtgaccaaataattactttctttttatccgttactagttttggccgagggaccaagtctagganatacgaaagtactggtagctgacactatctgtcttctacttcctcccgctatctgtactatatactgtctagaggcggcgtaggacgaggcgactag

SEQ ID NO: 289227 - DNA, 703 bp, Homo sapiens
  misc_feature: GYAE6OF02GQ91R.44.75.G09.1.454.CMB.1.raw
  modified_base (335)..(335): a, c, t, g, unknown or other
  misc_feature (335)..(335): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaacgcccctaagtccctgattcttttctggatccactttgaagagtggagtccccagccaggttcaggcggcagtggttctgggacacgatttcactctcaccatcancacgcctgcagccgtggagtatttcgcgtactttattctcgaccaaactaattacgtttctttttttactcccgtttacttacggtttttcgggcccggtaacgggggtaccctaacggtccgtagggtacgtaacgttaaccgaaaacgggtaacgtacgggttacgggtacgttcggaccgtaaccctaacgtttaccgttcggtttaccgttttaccgttaacctttccccgtttaccccccggtacccgttacctttacccgtttaggtaacgttttaacgttaacgtttacccgttacggttacccgttaggtacggggtccgggtacggttaccgggaccggtaacggtacccgagtaacgg

SEQ ID NO: 289228 - DNA, 610 bp, Homo sapiens
  misc_feature: GYAE6OF02JB3P8.44.75.G09.1.454.CMB.1.raw
  modified_base (255)..(255): a, c, t, g, unknown or other
  misc_feature (255)..(255): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaagcccctaagtccctgacttcttttcnggatccactttgaagagtggagtccccagccaggttcagcggctaggtggttctggggacactatttcacgtctcaccatcagacagcctgcagcctaggactatttccgcgtacttattactcgaccaacgtaattactttaccttttttacgtacccgttacgttacgtttttacggacccgtaacgggtacctaagtcgtaggacgtacttaacgaaaggtactaggtcgtactcgcaaccattcttcgttcttactacttcccgtacccgtcctacttccgtagtactacgtaacttacgttcgtacgtcggaccggtccggtcgtacggaccgtaacgggcctacgtacg

SEQ ID NO: 289229 - DNA, 622 bp, Homo sapiens
  misc_feature: GYAE6OF02HQXUB.44.75.G09.1.454.CMB.1.raw
  modified_base (257)..(257): a, c, t, g, unknown or other
  misc_feature (257)..(257): n is a, c, g, or t
  modified_base (370)..(370): a, c, t, g, unknown or other
  misc_feature (370)..(370): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtactttttttggccttggtttcagcaggagcctggacaaacgcccctaagtccctgattcttttcnggatccactttgaagagtggagtcccagccaggttcagcggcagtgttctgggacacatttcactctcaccatcagcagcctgctagccgtggagtatttcggcgtaactttnttaactgaccaactaattactttactttttttactacccgttaactagttttcggaccgtaaggggtaccctaacgtcgtaggaagtaacgtaacgtaaaaggtacgttaggtacgtcgtacgactaacccgtacttccttcgttcctttacgtactttcccgttcccgaccctacgttacctagttacttacgtaacttaccgtgttccgtagacggtcgggcgtcgggtacctagggtccgacgtaacgg

SEQ ID NO: 289230 - DNA, 604 bp, Homo sapiens
  misc_feature: GYAE6OF02HLW3X.44.75.G09.1.454.CMB.1.raw
  modified_base (252)..(252): a, c, t, g, unknown or other
  misc_feature (252)..(252): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttcnggactccactttgaagagtggagtcccagccaggttcagcggcagttggtctgggacacatttcactctcacatcagcagcctgcagcctggagattttcgcgtacttattactcgacctaaataattatttcttttttacttccgttactaggtttttacggccgtacggggaacctaaggtcgtaggagtaagtacgaaacggtaactggtaggtctacggctaaccacgttctacggttcctttactacttccttcccgacctacttcctcgtaattacgttaacttaccgttcgttacgtacggtacggtaccggggtcgtacgggaccgaacgggtccgacgtaacg

SEQ ID NO: 289231 - DNA, 614 bp, Homo sapiens
  misc_feature: GYAE6OF02JVT2T.44.75.G09.1.454.CMB.1.raw
tcagacagtatatacacgaccggtgctcgatttagtatagacatcagggacttaggggctttgccaggctcctgctgctctgtttccccggtgccacggtgtgacatcgagatgacccagtctccgtcctcactgtctgcgtctattggggacagagtcaccatcacttgccgggcgagtgccgacattaggacttttttggccttggtttcagcaggagcctggacaaacgcccctaacgtccctgtacttcttttctggtactccactttgaagagtggagtcccagccaggttcagcggcagtggtctgggacacatttcactctcaccatcacgtcagccgttagccacgcctggacgtatttcgcgtacttattacgtgaacctaacaattactttctttttactccttacttagttttcggacctagggaacctaaggtccgtagggaacgtataacggaaaggtaacgtaggtcggtacgttacggacaccgtaacgttcttcgttacttctaacttcccgttcccgtacctagttccttagtacttaagttacgtaccttagtcgtaggtacggacgggttcgaggtacgtaacggcgtacgtaag

SEQ ID NO: 289232 - DNA, 550 bp, Homo sapiens
  misc_feature: GYAE6OF02IM33Q.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggcccttggtttcagcaggagcctggcaaagcccctaagtccctgatctttctggatccactttgaagagtggagtcccagccaggttcagcggcagtggttctggggacacatttcactctcaccatcagcagcctgcagcctggagtattttcggcgtactttattactgacccaaactaatttactttctttttttactccgttaactagtttttggccgtaggggtaccaaggcgtagggagtagtacgaaaggtaactggtgctgcaccatcttcgtcttcacttccttcccgtcctatctagtacttatatacttgtctgaggcggcgtggacgaaggcgatag

SEQ ID NO: 289233 - DNA, 576 bp, Homo sapiens
  misc_feature: GYAE6OF02HJNTX.44.75.G09.1.454.CMB.1.raw
  modified_base (226)..(226): a, c, t, g, unknown or other
  misc_feature (226)..(226): n is a, c, g, or t
  modified_base (339)..(339): a, c, t, g, unknown or other
  misc_feature (339)..(339): n is a, c, g, or t
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccgggcagtgccganattaggactttttggcctggtttcagcaggagctgcaaagccctaagtccctgatcttttctggatcctactttgaagtagtggagtcccagccaggttcagcgcagtgttcnggcacgatttcgactcgtcacatcacgcacgtacctgccagcccgtaggacgtaagtttcggcgtaaccgtttattaccgtcacctaaacgtaatactttactttttacttccgttaacgttagttttcggaccgtagggtaaccctaagtcgtaggagttacgacgtaaacgggtaacgtggtacgggtactacggacctaaccgacgttccgtacgttcctttacgaccttcccg

SEQ ID NO: 289234 - DNA, 812 bp, Homo sapiens
  misc_feature: GYAE6OF02HH4IB.44.75.G09.1.454.CMB.1.raw
  modified_base (173)..(173): a, c, t, g, unknown or other
  misc_feature (173)..(173): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgngcgtagtcgacatagttacgtttacgtttcgcgttgtacacgcgaggctcgtcgaacaaccgtaccgtaccgtcctagtactttcttcgtagtacctaccttacgttagaagtggtacggtaccgtaccgacgtaccggttacggtacgacgggtccgtagtacgggtttccggttcggtacggaacctaagtttacctttacctaccgttcctacccaacctacgtaccgacgaccgtaccgtccggtaccgacgacccggttcggtaacggtagttttacccgttaccggtaaccttttaacgtttaaccgttaccgtacccgaaaaccctaaaactttaattttactttttttaaccgttttaaccgtaccggtttaacgtttttcgggttaacccggaaccgggttaaacggaactaggtaccggtaaggaactaaccgtaaaagggaaacgttcgtaggggtacctacgttaccgtaacctacgttcgttaccgttctttacctaaccgttacccgttcccggtaacccaaccgttttagacgtttacgtaactttaccgttaacggttccgttaccgttgggtaacgggtccggggttaccgtaggtaccggaacggttaccgccggttaaac

SEQ ID NO: 289235 - DNA, 663 bp, Homo sapiens
  misc_feature: GYAE6OF02GK7P3.44.75.G09.1.454.CMB.1.raw
  modified_base (230)..(230): a, c, t, g, unknown or other
  misc_feature (230)..(230): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtcagggcattagctaattattagcctggtatcagcaagaaaccagggaaacnctacctaagctcctgatctatgaaacatcctattttgactaatccgacggggtcccattccgtcggttcaggcggcagtggatcgtgggacagtatttcactctcctaccgtcacgcacgcctcgcacgcctagaagtatgttagactaacttattacttagtaactaaaagttactaaacgtacggtaccgtacccctcgtaaaccgttaccgtttacccgggacccgttaccgggaaccctaccgtaggttacggtaacgtaactaacgaacggtaccgtaacgttggttacgggaccttacgacctaacccgtatttccgttaccttccgtttactaccgtttccccgttaccccgtccttaacttaccgttacgtaacgtttaacttacgtttaacgttccggtacgttacgggaacgggttcccgggg

SEQ ID NO: 289236 - DNA, 736 bp, Homo sapiens
  misc_feature: GYAE6OF02GLQZ6.44.75.G09.1.454.CMB.1.raw
  modified_base (256)..(256): a, c, t, g, unknown or other
  misc_feature (256)..(256): n is a, c, g, or t
  modified_base (273)..(273): a, c, t, g, unknown or other
  misc_feature (273)..(273): n is a, c, g, or t
  modified_base (312)..(312): a, c, t, g, unknown or other
  misc_feature (312)..(312): n is a, c, g, or t
  modified_base (352)..(352): a, c, t, g, unknown or other
  misc_feature (352)..(352): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgattcttttcnggactccactttgaagngtggatcccagccaggttcagcgcagtggttctgggacncatttcactctcaccatcagcagcctgcagtcctaggganacttttccgacgtaactttagttacctggacccaaacgtaaactttacttttacctttttttaacgtacccgttaacttaggtttttacgggaccgtaacgggggaaccctaaaggtccgtagggaacgtaacttaaacggtaaaacgggtaaccttagggtcggtacgttaccggaccctaacccgtatttacccgttacggtttaccctttacgttaacccgtttcccgtttacccccggacccgtttaactttacccgttaggttaaacctttaacgttttaaaccgtttaaccgtttacgggttaccgttacgggtaaccggggtccggggttaccggttacggggttaaccggaaacggggtaccggtacgttaaacgg

SEQ ID NO: 289237 - DNA, 554 bp, Homo sapiens
  misc_feature: GYAE6OF02JAFLG.44.75.G09.1.454.CMB.1.raw
  modified_base (497)..(497): a, c, t, g, unknown or other
  misc_feature (497)..(497): n is a, c, g, or t
  modified_base (549)..(549): a, c, t, g, unknown or other
  misc_feature (549)..(549): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctgggtttcagcagggagcctggcaaaagcccctaaagtccctgacttcttttctggactcctactttgaagagtggagtcccagccaggttcagcggcagtggttctgggacactatttcactctcaccatcagtcagcctgcagcctggagtatttcgcgtacttatactgaccaaataattatttctttttactaccttactagttttcggacgtaagggacctaagtcgtaggagtaatacgaaaggaacttggtgtctgacaccgactctgttcttctacttccttcccnccacttctgtactactattactgtctagagcgggtctacggcgaacggcgtntaacg

SEQ ID NO: 289238 - DNA, 757 bp, Homo sapiens
  misc_feature: GYAE6OF02H1K25.44.75.G09.1.454.CMB.1.raw
tcagacagtatatacacgaccggtgctcgatttagtatagacatcagggacttaggggctttgtcaggctcctgctgctctgtttccccggtgccaggtgtgacatcgagatgacccagtctccgtcctcactgtctgcgtctagttgggacagagtcaccatcacttgccggcgagtgccgactattagtacttttttggccttggtttcagcaggacgccgtggacaaacgcccctaaacgtccctgtattcgttttctggactcctacgtttagaacggtaggtaggacgtccccgagcccgtagggttccacggcggctagggttcggttaccggttgggaacctaacttctttacccgaccttccgtaccaacccgtatcccgaacgccgtaaccgcccgttggacccacggtcccgttagggaacgttaccttttacggaccggttaaccttttaagtttaaccgtacgtaaccctaaaaccttaagttttaactttttactttttttaaccgttaccggtttaacgtttaccgggtttttaacgggacccggtaacgggtaaccgtaacggtacgtacggaagtacgttaaacgtaaaggtacgtaggtagtacgtacgaccgtacctaacgtcttacgtacttacctaccgttacctacccggtacctacgtaccttagtaactaatacgttaccgtggtactcggtaacgggtcgggtacgacggttaacggacggtaccgacgtaag

SEQ ID NO: 289239 - DNA, 667 bp, Homo sapiens
  misc_feature: GYAE6OF02G9OLJ.44.75.G09.1.454.CMB.1.raw
  modified_base (253)..(253): a, c, t, g, unknown or other
  misc_feature (253)..(253): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggaccttttttggcctggtttcagtcaggagcctggcaaagcccctaagtccctgatcttttcnggtatccacttttgaacgagtggagtccccagccaggttcaggcggcagtggttctgggacacatttcaactctcaccatcagcagcctgcagcctggagtatttcgacgtacttattcgtcgaccaaacagttatttacgttttttatccggttaacttaggtttttcggtacccgtaacggggtacctaaacgggacttacgggaagtacgtaacgaaaacgggttaacgttcgggttaacgggccgtttacggacccgtaacccgtaacgttccgttacggttccttttaccgaacgttccgtttacccccggccttacgttaccgtgtaattaccgttaacttaacgttccgttactacgggtacggttaccgggccgttacggaccgtaacgggtccgtacccgtaacg

SEQ ID NO: 289240 - DNA, 905 bp, Homo sapiens
  misc_feature: GYAE6OF02HERC7.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctcgtttccccggtgccaggtgtgacatcgagatcgacccagtcctccgtcctcactgtctcgcgtctagttgggacagagtccacctatccacgttcggccgggacgtagtcgacccgtatacgttagggtacttttttcggcctttggtttccaggcgaggtacgccgtggaacaaacgtccccctaagtcccctggtaactttccgttttcgtacggtaccttacccgtaacgtttaggaaacggttaacggttcgggtaacccggttacccccaacgggtacccgtaacgggttttcccgaacggacccgggtacctacggggtttcgggtttaccggtaccggggtaaccctaaccgttaacgttttacccgaaccgttcccgtaaccctaaaccccgtacttaccgaacggtaccctaacgggtcccttacggaccgtaccgggtcccttaaggggtaaccgttacgttttcccgggaacctttaaccgttttaaaccgttaccgtaaccggtaacccctaaaacgttaaactttaaccgtttttaccctttttttaaaccggacccggttttaaaccgtttaacgggtttttaccccgggtaaccccggtaaccgggggttaaccctaaaggttcccgttaagggtaacgtaaccgttacgggtaaaaaaccggttcggtaccggtttaaccggtaccgttaaccgtaccctttaaacccgttacggttttcccgttacccgtttaacccgttttacccgtaccccgttttaccccg

SEQ ID NO: 289241 - DNA, 680 bp, Homo sapiens
  misc_feature: GYAE6OF02G7V3D.44.75.G09.1.454.CMB.1.raw
  modified_base (260)..(260): a, c, t, g, unknown or other
  misc_feature (260)..(260): n is a, c, g, or t
  modified_base (306)..(306): a, c, t, g, unknown or other
  misc_feature (306)..(306): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttccagcaggagccgtggacaaacgcccctaagtccctagtacttcttttcnggtactccgtactttgaagagtggagtcccagcctagttcaggcgnagtggttctggacactattcactctcaccatcagcagcctgcacgcctggactactttcggacgtacttattaccgacgtacctaaacgtaattttactttaccttttttacgtacccgtttaagttaaggtttttcccgggaacccggtaacgggggtaaccctaaacgggtccgtaagggtaacgtaacgttaaccggtaaaacgggtaaccttagggtacgggtaacctacggaccgtacccgtaacttccgtttacggttccttacgtaacgttccctttaccccgacttactccgttagtacttacgtacgttacctgttacctagggaccgtccgggtaccgtaggtacccgagtaccgtacctaagg

SEQ ID NO: 289242 - DNA, 551 bp, Homo sapiens
  misc_feature: GYAE6OF02GLV8E.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgatcttttctggatccactttgaagagtggagtcccagccaggttcagcggcagtggttctgggacacatttcactctcacatcagcagcctgcagcctggatatttcgcgtacttattactgaccaactaatatttcttttttatccgttactagttttggaccgtaggggtaccaaaggtctagggagtatacgaaaggtactggtcgcgtagcacagtctgttcttcacttcctcccgctatctagtattatacttacttcgtcttacggtacggccgggtacgtcgggcgaacggtccgctaacg

SEQ ID NO: 289243 - DNA, 688 bp, Homo sapiens
  misc_feature: GYAE6OF02FZFN0.44.75.G09.1.454.CMB.1.raw
  modified_base (313)..(313): a, c, t, g, unknown or other
  misc_feature (313)..(313): n is a, c, g, or t
tcagacagtatatacacgaccggtgctcgatttagtatagacatcaggggaggaatcagacccagtcaggacacagcatggacatgagagtcctcgctcagctcctggggctcctgctgctcttgtttccccggtgccaggtgtgacatcgagatgacccagtcctccgtcctcactgtctgctctagttggggacagagtcacctatcacgttcgccgggcgagtcgacccgactagttaggtacttttttggccttggtttcagcgaggacgcctggacaacgtcccctaagtccctgtacttcttttcgngtactcctactttaggaagtcgtaggtactccccgtaggccgtaggttcgacgggtcggtagtacggttgggttcgtacgggactacgttaactttcgaaccttccgtacctaacccgtatccgacgtccgaacgtcccgtacggcctacgggtcccgtagggttaacgttacgtttcgaccgttaactttacgttacttacgaaccctaaataatttaccttttacgtttttaccgtccgttaacgtttcggtttacgggacccgtaacggggacctaacggtcgtaggacgtagtacgaaacgggtcgttaggtcggacctacgaccgtaccgttaagttccgtttacgttaccctttactactttaccccgg

SEQ ID NO: 289244 - DNA, 558 bp, Homo sapiens
  misc_feature: GYAE6OF02HIQGK.44.75.G09.1.454.CMB.1.raw
  modified_base (175)..(175): a, c, t, g, unknown or other
  misc_feature (175)..(175): n is a, c, g, or t
  modified_base (253)..(253): a, c, t, g, unknown or other
  misc_feature (253)..(253): n is a, c, g, or t
  modified_base (299)..(299): a, c, t, g, unknown or other
  misc_feature (299)..(299): n is a, c, g, or t
  modified_base (466)..(466): a, c, t, g, unknown or other
  misc_feature (466)..(466): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggngagtgccgacattaggacttttttggccttggtttcagcaggagcctggcaaagcccctaagtccctgattcttttcnggactccactttgaagtagtggagtccccagccaggttcagcggcngtggttcaggacactattcactctcaccatcagcagcctgcagcctggactatttcgcgtacttattactcgaccaaactaacttagtttaccttttttaacgtaccgttacgtagtttttcggccgtaacggggaccaagtcgtaggagagtactaaaggactggngtctgacacgtatcgtgtctactctccttccgctatcgtgattagtctacttgtcgtgacggtccggtagtcggacggtaacggcgtatacg

SEQ ID NO: 289245 - DNA, 608 bp, Homo sapiens
  misc_feature: GYAE6OF02G17IP.44.75.G09.1.454.CMB.1.raw
  modified_base (250)..(250): a, c, t, g, unknown or other
  misc_feature (250)..(250): n is a, c, g, or t
  modified_base (300)..(300): a, c, t, g, unknown or other
  misc_feature (300)..(300): n is a, c, g, or t
  modified_base (370)..(370): a, c, t, g, unknown or other
  misc_feature (370)..(370): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagccctaagtccctgatctttcnggatccactttgaagagtggatcccagccaggttcagcggcagtggttcngggacacatttcactctcacatcagcagcctgcagcctggacgatttcgcgtaactttatactgaccaanaacttatttctttttactccgtttatagtttttcggaccgtacggggtacctaacggtctagggagtacgttacgtaaaacgggtaacgttcggtcggtactcgacctaccgtaacgttccgtacggttccttctacgtttcccgttacccgcctacttccgtagtaacttagttaacttacttcgttacgttacggtacggtccgggtcgtacggtacgtacgggtcctacgtaacg

SEQ ID NO: 289246 - DNA, 614 bp, Homo sapiens
  misc_feature: GYAE6OF02GJBLH.44.75.G09.1.454.CMB.1.raw
  modified_base (218)..(218): a, c, t, g, unknown or other
  misc_feature (218)..(218): n is a, c, g, or t
  modified_base (249)..(249): a, c, t, g, unknown or other
  misc_feature (249)..(249): n is a, c, g, or t
  modified_base (304)..(304): a, c, t, g, unknown or other
  misc_feature (304)..(304): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggancctggcaaagccctaagtccctgatctttcnggatcctatttgaagagtggacgtcccagcctaggttcagcggctagtggttcgngggacacgtatttcactctcaccatcacgcacgcctgacctagcctaggtagtacttttcgacgtactttaactactcgacctaaactaattcttacgtttttataccgtacttaggttttcggaccgtacgggtacctaaggcctaggtacgtagtacgtaaaggtacgttgtacgtcgtacgaccgtaacgtcgtacgtacgttcttacgtacgttccgttccgtactactcgttacgtatacgttaacgtacgttcgtacgttacggacggtacggtacgtacggacgtaacggtccgtacgtacgg

SEQ ID NO: 289247 - DNA, 644 bp, Homo sapiens
  misc_feature: GYAE6OF02GX95O.44.75.G09.1.454.CMB.1.raw
  modified_base (525)..(525): a, c, t, g, unknown or other
  misc_feature (525)..(525): n is a, c, g, or t
tcagacagtatatacacgaccggtgctcgatttagtatagacatcaggggggggtctcaggaggcagcgctctcaggacgtcaccaccatcggcctgggctctgctcctcctcaccctcctcactcaggacacagggtcctgggcccagtctgccctgactcagcctgcctccgtgtctgggtatcctggactaggtcgatcaccttctcctgcactggactcagcagtgacggctccaactttctaatcgtccgtcctccgtgtatacaacaacactccccggaaccaaaccccccgtaaaactcctttagactttaccaagttacgaaacttactaccgtaaacggccggtaccccttcgttagggttaacttttcgtacgtactccggtcctttcgtcgttacggcctaccgacggttcccgggactaaaccgccgtcccgtcctacgaacctaacgttctcgtcggccttcgaaggtctaggagacggaggtctagtaatttacttacgcgtactgtctanataactacgagtaacggacttactttacacgttcgactagacggtacacgcgtacgtaccgtacgttacggaccgacggaccccgtaggtccctacccggtcccgtaccgtacttcccg

SEQ ID NO: 289248 - DNA, 770 bp, Homo sapiens
  misc_feature: GYAE6OF02JA7HL.44.75.G09.1.454.CMB.1.raw
  modified_base (130)..(130): a, c, t, g, unknown or other
  misc_feature (130)..(130): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctnactgtctgcgtctattggggacagagtcaccatcacttggccgggcgagtcgccgacattaggtacttttttggccttggtttcagcgaggagcctgggacaaacggtcccctaaggtccctagtattctttctaggtactccgtactttagaagtaggtcggtacgtcccacgctacggttacgaggcggctaggtggttcgtggactactacttccaacttccaccgacctacgtccacgtaccgtacgtccgtagctacgtcccggtaggtacgttaacgttttccggaccgtttacttaacttaccgtacgtaaccctaaactttaactttacttttaaccgtttttttaccgtaccgttttaccgtttaacggttttccggtaaccgggtaacggggttaaacccgtaacgggttacgggttaacgggtaaacgttaacgttaacgggtaaaacggtttaacggttacgggttaaggtaccggttacgtaaccgtaccgtaacgttcgtttacccgtttacttacccgttaccttcccttaccccgtactacgttaccttacgtacttaacgtctttaaccgtcgttaccgtcgacgggtaccggttacggacggtaccggtacgacgtacgtag

SEQ ID NO: 289249 - DNA, 644 bp, Homo sapiens
  misc_feature: GYAE6OF02G7DQZ.44.75.G09.1.454.CMB.1.raw
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (370)..(370): a, c, t, g, unknown or other
  misc_feature (370)..(370): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggttcagcaggagcctggcaaacgcccctaagtccctgattcttttcnggatccactttgaagngtggagtcccagccaggttcagcgcagtggtctgggacacatttcactctcaccatcagcagctgcagcctggatatttcgcgtacttattactgaccaaanaatatttctttttactccgttactagttttcggaccgtagggggaccctaaaggccgttagggacgtaacgtaacgaaaagggtaacgttaggtacggggtacctacggacctaaccgtattaccgtgtttacctttaccgtaactttcccgtttaccccggtaccttaaccgttccttacggtaactttaacgttaacgttaaccttggttaccgttacgggtacggtccggggtaccgttagggacccgtaaacggggtccgtacgtaacgg

SEQ ID NO: 289250 - DNA, 666 bp, Homo sapiens
  misc_feature: GYAE6OF02FH649.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaacgcccctaagtccctgattcttttctggactccactttgaagagtggagtcccagccaggttcagcggcaggtgttctgggacactatttcactctcaccatcagcagcctgcagccgtggagtctttcgcgtacttaacttactcgaccctaaactaattactttacctttttttaacttcccgttaacttaggtttttcgggacccgtacgggggtaaccctaaaggccgtagggaacgtaacgttaacgaaaagggtaaacgttggttacggtccttacggacctaacccgtaagttccgtttacgttcctttacgtacctttcccttccccgtcctaacgttccttacgtaactattaaccgttaccgttacggttccttacggtacgggtccgggtaccggttacgggaccgtaaccggggtccgacggtaacg

SEQ ID NO: 289251 - DNA, 516 bp, Homo sapiens
  misc_feature: GYAE6OF02G4XBI.44.75.G09.1.454.CMB.1.raw
  modified_base (270)..(270): a, c, t, g, unknown or other
  misc_feature (270)..(270): n is a, c, g, or t
  modified_base (318)..(318): a, c, t, g, unknown or other
  misc_feature (318)..(318): n is a, c, g, or t
  modified_base (345)..(345): a, c, t, g, unknown or other
  misc_feature (345)..(345): n is a, c, g, or t
  modified_base (413)..(413): a, c, t, g, unknown or other
  misc_feature (413)..(413): n is a, c, g, or t
  modified_base (445)..(445): a, c, t, g, unknown or other
  misc_feature (445)..(445): n is a, c, g, or t
  modified_base (463)..(463): a, c, t, g, unknown or other
  misc_feature (463)..(463): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagtcccctaagtccctgattcttttctggattccactttgaagngtggatcccagccagttcagcgcagtggttctgggacacatttcactntcaccatcagcagcctgcagcctaganatttcgcattatatcaccaatatagttcttttactctactaggtttcgacgagggtaccagctagganacgtacaagtacgtgtgctgcactatctcgtnttctattcctccgtaccntcagtactagttatacgtgtcgtagagtacgggtctggacaggacgtactaag

SEQ ID NO: 289252 - DNA, 578 bp, Homo sapiens
  misc_feature: GYAE6OF02FOHUG.44.75.G09.1.454.CMB.1.raw
  modified_base (257)..(257): a, c, t, g, unknown or other
  misc_feature (257)..(257): n is a, c, g, or t
  modified_base (381)..(381): a, c, t, g, unknown or other
  misc_feature (381)..(381): n is a, c, g, or t
  modified_base (503)..(503): a, c, t, g, unknown or other
  misc_feature (503)..(503): n is a, c, g, or t
  modified_base (511)..(511): a, c, t, g, unknown or other
  misc_feature (511)..(511): n is a, c, g, or t
  modified_base (516)..(516): a, c, t, g, unknown or other
  misc_feature (516)..(516): n is a, c, g, or t
  modified_base (529)..(529): a, c, t, g, unknown or other
  misc_feature (529)..(529): n is a, c, g, or t
  modified_base (532)..(532): a, c, t, g, unknown or other
  misc_feature (532)..(532): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgaggtgccgacattaggtacttttttggccttggtttcagcaggagcctggcaaacgcccctaagtccctgacttcttttcnggactcctactttgaagagtggacgtcccagccaggttccaggcggtacaggttggttcgtggggacctacgtacttttcgaccttcctacacctatcagcacgtcctgacgacgtccgtaggngtactttcgacgttaatttacttactcgaacctaaataactttactttcttttttacgtaccttacgttagttttcgggaccgtagggtacctaacggtcgtaggagactacgaagactggngctgcacntcgtntctctactctccnctntctatatactatcgtgtcgtagtcggcggcgtaggcgaggcatacg

SEQ ID NO: 289253 - DNA, 592 bp, Homo sapiens
  misc_feature: GYAE6OF02GIT3B.44.75.G09.1.454.CMB.1.raw
  modified_base (358)..(358): a, c, t, g, unknown or other
  misc_feature (358)..(358): n is a, c, g, or t
  modified_base (482)..(482): a, c, t, g, unknown or other
  misc_feature (482)..(482): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaacgcccctaacgtccctgattcttttctggactccactttgaagagtggactccccagccaggttcagcggcaggtggtctgggacactatttcactctcacctatcagcagcctgccacgccgtggacgtntttcgcgtaactttatactgacccaactaattactttactttttactaccgttactacggttttcggaccgaggggtaccaagtccgtaggaagtagttaacgaaaggtactggtacgcgtacncacctattcgtcgttccttctacttcccttacccgactacgttcgtacgtacttagttaacttacttgtaccgttggaccgtcgggccgtaggacgaacggtcgactacg

SEQ ID NO: 289254 - DNA, 848 bp, Homo sapiens
  misc_feature: GYAE6OF02JP01A.44.75.G09.1.454.CMB.1.raw
  modified_base (121)..(121): a, c, t, g, unknown or other
  misc_feature (121)..(121): n is a, c, g, or t
tcagacagtatatacacgaccggtgctcgatttagtatagacatcagggaggaatcagacccagtcaggacacagcatggacatgagagtcctcgctcagctcctggggctcctgctgctntcgtttcccggtgccaggtgtgacatcgagactgacccagtctccgtctcactgtctgcgtctagttcgggacacgagtcaccagtcacgttcgaccgggcgtagtcggaccgacgtagttacggttaccttttttcggacctttggtttactacggtcgtacgggtacgtccgttaggacgtaaccggtccccgttaacggtcccctagtaccttcgtttcgttacggtaaccttcgttacgtttacgtaacgggtacggtcgggtacggtaccgtaccggtacccggttacggttcggaacggtccggacggtacggttttacgggttcggttacggggaaccctacgtacgtttaccgtaacttaccgtaccctaccgtatccgtacgcgaaccgtccggtagtccgaccggttacccgtagggtaaccgttaggttttaccccgtacggtttaaaccgtttacgtttaaaccgtcccggtaaccttaaacgtaaccttttaacgtttttaaccgtttttttacctaacccggttttaacgttttcggttttaacccgggtaccggttaacccggggttaaaccgtaaccggttcgttaacgggtaccgttaacgttaaccgggtaaaccggtaaacggtttggtaccggttaacggttaccgtacggttaacccgttggttaccgtttaccggtttactttaccggttaccctttaaccccgg

SEQ ID NO: 289255 - DNA, 646 bp, Homo sapiens
  misc_feature: GYAE6OF02G9L2C.44.75.G09.1.454.CMB.1.raw
  modified_base (329)..(329): a, c, t, g, unknown or other
  misc_feature (329)..(329): n is a, c, g, or t
  modified_base (350)..(350): a, c, t, g, unknown or other
  misc_feature (350)..(350): n is a, c, g, or t
  modified_base (369)..(369): a, c, t, g, unknown or other
  misc_feature (369)..(369): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggcaaagcccctaagtccctgatcttttctggatccactttgaagtagtggagtccccagtccaggttcaggtcggcagtggttctgggacacattcactctcaccntcatcagcctgcagcctggangtttcgcgtacttattacncgacctaactaattctttaccttttttaataccgttacttaggtttttcggaccgtacggggtaccgtaaggtcgtacggtaaggacttacgaaagggtactaggtacgtcgtacggactaacctaattccgtcgttcgttacgtaccgtttacctttaccccggaccttaccgttaccgttacggtaactttaacgttaacgttaccgttacggttccttagggtaccggtaccggggtacgtaccgggtaacgacggggtaccggtacggtaacg

SEQ ID NO: 289256 - DNA, 717 bp, Homo sapiens
  misc_feature: GYAE6OF02H3AR6.44.75.G09.1.454.CMB.1.raw
  modified_base (712)..(712): a, c, t, g, unknown or other
  misc_feature (712)..(712): n is a, c, g, or t
  modified_base (716)..(716): a, c, t, g, unknown or other
  misc_feature (716)..(716): n is a, c, g, or t
tcagacagtatatacacgaccggtgctcgatttagtatagacatcagggacttaggggctttgccaggctcctgctgctctgtttccccggtgccaggtgtgacatcgagatgacccagtctccttccttctgtcttcttctgttggaggcagcgtcaccatcacttgccgggcgagtcagggttcgttttcggtgcttgttgtccttgggtttacaacggaaaaaggggggacgacggaccccgttaaggtccctcgtcttctcgtacgaaaccagacgtaggaaggtagacggtcccgtccgaggtttcagtcgccagtccgagggtgggtcggggccgtagtcccactcctacacctagttacgccgtaccgtggcccggtacgtggtaaagtctttacgtcgacttaacttttactttccgtacggttctaacggctaacggttatactaagttcggtaccgtacccccggttttactttaccggtttttcgggacccggtaacggggtaacccgaaggttcggtacgggtagaacgtaacggaaacggtacggttaggtggaccttggaccctaccgtacgttcgttcgttccttcgtacctttccccgttcccgacctacgtttcgtcgtaacttaagttaacgttcttccgtcgtcggaacgggtccggtcgttaccggacggtaacggtcggacgtatacggtnagtng

SEQ ID NO: 289257 - DNA, 747 bp, Homo sapiens
  misc_feature: GYAE6OF02JARR0.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatcgacccagtctccgtcctcactgtctgcgtctagttgggacagagtcacatcacttgccgggcgagtcgccgactagttaggtacttttttggccttggtttcaggcaggacgccgtggacaaacgtcccctaagtcccctagtacttcttttcgtggtacttccctaacgtttaggaagtagtacggtacgtcccgagtccgtagggttcacggtcggacgtaggttcgggttacgtacggggtactacttacgtttcgaaccgttcctaccgtaacccgtaatcccgaagtaccgtacgtccgttacggaccgtacggtccgttagggaacgttcgtttcgacgttaacttacgtttacctacggaccctaaaacgtaagtttacttttaccgttttttaacgtccgtttaaaccgtttacgggtttttaccggacccggttaaacggggtaacccttaaggtccgttagggtaaacgtacgttaaacggtaaaacgggttaccgttacgggtacgggttaccgttaccggtaaccgtaccggttaacgtttccgtttacggtttaccctttaccgtaccgtttaccccgg

SEQ ID NO: 289258 - DNA, 605 bp, Homo sapiens
  misc_feature: GYAE6OF02HLSNI.44.75.G09.1.454.CMB.1.raw
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
  modified_base (277)..(277): a, c, t, g, unknown or other
  misc_feature (277)..(277): n is a, c, g, or t
  modified_base (603)..(605): a, c, t, g, unknown or other
  misc_feature (603)..(605): n is a, c, g, or t
tcagacagtatatacacgaccggtgctcgatttagtatagacatcagggacgttaggggctttgccaggctccttggctgcgtctgtttccccggtgccaggtgtgacatcgagatgacccagtctccttccttcctgtcttcgttctgttggaggcagcgtcaccatcacttgccgggcgagtcaggtcgttttcggngctgttgcctggtttcaacgaaaaagggggnaggcccctaaggtcctcgtctctcgtagaaaccagactggaaggtanagtccccgtccaggttcagtgccagtccagggtggtgggccggatccactctcaccattagcgacctgcggcctgaagattctgctaaactttatttctgtctagcctaagtatcaagttagtcgtcccccgtttgtaaccttttggcccgtaaggggaccaaagcgtaggaaataacaaaaacgtacttacggtggacttacggaccaacctactactctacttctacttccgttccccgcctactcctgtactaactaacttacgttcgtacttaggacggcggtccggtagggacgtaacggccgaacgtaacgtggactagnnn

SEQ ID NO: 289259 - DNA, 705 bp, Homo sapiens
  misc_feature: GYAE6OF02J04P9.44.75.G09.1.454.CMB.1.raw
  modified_base (312)..(312): a, c, t, g, unknown or other
  misc_feature (312)..(312): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggcttttttggccttggtttcagcaggagcctggcaaagcccctaagtcccctgattcttttctggacttccactttgaagagttgggatcccagccgtaggttcagcggccaggtggttcgngggaccagattttcacgtctcaccatcagcagccctggcctagccctggtacagtttccggactactttagtactaccgacctaactaattatttcgtttttaacctcgttacttagttttcggtaccgtacgggtaccgtaagtacgtcggtaggaaccgttacgaaacgggttaaccgtagggttacgggtccgttacggaacccgttaaccgtaaccggttaccttcgttttacccgttaccttaactttcccccggtttccccgttaaccgtactttaaccttggtaaacctttacgttaaccttacgtttaacggttaccggttcgttaaccgggggtcgttaccggtaaccgggtaccggtaacccgggttaccgaccgtttaacgg

SEQ ID NO: 289260 - DNA, 653 bp, Homo sapiens
  misc_feature: GYAE6OF02H9167.44.75.G09.1.454.CMB.1.raw
  modified_base (257)..(257): a, c, t, g, unknown or other
  misc_feature (257)..(257): n is a, c, g, or t
  modified_base (305)..(305): a, c, t, g, unknown or other
  misc_feature (305)..(305): n is a, c, g, or t
  modified_base (338)..(338): a, c, t, g, unknown or other
  misc_feature (338)..(338): n is a, c, g, or t
  modified_base (348)..(348): a, c, t, g, unknown or other
  misc_feature (348)..(348): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggacgcctggcaaagcccctaagtcccctgacttctttcgnggactcctactttgaagagtggacgtccccagccctaggttcagcggnaggtggttcgtgggactactattttccacttcnccaccatcanccagcctgcacgccgtagggactatttcggacgtactttatacgtcgacctaaactaattactttactttttttaactcccggtttaacttaggttttcggaccgggtacggggtaacctaaggaccgttagggagtaacgtaacgtaaaacgggtaaccgttgggttacgggctacggacctaaccgtattcccgtttacgttcttacccgtacgtttcccctacccgtcctacgttcgtagttactacgttacttaccgtgttcgaggtacggcggtcggtcgggtaccgaaggtccgatacg

SEQ ID NO: 289261 - DNA, 844 bp, Homo sapiens
  misc_feature: GYAE6OF02HTOAU.44.75.G09.1.454.CMB.1.raw
  modified_base (276)..(276): a, c, t, g, unknown or other
  misc_feature (276)..(276): n is a, c, g, or t
tcagacagtatatacacgaccggtgctcgatttagtatagacatcagggacttaggggctttgccaggctcctgctgctctgtttccccggtgccaggtgtgacatcgagatgaccagtctccgtcctcactgtctgcgtctattggggacagagtcaccatcacttgccgggcgagtgccgacattaggtactttttttggtcttggtttcagcaggagcctggacaaacgccctaagtccctgtatcttttcgtggactcctactttaggaagnggtggacgtccccagccgtaaggttcacggcggctaggttggtttaccgagggaaccaacgtattttccacttcctacaaccctaatccaggaccaacggtcctacgccgaggtacccgtgggtaaagttacgtttttaccccggacggtttaaaccttttaaacgtttacccgtaacggttaaaccccaaaaacctaaaaggtttttactttttaaccgttttttttaaacgttacccggtttaacgttaaccgggtttttttacggggaacccggtaaacgggggtaaaccgtaaaggtaccgttaagggaacgtaacggtaaaccggtaaaaacgggtaacgttacgggtacgggtaccgtaacggacctaacccgtaacggttccgttacggtttacccgtttaaccttacgtttaccccgttaccccggtacccttaacgttaccgttacggtaacgtttaaccttaacgttaaccgttacggttacccgttaagggtaaccgggttaccggggtaaccggttaaccgggtaacggtaaccgggtacggtaaccgttaacggg

SEQ ID NO: 289262 - DNA, 735 bp, Homo sapiens
  misc_feature: GYAE6OF02G2F2E.44.75.G09.1.454.CMB.1.raw
  modified_base (264)..(264): a, c, t, g, unknown or other
  misc_feature (264)..(264): n is a, c, g, or t
  modified_base (320)..(320): a, c, t, g, unknown or other
  misc_feature (320)..(320): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttggccgggcgagtgccgacattaggtacttttttggccttggtttcagcgaggacgccgtggacaaacgcccctaagtccctgtacttcttttcgnggactcctacgtttgaagtagtggacgtccagccaggttcaggcgcgtagtgttcnggactactatttcacttccgtcaaccatcagtacacgtcctggacagccgttaggacgttatttccggacgtactttaaattaccgacggtaaccctaaagttaacttttagttttacccttttttaacgtacccgtttaacgtttacggtttttaccgggaccggtaaacggggtaaccgtaaacggtccgtagggtaacgtaacggttaacgtaaaacggggtacgttacggttacggtacgtaccgtaccgtaaccttacgttaccgttacggttaccttacgttaccgttcccgttacccggtaacccttacttacccgttacgtaatttaacgttaacttaaccggttcggttacctagggtaacggtccgggttacggtaccggtacgggaccgttacggacctaaagg

SEQ ID NO: 289263 - DNA, 525 bp, Homo sapiens
  misc_feature: GYAE6OF02GHCUK.44.75.G09.1.454.CMB.1.raw
  modified_base (272)..(272): a, c, t, g, unknown or other
  misc_feature (272)..(272): n is a, c, g, or t
  modified_base (357)..(357): a, c, t, g, unknown or other
  misc_feature (357)..(357): n is a, c, g, or t
  modified_base (376)..(376): a, c, t, g, unknown or other
  misc_feature (376)..(376): n is a, c, g, or t
  modified_base (427)..(427): a, c, t, g, unknown or other
  misc_feature (427)..(427): n is a, c, g, or t
  modified_base (441)..(441): a, c, t, g, unknown or other
  misc_feature (441)..(441): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacatttaggactttttttggccttggtttcagcagggagcctggcaaagccccctaagtccctgatcttttctggatccactttgaagngtggagtcccagccaggttcagcggcagttggttctgggacactatttccacttctccaccatccagcagcctgcagcctgggantttcgcgtactttattacngaccaaactattattctttttatccgtatgttttggcagggacagcgtganatacaagactgtgntgcacatctgtacttcactctcccgtcatctgatatatacttcgtacgtgacggtcgggtacgtcgggacgaacggtcgatacg

SEQ ID NO: 289264 - DNA, 533 bp, Homo sapiens
  misc_feature: GYAE6OF02IOA66.44.75.G09.1.454.CMB.1.raw
  modified_base (274)..(274): a, c, t, g, unknown or other
  misc_feature (274)..(274): n is a, c, g, or t
  modified_base (334)..(334): a, c, t, g, unknown or other
  misc_feature (334)..(334): n is a, c, g, or t
  modified_base (453)..(453): a, c, t, g, unknown or other
  misc_feature (453)..(453): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgccgacattaggtacttttttggccttggtttcagcaggagcctggcaacgcccctaagtccctgacttcttttctggtactccactttgaagngtgagtcccagccaggttcagcggcaggttggttctcgggacactatttcactctcaccntcagcagcctgctagtctagaagtattttgacttagtttatactgtacagtctagtataatgactgtcctccgtcgacgacggcacgatggagaattaaacgacgtgtgctacgcaccntcgtcgtcttcgacttcctcccgctatctagattatacttacgtcgtcttaggaccggtcggtcgtcgggacaggtcacg

SEQ ID NO: 289265 - DNA, 568 bp, Homo sapiens
  misc_feature: GYAE6OF02H6GVF.44.75.G09.1.454.CMB.1.raw
  modified_base (182)..(182): a, c, t, g, unknown or other
  misc_feature (182)..(182): n is a, c, g, or t
  modified_base (221)..(221): a, c, t, g, unknown or other
  misc_feature (221)..(221): n is a, c, g, or t
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
  modified_base (302)..(302): a, c, t, g, unknown or other
  misc_feature (302)..(302): n is a, c, g, or t
  modified_base (355)..(355): a, c, t, g, unknown or other
  misc_feature (355)..(355): n is a, c, g, or t
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
  modified_base (410)..(410): a, c, t, g, unknown or other
  misc_feature (410)..(410): n is a, c, g, or t
tcagacagtatatacacgaccggtgctcgatttagtatagacatcagggacttaggggctttgcccaggctcctgctgctctgtttccccggtcgccaggtgtcgaccaagtcgagatcgacccagtctccgtcctcactgtctgcgtctattggggacagagtcaccatcacttgccgggngagtgcccgagattaggactttttggctggttcagcagnctaggnaaacgtcccaagccctgatcttttnacggntccgaatttggaaagtcgtagggactacccagtccgaggttaccnggaccggcaggttggtccgtggacacagtttcactactctaccgatacagtcncggtacctgcacggctgggaattnttccgganactttaatactcgacaaacactntttacttttacgtacctatacgtttacggctaggggtacaacggctaggagaattagaaagtacgtagttacgcgtagcgtacgacagtcgttctactctcctactccgatctcagtataactctagtctgacgtcggctggaccgtagaccgctaag

SEQ ID NO: 289266 - DNA, 770 bp, Homo sapiens
  misc_feature: GYAE6OF02I1A8K.44.75.G09.1.454.CMB.1.raw
  modified_base (259)..(259): a, c, t, g, unknown or other
  misc_feature (259)..(259): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacatttaggacttttttggccttggtttcagcagggagccgtggcaaacgcccctaagtccctgacttcttttcgnggactcctactttagaagagtggacgtcccagccaggttcaggcggcgagttggttctgggactactattcactctcaccatcagtcacgtcctcgccacgtccgtagggtactacgttttccggacgttaacctttaagttaccgtacggaccctaaaacttaaacgttttacttttaccgttttttttaaccgtaacccggtttaacgtttaacggttttttaccgggggaacccgggttaaacgggggttaacccggtaaacgggttccggtaaggggtaaacgtaacggttaaaccggaaaacgggttaaacggttacgggttacgggtaccgttacgggtacccgtaaccgttaacgtttaccgttccgtttaccgtttacctacctttcccgttaccccgtaccgttaacttccgtacgtaacgtttaacttaacgttaccttacggttactccgggtaggtcccgggttcggtacgggtaccggtacgggtaccgtacgtaacg

SEQ ID NO: 289267 - DNA, 727 bp, Homo sapiens
  misc_feature: GYAE6OF02ISXPI.44.75.G09.1.454.CMB.1.raw
  modified_base (696)..(696): a, c, t, g, unknown or other
  misc_feature (696)..(696): n is a, c, g, or t
tcagacagtatatacacgaccggtgctcgatttagtatagacatcaggggaggaatcagacccagtcaggacacagcatggacatgagagtcctcgctcagctcctgggctcctgctgctctgttccccggtgccaggtgtgacatcgagatgacccagtctccgtcctcactgtctgctctagttggggacagagtcaccatcacttgccgggcgagtgcccgatattaggtacctttttggccgttggtttcacgctaggacgccgtggaccaaagccccctaagtcccctgtagttccttttctggtacttccctacgttttagaacgtggtacgggtacgtaccccgagtcccgtaacggttcacggtcggaccgtacggttcggttccgtcgggaactacgttactttacctaccttccttacccgaacccttagtacccgaacgtacccgtacgtccccgttagacccgtaacggacccgttggggtaaaccgtccgttttaccgaaccggttaacctttacgttaaccgtccggaacctaaacttaacgtttactttaccgttttttacgtacccgtttacgttaacgggttttcggtaaccggtacccggggtaaacctaacgtccgttacgggtaacgtaggttaccgaaaggtaaccggttacgtaggtaccgtcgtacgtaaccncgtttactcgttaccttcggtacttaccccg

SEQ ID NO: 289268 - DNA, 658 bp, Homo sapiens
  misc_feature: GYAE6OF02HASW3.44.75.G09.1.454.CMB.1.raw
  modified_base (259)..(259): a, c, t, g, unknown or other
  misc_feature (259)..(259): n is a, c, g, or t
  modified_base (315)..(315): a, c, t, g, unknown or other
  misc_feature (315)..(315): n is a, c, g, or t
  modified_base (364)..(364): a, c, t, g, unknown or other
  misc_feature (364)..(364): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgttctagttggggacagagtcaccatcacttgccgggcgagtgccgacattaggtacttttttggccttggtttcagcaggagcctggacaaacgcccctaagtccctgacttcttttcnggactcctactttgaagagtggacgtcccagccaggttcaggccgcgagtggttcnggggacactagtttcacgttcacaccatcagcagtcctgcagcctaggntactttcgcgttaactttagtacctcgaaccaaactaattattttacctttttacaccgttacttacgttttacggtaccgtacgggaaaccgtaacgcgtacggaggtaactaacggaaacggtaacgttaggtacgtacgtccggtacaaccgtacttacgttcttaccgttacttacgttccctttacccgacccgttactacgttaccgtaattaaccgttacgttaacgttcgttagtacggtacggtaccgggtcgtagggttacccggaacggtccggtaccgaagg

SEQ ID NO: 289269 - DNA, 685 bp, Homo sapiens
  misc_feature: GYAE6OF02G2X8K.44.75.G09.1.454.CMB.1.raw
  modified_base (256)..(256): a, c, t, g, unknown or other
  misc_feature (256)..(256): n is a, c, g, or t
  modified_base (348)..(348): a, c, t, g, unknown or other
  misc_feature (348)..(348): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggacaaacgcccctaagtccctgacttcttttcnggactccactttgaagagtggacgtcccagccaggttcaggcggcaggtggttctgggactacgatttcactctcaccatcagcagcctgcncgccgtggagtactttcgcgtaactttattacgtcgaccctaaactaatttactttcttttttaactacccgtttacttacggtttttacgggacccgtaacgggggtacctaaacggtcggtacgggtaacgtacgttaaccgaaaacgggttaccttgggtacggtaccgtcggaccctaacccgtaagttccgttacgttaccgttttacctacgtttccccgttccccgtacctaacgttccgttacgttaactttaagttaaccttaacgtttcggttccgtaggtaacggtccggggtcgttacgggacggaacgggtccgaacgtaacgg

SEQ ID NO: 289270 - DNA, 724 bp, Homo sapiens
  misc_feature: GYAE6OF02HE9TX.44.75.G09.1.454.CMB.1.raw
  modified_base (358)..(358): a, c, t, g, unknown or other
  misc_feature (358)..(358): n is a, c, g, or t
  modified_base (389)..(389): a, c, t, g, unknown or other
  misc_feature (389)..(389): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttcggccgggcgagtcgccgactagttaggttacttttttcggccgttggtttcaggcgaggacgtccgtcggaccaaaccgtccccctaacgttccccgtagtacttttcttttcgtcggtacttcctacgtttaggaagtaggtcgacgtcccagccgtaggttcacggcggtctaggttcgggttcgngggacctacttgtttccactccgacctaccnttacagccgacgccgtgcacgtccgtaggtacgtacgtttccgcgttaactttacttaccgtacgtaccctaaactattttaccttttacttttttaccgttaccgttacgttttacggttttccggtaccgggtaacgggaaccgtaacggaccgtaggaacgtaacggtaacggtaaacggtactagggtcgtcgtcgtacctactacgttcgttacgtcttcctacgtttcccctccgtacctacgttacgtacgttaacttacgttaacgttaccgttggttcgtaccggtcggtacggtccggtaacgggtacgacgggtacacgtacgg

SEQ ID NO: 289271 - DNA, 638 bp, Homo sapiens
  misc_feature: GYAE6OF02IQJJQ.44.75.G09.1.454.CMB.1.raw
  modified_base (353)..(353): a, c, t, g, unknown or other
  misc_feature (353)..(353): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggactccactttgaagagtcggagtccccagccaggttcagcggcaggtggttcgtgggacacatttccactctacaccatcagcagcctgcagcctggagtntttcgcgtaactttagtactgaacccaaactaattagtttacctttttttatacccgttaactagtttttcgggacccgtaagggggtaacccaaaggtacgtacggtagaaaccttacgaaaacggtaacttcggtacgggtaccttacgaccgaacccttaattaccgttgttaccttacgaccttcccgttacccgacctattcccgtagtaactaacttaacttaacgtcgttactacggtaaggtccggacggttcggacggtaacggacgtaccgtaag

SEQ ID NO: 289272 - DNA, 661 bp, Homo sapiens
  misc_feature: GYAE6OF02HT4ZF.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcccttggtttcagcaggacgcccggcaaacgcccctaagtcccctgattcttttctggactcctactttgaagagtaggacgtcccgagccgtaggttcaggcggctaggttcggtttcgtaggggactacgtattttcaccttcctaccaccatcaagcagtcctgacacgccgtggacgttacttcgacgtactttactactgaacccaacaattacttttctttttaactccgttactttaggttttcgaccggtaacgggtaaccaaggtctagggacgtagtaacggaaaggtaccgtggttcggactcgtaccacctacttcgtcgttcttacgtacttccgttcccgacctacgttcgtacgttattacgttacgttaaccgttcgttaccgtacggtaccggttcggggtacgttacggggtaaccggacgggtaccgtaccgtagtacgg

SEQ ID NO: 289273 - DNA, 668 bp, Homo sapiens
  misc_feature: GYAE6OF02I882A.44.75.G09.1.454.CMB.1.raw
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
  modified_base (351)..(351): a, c, t, g, unknown or other
  misc_feature (351)..(351): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaacgcccctaagtcccctgacttcttttctggacttcctactttgaagtagtggtacgcccgagccgtaggttcagccggctaggttcggttcgtcggacactattcactctcaccntacngacncgctcgacgacgcgtaggtacgtatttccgactacttacgttacctacgtaccaaactaatttacttttactttttaacgtacccgttaacttggttttaccggaccggtaacggggtaaccacggtcgtacgggagtaacgtaacgtaaacgggtacgttcgtacggtactcgacctaaccgtacttcgtttacgttcctttacaccgtttccccttaccccgtacctatttcccgtatacttaacgttacgttaacttcggtaccgttggaccggggtccggtcgtacgggaccggtaacggtcctaagtaacgg

SEQ ID NO: 289274 - DNA, 601 bp, Homo sapiens
  misc_feature: GYAE6OF02IL7L1.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaacgcccctaagtcccctgtacttcttttctggtactcctactttgaagagtggacgtccagccaggttcaggcggctaggtggttctggggacatatttccactctcaccatcacgcagcctgccagcctaggagtatttcgcgtacttatactacgaccaaactaattactttacttttttactaccggtttaacttaggttttcggaccgtaggggtaacctaaggcgtaggagtaacgtacgtaaacggacgtagtggctcgctacctactctcgttcttctcttcctcccgacctactctagtattacgtacttacgttacgttcgtacgtagggtccggtcggtacggtacggtaacggccgtataacgg

SEQ ID NO: 289275 - DNA, 556 bp, Homo sapiens
  misc_feature: GYAE6OF02HZ6UB.44.75.G09.1.454.CMB.1.raw
  modified_base (251)..(251): a, c, t, g, unknown or other
  misc_feature (251)..(251): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccacttttgagagtggagtccccagccaggttcagcggcagtggttctggggacactatttcactcctcaccatcagcacgcctgcacgcctggagtatttcggcgtaacttacttactgaccctaaactaatttacgtttacttttttactacccgttactaggtttttcggccgtaggggacctaagtcgtaggatagtacgaaaggaactggtgctcgacaccgtatctgtctcacttcctcccgctactctgtatatacttactcgtctgaggcggtcgtggacgacggcgacgtag

SEQ ID NO: 289276 - DNA, 669 bp, Homo sapiens
  misc_feature: GYAE6OF02IZM1C.44.75.G09.1.454.CMB.1.raw
  modified_base (313)..(313): a, c, t, g, unknown or other
  misc_feature (313)..(313): n is a, c, g, or t
  modified_base (330)..(330): a, c, t, g, unknown or other
  misc_feature (330)..(330): n is a, c, g, or t
tcagacagtatatacacgaccggtgctcgatttagtatagacatcaggggacttaggggctttgccaggctcctgctgctctcgtttccccggtgccaggtgtgacatcgagatgacccagtctccgtcctcactgtctgcgtctattggggacagagtcaccatcacttgccggcgagtgccgacattacggtacttttttggcctggtttcagcaggagcctggacaaacgcccctaagtccctgacttcttttcgcggatccacttttgaagagtggagtcccagcctaggttcaggtcgcgagtgttcnggacactattccactcncaccatcagcagccgtgacacgcctggacgtagtttcgaccgtactttacttaccgtcgaccctaaacgtaactttacgttttacctttttttaacgtaccccgtttaagtttaacggtttttcgggacccgttaaacggggtaaccctaaaggtccgtaagggtaactaagttacgaaaaggtacgtggtacgcgtacggtccacgtacgttctacgtttccgtcgtaacgttcccgttcccgaccgttaacttcgttagtaacttaagttaacttacgttagttaccttaggacggttccggtacggtcgggaaccgtaacgggtccgtaaccgtag

SEQ ID NO: 289277 - DNA, 679 bp, Homo sapiens
  misc_feature: GYAE6OF02GPZU5.44.75.G09.1.454.CMB.1.raw
  modified_base (258)..(258): a, c, t, g, unknown or other
  misc_feature (258)..(258): n is a, c, g, or t
  modified_base (315)..(315): a, c, t, g, unknown or other
  misc_feature (315)..(315): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagccgtggacaaacgcccctaagtccctgattcttttcgnggactcctactttgaagtagtggagtcccaagcctaggttcaggcgcagtggttcgnggacactatttcacttctcactatcagcacgtcctggacacggcctaggagtatttcgcgtactttattacgtacgacccaaataactttacgttttacttttttacgtacccgtttaacgttacggtttttacgggaccggtaacggggtaaccgtacggtacgtagggtaacgtaactaaccggtaaaagggtaaccgttgggttacggtaccttacggaccctacgtaaccttcgttcgtttaccttctaacctttcccgtaccccgtactacgttaccgttagttaacttacttacgttaacttcggttacgttacggaacgggtccggtaggttcggggacgtacgggtaccagtaacg

SEQ ID NO: 289278 - DNA, 540 bp, Homo sapiens
  misc_feature: GYAE6OF02ISWKD.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtcagggcattagcaattatttagcctggtatcagcagaaaccagggaaagctcctaagctcctgatctatgaaacatccatttgcaatcaggggtccatctcggtcagcggcagtggatcgtgggacagatttcactctcaccgtcacgcagcctgccagcctagaagatgtgctaactttatacttgtacaaaagtaataacgagtcgccctacacctacgtttccggcccgtagggaccctacgaggtaggtactatcaaggctaacgtgtagctgcctaccacttcgtcttcttctacttccgtttccccgactacttcgtacgtattacgttattacctggttactggacggtccggg

SEQ ID NO: 289279 - DNA, 660 bp, Homo sapiens
  misc_feature: GYAE6OF02FO68Z.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccggcgagtgccgacattaggacttttttggcctggtttcagcaggagcctggacaaacgcccctaagtccctgattcttttctggactcctactttgaagtagtggtagtccccagcctaggttcagcggcagtggttcgtgggactacgtatttcactctcacatcagcacgcctgccgacgccgtggacgtatttcgcgtaactttaactttacgtcgaacccaactaaatttactttactttttttaacgtaccgtttacttaacggtttttcggaccgtaacggggtaccagtacgtaggtagtacgttaacgaaagggtaacgttggtcggtacgtcgacctaacctacgttcgttcgttccttacttaccgttacccttcccgccttagttcccttagtaccgttaacttaacgttacttcggttacgttacggtagggtacccgggttacggtaccgggacggtacggtaccggtactaacgg

SEQ ID NO: 289280 - DNA, 804 bp, Homo sapiens
  misc_feature: GYAE6OF02H6X53.44.75.G09.1.454.CMB.1.raw
  modified_base (253)..(253): a, c, t, g, unknown or other
  misc_feature (253)..(253): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggccttggtttcagcaggagcctggacaagcccctaagtccctagattcttttntggactccacttttgaagagtggagtcccagccaggttcagcggcagtggttctgggacacgattttcactctcaccatcagtcagtcctgcacgcctggacgtagttttccgacgtaactttacgttactacggaccctaaaacaacttttacgtttacttttttttaacgtaccccgtttaacgttaacgggttttttacgggacccggttaaacgggggtaaaccctaagggtacccggttagggtaaaggttaacgtaaaccgttaaaaggggtaaaccgttgggttacgggtaccgttacggacccgtaaaccccgtacgttacccgtttcggtttacccgttttaccgttaaccgtttaccccgtttacccccggtaacccgttaaccgtttcccgtttaagttaacgtttaaacgtttaaccgttttaacccgttttacgggtttacccgtttaaccggggtaccggggttaccccgggggtaaccggttccggggttaaaaccccggggttaacggggtaaccccggtacgttaaaaccgggg

SEQ ID NO: 289281 - DNA, 696 bp, Homo sapiens
  misc_feature: GYAE6OF02ISUS2.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctgtttcccccggtgccgaggtgtcgactatcgagatcgaccctagtcctccgtcctctactgtctgccgtctagttggggacagtagtccaccatcacgttcggccgggacgagtcgagggcattagactaattagtttacgccttaggtactcgagacaagaaaccgagggaaagcctactaacgtctcctagtatctaatacgaaacctacgtaccttatttacgtactaacgtaccggtaccgggttaccctgttccgttacggttaccgaggccggtagtaggtacggtactcgggtaacgggtaactacgtaacttaccaacgtttccaccgtaacctataccgacgtacctaccgcgtcgacgtaccgtccgtaagttacgtttacgttaacgtttactaccgttaatttaaccgtttaccacgaacccttaaagttaattaaacgttaacgttacgtttaactttctaacggttagtttaccggttcgggacggtaacggaaccgcgttacggaaggtaacgtaacgtaaccgaacggttaacgttcggtcggttacaccgtacccg

SEQ ID NO: 289282 - DNA, 685 bp, Homo sapiens
  misc_feature: GYAE6OF02IEEHU.44.75.G09.1.454.CMB.1.raw
  modified_base (251)..(251): a, c, t, g, unknown or other
  misc_feature (251)..(251): n is a, c, g, or t
tcagacagtatatacacgaccggtgctcgatttagtatagacatcagggacttagggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgattcttttcnggatccatttgaagagtggactcccagccaggttcagcggcagttggttcgtgggactactatttcaccttctaccacctatcgaacgccacgtccctagaccgacggccgttagggagttacgtttccggacgttaactttacttaactcgaaccctaaactaattttacttttacctttttttaacgtcccgtttaacgttacgggtttttcgggacccggttaacggggtaaccctaaggtccggtagggaagtaacgttaacgtaaaacggtacgttggacggtactacgaccacctacttcgttcgttactttccaccgttcccttccccgaccttacttacgttacaactttacgtaacgttaaccgttcgttcggttacggtaccgggtcgggacgtacgggaccggtaacggtccgtacgtaacgg

SEQ ID NO: 289283 - DNA, 718 bp, Homo sapiens
  misc_feature: GYAE6OF02JE74E.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgcgggcccgagtgccgacattaggtacttttttggccttggtttcagcaggagcctggcaaaacgcccctaaacgtccctgattcttttctggactcctactttgaagagtggagtccccagcctaggttcagtcggcaggtggttctgggacatatttcactcctcaccatcagctagcctgcagccgtggacgtatttcgacgtactttatactcgaccaactaattatttccttttttaacgtcccgtttaacgttacgtttttcgggaccctaacgggggtaacctaaggtacggttacggacgtaacgttaacgaaaacgggtaacgtggtaacggtcggtcgaccgtaacccgtatttaccgttcggtttacccgttttaccttaaccgtttccccgttttacccccggaccgttaacctttccggttaggttaacctttaaaggttaacccgttttaaaccgttcggtttaccgttacggtaacggggtcccgggggttacggtacgggttacccgggaaaggggtcccgtaacgttaacggg

SEQ ID NO: 289284 - DNA, 770 bp, Homo sapiens
  misc_feature: GYAE6OF02IW1J8.44.75.G09.1.454.CMB.1.raw
  modified_base (251)..(251): a, c, t, g, unknown or other
  misc_feature (251)..(251): n is a, c, g, or t
tcagacagtatatacacgaccggtgctcgatttagtatagacatcaggggaggaatcagacccagtcaggacacagcatggacatgagagtcctcgctcagctcctggggctcctgctgctcgtggcctcccaggttcgagattgtgacatcgagatcgacccagtctccttccttcctgtcttcttctggttggagcagcgtcacctatcacgttcggccgggcgtagtcgtagggtttccgttttcggngtcttgttcgtccgtttggtttacgaaaacggtaaaaagggggcgaccggtaccccgtaaggttccctcgtcttcgtcgtacgaaccgagacgtaggaaggtacgacgttcccgtcgtacggttcagtcgcctacgtccgaggtcggtcgggaccggactccgacttccactaaccgtagttacgccgtaccgtcggtacccgtacgtaggaacgttacttaccgtcggtaaccttaacgttttacgtttacgttacggttaccgacgtacgttaacgttacgttacccgttaagtttacccggttcccgttaccccgtttacgtttaccggtttttaccgggacccggttaaccggggtaacccgtaacggttaaccgttaaacgtaaaaccgtaaccggaaaaccgttaacggttacggttacggtacggtaccgtaacccttaaccgttactttacccgtttacgttaccgtttaccgttaacccgtttccccgtacccggtaccttacgttaccg

SEQ ID NO: 289285 - DNA, 570 bp, Homo sapiens
  misc_feature: GYAE6OF02GOGHG.44.75.G09.1.454.CMB.1.raw
  modified_base (252)..(252): a, c, t, g, unknown or other
  misc_feature (252)..(252): n is a, c, g, or t
tcagacagtatatacacgaccggtgctcgatttagtatagacatcagggacttaggggctttgccaggctcctgctgctctgtttccccggtgccaggtgtgacatcgagatggacccagtctccgtcctcactgtctgcgtctattggggacagagtcaccatcacttgccgggcgagtgccgacattaggacttttttggcctggtttcagcaggagcctggcaaagcccctaagtccctgatcttttcnggatcctactttgaagagtggagtcccagccaggttcagcggcagtggttctgggacactatttcactctcaccatcagcagcctgcagcctggagtatttcgacgtacttattactgacccaataatactttctttttatccgtactagttttcggccgtaggggacctaagtcgtaggagatacgaaaggtacgttgtacggactcggaccacctattcgtcgtccttctacgttccttcccgacctatccgttgacttagtacttaaccgttgttctaggacggtcgggtacgttgggaccgaggtccgatacgg

SEQ ID NO: 289286 - DNA, 711 bp, Homo sapiens
  misc_feature: GYAE6OF02GDLZS.44.75.G09.1.454.CMB.1.raw
  modified_base (254)..(254): a, c, t, g, unknown or other
  misc_feature (254)..(254): n is a, c, g, or t
  modified_base (299)..(299): a, c, t, g, unknown or other
  misc_feature (299)..(299): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggacaaagcccctaagtccctgattcttttcnggactcctactttgaagagtggacgtcccagccaggttcagcggntagtggttcgtgggacactatttcactctcaccatcagcagcctgcagccgtaggacgtacgtttcgacgttacttaattacgtcgtaacccaaacgtaatttactttacctttttttaacgtacccgtttaacgtttacggtttttacgggcccggttaaacgggggtaaaccctaaagggtaccgttaagggaacgtaacgttaaaccggaaaacgggttaacgttacgggttacggaccgttcggaaccctaccgtacgttaccgttcgttccgtttaccgtactttaccccggttaccccgtaccgtacgttacccgttacgtaactttaacgttaacttacgttacggttacgttacgggacggttaccggggacttaccgggacgtaacgggtaccgacggtaacg

SEQ ID NO: 289287 - DNA, 736 bp, Homo sapiens
  misc_feature: GYAE6OF02J14K0.44.75.G09.1.454.CMB.1.raw
  modified_base (196)..(196): a, c, t, g, unknown or other
  misc_feature (196)..(196): n is a, c, g, or t
  modified_base (230)..(230): a, c, t, g, unknown or other
  misc_feature (230)..(230): n is a, c, g, or t
  modified_base (395)..(395): a, c, t, g, unknown or other
  misc_feature (395)..(395): n is a, c, g, or t
  modified_base (411)..(411): a, c, t, g, unknown or other
  misc_feature (411)..(411): n is a, c, g, or t
tcagacagtatatacacgaccggtgctcgatttagtatagacatcagggacttaggggctttgccaggctcctgctgctctgtttccccggtgccaggtgtgacatcgagatgacccagtctccttccttcctgtcttcttctgttggaggcagcgtcaccatcacgttgccgggcgagtcaggttcgttttcggngcttgtgccgtggtttacaaacgaaaaagggggnacggcccgtaaggtccgtacgtctctcggtagaaaccagtacgtagggaagtagacgtcccgtacaggttccagtcgccgagtcccgagggtcgggtcgggaccgtacgtaccccgttcaccacctagttacgccgaacctcggccggtctaagaagttcgttcncggtacctaacgtttntttccgacgttccagtacgtaagttactacgtaaacgtggttccccgggttacccctttccgttaacgtttttccgggacccggtaacggggtacccgaaagggttccgtaaacggtaaaacgttaacgaaaaccggtaacgttcgggtacggtcgtaccgtaccgtaaccgtacgtacttcggttacccttcctacgttacccctacccgtccctaacgttcgtacgtaactttactacgttacgttacgttacacgggtcggtccgggtacgtacggtaaccggacggttaccgagttaacggtaccgtcggagacgtcgtag

SEQ ID NO: 289288 - DNA, 721 bp, Homo sapiens
  misc_feature: GYAE6OF02I7TWT.44.75.G09.1.454.CMB.1.raw
  modified_base (340)..(340): a, c, t, g, unknown or other
  misc_feature (340)..(340): n is a, c, g, or t
  modified_base (360)..(360): a, c, t, g, unknown or other
  misc_feature (360)..(360): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacagttaggtacttttttggccttggtttcagcaggacgcctggacaaacgcccctaagtccctagtactttcttttcgtggtactcctactttaggaagagtggtacgtcccagtccgtaggttcaaggcggtacaggttggtcgtgggacacgtntttacactctccaccatcgngaccacgtcctgaccgacgtccgtaggtaacgtattttccgacggtaactttataactcgaacccaaagtaaactttactttacgttttttaactaccggttactttaggttttccggaccggtaacggggtaacctaacggtacgtagggtaacgtaacgtaacgaaaacggttacgttacgggtacggtacctaccggtaccaaccgttacgttctttaccggttcctttaccgtaccgttacccgttacccgtaccgtaacctaccttacggttaataaccgttactttaacgtccgggttaacgtacggtacgggttcgggtaccgtacgggtaacggaaccgggccgtagtaacgg

SEQ ID NO: 289289 - DNA, 549 bp, Homo sapiens
  misc_feature: GYAE6OF02IDM0K.44.75.G09.1.454.CMB.1.raw
  modified_base (251)..(251): a, c, t, g, unknown or other
  misc_feature (251)..(251): n is a, c, g, or t
  modified_base (311)..(311): a, c, t, g, unknown or other
  misc_feature (311)..(311): n is a, c, g, or t
  modified_base (514)..(514): a, c, t, g, unknown or other
  misc_feature (514)..(514): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccacttttgaagtagtggagtcccagccaggttcagcggcagtggttctgggacanatttcactctcaccatcagcagcctgcacgcctggagtattttcgcgtactttatactgacccaaataattactttactttttttatacccgttaacttacggtttttcggaccgtaggggtaaccaaggctagggtagaagttacgaaaaggactggtggctgacacctatctgtcttctacttcctccgcatctagatatntactgtctgagcggtctcggacgaaggtcgatacg

SEQ ID NO: 289290 - DNA, 880 bp, Homo sapiens
  misc_feature: GYAE6OF02H6CML.44.75.G09.1.454.CMB.1.raw
  modified_base (288)..(288): a, c, t, g, unknown or other
  misc_feature (288)..(288): n is a, c, g, or t
tcagacagtatatacacgaccggtgctcgatttagtatagacatcagggacttaggggctttgcccaggctcctgctgctcttcgtttccccggtgccaggtgtgacatcgagatcgacccagtcctccgtcctcactgtctgcgtcttagttggggacagagtcaccatcacttcggccgggcgagtcgaccgatagtttaggttactttttttggccgttggtttcagacgagggacgccgtcggaccaaaccgtccccttaacgtccctagtactttcttttcgnggtacttacctacgttttaggaaggtaggtacggtacgtaccccaggccgtagggtttacacgggtccggtacgtagggttcgggtttcgtacgggactaacttacttttccgaaccttcctaccaacctatccgaaggccacgtcctaggaccacggtccgtagggaacgttacgttttccggacgtttaactttacgtttaacctaccgaacctaaaaccttaagttttaccttttttacctttttttaacgttacccgttttaacgttttacgggtttttccgggaacccgggttaaacggggtaacccgtaacggtcggttacgggaacgttaacgttaacggaaaacgggttacgttcgggttacgggtaccgtaccgaacccgtaccgttaacgttccgtttacgtttcccgtttaccgttacccgttttccccgttaccccgttacccgttacgttaccgttacgttaaccttttaacgttaaccgttttaaccggttcggtttaccggtacgggtaccggggttaccggggttaccggttacccggggtaaccgggtaaccgggttaccgaaccggtttaacgg

SEQ ID NO: 289291 - DNA, 795 bp, Homo sapiens
  misc_feature: GYAE6OF02JHG4N.44.75.G09.1.454.CMB.1.raw
  modified_base (265)..(265): a, c, t, g, unknown or other
  misc_feature (265)..(265): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcacgcgaggacgcctggaccaaaacgcccctaacgtcccctgtacttcttttcnggacttccactttgaaagtggtggactacccagcctaggttccaggccggtctaggttcggttgtacgggactacgtatttccgacttctccaaccctattccgaagccgtacgccgtcgcgtaccgtccgtgggtaacttcgtttacccgcgtttaacttaacttacgtccgaaccaaacttaagttttacttttaccttttttactacccgtttaacgtttacggtttttacgggacccgtaagggggtaaccctaaggtaccggttaggaacggttacgtaaaccgggttaaaacggtaaccgtttcgggtaacgggtttcctaaccggtaccgtaaaccgacgttttaccgtcgtttacccgttacgtttaacccgtttccccgttaaccccgtacgttaccgtttaacggttacgttaacttaaccggtttaaccttaacgtttacggtttacgtcgggtaacccgggttccgggggttaccggtacgggttaacccggaacgggttacccggtattaaaccggg

SEQ ID NO: 289292 - DNA, 681 bp, Homo sapiens
  misc_feature: GYAE6OF02IYXBJ.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggacgcctggcaaacgccctaagtccctgtacttctttcgtgactccactttgaagtagtggacgtcccagtcctaggttcagcggctaggtggttcgtagggactacgtacgtttaccacgttcctccgacctactcgtacgccgtaacgtcctcgactaccggtccgttagggaacgtacgttttaccgacgttaactttacgttactacgaaccaaactaactttaacttttcgtttttacttacccgtttaacgttacggttttaacgggccgtaagggacctaacgtcgtagaacgtagttaaccgaaaggtaacgttcggtcggtactaccgactaccgtacttcgtacgttcgttacgtaccttcccgttacccgtaccgtacttcgtctaacgttataacgtacgttgtaccgtaggtaccggtacggtcggtacggttacggacggtccgataacg

SEQ ID NO: 289293 - DNA, 839 bp, Homo sapiens
  misc_feature: GYAE6OF02JAFAA.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttcgccgggcgagtcgccgacattaggtacttttttggccttggtttcagcgagggacgtccgtggaccaaacgcccctaaggtccctggtactttcttttcgtaggtacttccgtaacgttttgaaaggtaacggtgggtaaccgttcccaacggtacccgtacgggtttaccgaacggtcggaccgtaggttcggggttttaccggtacggggaacctaacttaccttttacaaccgtttcctacctaaccctaagtcctaacggcctaacggtacccttcgaccgtacggtacccgttagggtacggttaacttttccgaacggtacccttttaaagtacctacgtacctaaacttaactttaagttttaccttttttaacgttaccgtttacggtttaacgttttacgggtaaccggtacgggtaaaccggtaacggtcgtaacgggtacgtaagttaaccgtaaacgggtaacgttacggtacgggtacgttacgaccgtaaccgttactaccgtttacgtttaccgtttaccggttacttacccgtttacccggttacccgttaaccttaactttacgttaacgttaacctttaacgttacttacggttaaccgttcggtaacggtcgggttacgttccggaaccggtaacggtccggtaagtacgg

SEQ ID NO: 289294 - DNA, 609 bp, Homo sapiens
  misc_feature: GYAE6OF02INI3H.44.75.G09.1.454.CMB.1.raw
tcagacagtatatacacgaccggtgctcgatttagtatagacatcagggacggttaggggctttgccaggctcctgctgctctgtttccccggtcgccaggtgtgacatcgagatgacccagtctccgtcctcactgtctgcgtctaattggggacagagtcaccatccattcgccggcgagttgccgacaagttaggtacttttttggccttggtttcagcaggagcctggacaaacgcccctaaagtccctgtacttctttactggactcctactttagaaagagtcggacgtccccagccgaggttccaggcgctaggtggttctgggacacacgtttcactcgtacaccatcagcagcctagcagtcctgggagtacgtttcgacgtactttatacgtcgaaccaactaattctttactttttacaccgttaacgtagttttcgaccgagggtaactaggtctaggtatacgttacgtaaaggtaactgtacgcgtacgactaccagttcctagttccttactcgttaccgttccgactagtactagtaaacttcgtaacgtgtacgtcgacggacggtcgtcggtacgtacggtcgactagtac

SEQ ID NO: 289295 - DNA, 720 bp, Homo sapiens
  misc_feature: GYAE6OF02I00DU.44.75.G09.1.454.CMB.1.raw
  modified_base (316)..(316): a, c, t, g, unknown or other
  misc_feature (316)..(316): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttggcctggtttcagcgaggagcctggcaaagcccctaagtccttgatcttttctggactccactttgaacgagtggacgtccccagccaggttcagcggcagttggttctgggacactntttcactctcaccatcagcagcctgcagcctggagtagtttccgcgtaactttattactcggacccaaacgtagttaagtaaacggtagtttaactttcctacgtaaaggttaacggtttttcgggacccggtaacggggggtaaccctaaacgggtacgttaaggggtaggtaacttaaccggtaaaaacccggtaacgtttacgggtacgggtaccgttaggtaccctaacctaaccgttacgtttacggtttcctttaaccttaccgtttacccgtttaccccgttacccgtacgtttaccgttaccggttaaactttaaccgtttaaacttacgttaacggtttccgtacgggtaccgggtaccggggttccggttacgggtcggtaaccgggtaccggg

SEQ ID NO: 289296 - DNA, 501 bp, Homo sapiens
  misc_feature: GYAE6OF02FUONH.44.75.G09.1.454.CMB.1.raw
  modified_base (251)..(251): a, c, t, g, unknown or other
  misc_feature (251)..(251): n is a, c, g, or t
  modified_base (329)..(329): a, c, t, g, unknown or other
  misc_feature (329)..(329): n is a, c, g, or t
  modified_base (363)..(363): a, c, t, g, unknown or other
  misc_feature (363)..(363): n is a, c, g, or t
  modified_base (433)..(433): a, c, t, g, unknown or other
  misc_feature (433)..(433): n is a, c, g, or t
  modified_base (459)..(459): a, c, t, g, unknown or other
  misc_feature (459)..(459): n is a, c, g, or t
  modified_base (466)..(466): a, c, t, g, unknown or other
  misc_feature (466)..(466): n is a, c, g, or t
  modified_base (483)..(483): a, c, t, g, unknown or other
  misc_feature (483)..(483): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttcnggatccactttgaagtagtggagtccagccagttcagcggcagtggtctggacacatttcactctacaccatcagcancctgcagcctggatatttcgacgtacttattacngaccaaataatattcttttttatccgtatagtttggcgtacgggacaagctggagatacgaaaggactgngctgcaccatctgtcttcatctcccncatctanactatatactgtctagngcggctggacaggcatac

SEQ ID NO: 289297 - DNA, 602 bp, Homo sapiens
  misc_feature: GYAE6OF02FU84M.44.75.G09.1.454.CMB.1.raw
  modified_base (597)..(597): a, c, t, g, unknown or other
  misc_feature (597)..(597): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgacttcttttctggacttcctactttggaagtaggtggaacgtcccagccaggttcagcggcagttggtctgggacactattcactctcacatcagcagtcctgcagccgtggactactttcgacgtacttatactgaccaaataattactttctttttactccgttacttacggttttcgaccggtacgggtaacctaagtcgtagggagtaacgttaacgtaaacgtacgtggtacggtcctgacctacctagttcttcgttcttactaccttcccgttcccgctacttgtactaattagtaacttattacgttcgtaggtacggtcggtccggtaggacgtacggtcgntaacg

SEQ ID NO: 289298 - DNA, 732 bp, Homo sapiens
  misc_feature: GYAE6OF02I4XXE.44.75.G09.1.454.CMB.1.raw
  modified_base (184)..(184): a, c, t, g, unknown or other
  misc_feature (184)..(184): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgctctattggggacagagtcaccatcacttgccgggcgagtgccganattaggtacttttttggccttggtttcagcaggacgcctggacaaacgccccctaagtcccctgacttccgttttctgactcctactttgaagagtggaacgtcccgacgacctacggttcaggacggcacggttaggttcgtcggggacactaatttccaacgtccttacaccatcagactaccggctcgcacgcctgggacgttactttccggataacctttaactacgttagacccaaataaactttagtttaccttttttaacgtacccgttacgttacggttttgggtacccgtaacgggggtaacccgtaacggtacgttacgggtaacgtaacggttaacgtaaaacgggtaacggttacggttacgggtacgtaccggtactaccccgtaagttcgtttcggttaacctttcttaaccgtttacccgttccccgtacctaccttaccttagtaaccttaagttaacgttaaccttcggttaccgttacggtacgggtacgggtccggttacgggaccggtaacggacccgtacgtaacgg

SEQ ID NO: 289299 - DNA, 665 bp, Homo sapiens
  misc_feature: GYAE6OF02HH8KF.44.75.G09.1.454.CMB.1.raw
  modified_base (265)..(265): a, c, t, g, unknown or other
  misc_feature (265)..(265): n is a, c, g, or t
  modified_base (388)..(388): a, c, t, g, unknown or other
  misc_feature (388)..(388): n is a, c, g, or t
  modified_base (582)..(582): a, c, t, g, unknown or other
  misc_feature (582)..(582): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtgaccgacattaggtacttttttggccttggtttcagcaggacgcgtggacaaacgcccctaaaggtccctagtacttcttttcgnggaactcctacctttagaagtagtggacgtcccagccgagttcacggcggactaggttggtctcgggaacgactactttccactcctacacctatccagtcacgcctgcacgtccgtggaatntttaccgacgtactttaactactcgaacccaataattacgtttctttttaacgtccgttaacgttagttttcggaccgtaaggggtaacctaacggtacgttaggacgaattaacgaaacggtaacgttacggtacggttcacgggctaacccgttacgtcgtacgttactttacgaacgtttcccggtacccnccgtaattccggttatagttaactacgtacttcggtaccgtaggtaggccgggtcgtacggacggtaacgttcccggacgtag

SEQ ID NO: 289300 - DNA, 796 bp, Homo sapiens
  misc_feature: GYAE6OF02HNK85.44.75.G09.1.454.CMB.1.raw
  modified_base (187)..(187): a, c, t, g, unknown or other
  misc_feature (187)..(187): n is a, c, g, or t
  modified_base (273)..(273): a, c, t, g, unknown or other
  misc_feature (273)..(273): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacgttgccgggcgagtgccganattaggtacttttttggccttggtttcagcagggacgccgtggaccaaaacgtccccgtaaagtcccctaggtattccgttttacnggtactcccgtagtttcgaaagaggtcggtacgtcccacggccgtaggttcaggcggacgtaggttggttcggtacgggacaccgttacttccacttccaccgaacctataccgaacgtccgacgtccgtgaccgacggtccgtaagggtacgttaactttaccggacgtttaaactttaacgtaccgtacgaaaccctaaacgtttaaacgtttaactttttaccgtttttaacgtttaccgttaacgtttacggttttacgggtaccggtaacgggtaaccggtaacggtaccgtagggtaacgaacgttaaacgtaaacggtaacgttacggttacggtccgtacgtaccgtacctacgttacgtcgttacgttacgttaccacccgttttttttttttttttttttttttacccgaccgttacgttacgtacgttaacgttaacgttaacgttaacgttacgttacgttacggtacgggtacgggtacggtacggtacggaaccggtacggacgtaacg

SEQ ID NO: 289301 - DNA, 663 bp, Homo sapiens
  misc_feature: GYAE6OF02FHLKC.44.75.G09.1.454.CMB.1.raw
  modified_base (255)..(255): a, c, t, g, unknown or other
  misc_feature (255)..(255): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggacgcctggcaaacggcccctaagtccctgactcttttcnggactccactttgaagagtggagtcccagccaggttcacggcggcaggtcggttctggacactatttcactcgtaccaccatcacgtcagcccttgcctacgcctagggtacgtacttttcggaccgttacttaactttacctaggacccgtaaaactaactttactttacctttttttaactcccgttaacgtttacggtttttaccgggacccggtaacggggtaaccaaggttaccgtagggaacgtaagttaacgaaaacggttaacgtggtacggtcgtacgacctactactcgttacgttccttacgtacttcccttacccgaccttactactagaactagttaactactacggttccgtaggacgggtccggtcgtaggtaccgaacggtaccgctaacgg

SEQ ID NO: 289302 - DNA, 729 bp, Homo sapiens
  misc_feature: GYAE6OF02HR9UB.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgcccgacagtttaggtactttttttggccgttggtttcacgcgaggacgccgtggaccaacgtaccccttaacgtccctgtattcttttgcgtactcctactttgagagtggactcccgagcctaggttcaggcggcgtagtggttcgtgggactactactttcacttcctctaacctatcagtcacgtctacgcacgtcctggacgttactttacgacgttactttacgtaccgtagtaaccaacgttaatttacgtttttaccttttttaactcccgtttaaacgtttcggttttcggacccggtaggggtacctaaaggtcgttaggaagttaacgtaacggtaaacgggtactacgggttagccgtcggtaaccacccgttaagtttccttacggtttacccgtttacctaacgtttttccccgttcccggaactttacctaccgttagtaactttacgtttaaacttccgtttcgttaccgttacgggtaccgggttacggaccggtttaaccgggacccttacggggacccggtacttaacggg

SEQ ID NO: 289303 - DNA, 661 bp, Homo sapiens
  misc_feature: GYAE6OF02HH1MH.44.75.G09.1.454.CMB.1.raw
  modified_base (175)..(175): a, c, t, g, unknown or other
  misc_feature (175)..(175): n is a, c, g, or t
  modified_base (257)..(257): a, c, t, g, unknown or other
  misc_feature (257)..(257): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggngagtgccgacattaggtacttttttggccttggtttcagcaggagcctggacaaacgcccctaagtccctgattcttttacnggatacctactttagaacgtagtggagtcccagcctaggttcagcggctagtcggttacgtggactacgtagttcactctcaccatcagctagccttgcacgtcctaggatactttcggacgtactttaattactacgacctaaacgtaatttacttttactttttactccgttaacgttagggttttacggaccggtaacggggtacctaacggacgttagggaagtaacgttaacgaaacggtacgtaggtagtaccgtacgtaccgtactacgttcttcgttaccttcttaaccgttccttacccgtctaacgttccgtatacgttaagttacttacgttacgttaccgtacgggtacggtccgggtacggtacgggtaaccgaacgggcgtacgtaacgg

SEQ ID NO: 289304 - DNA, 736 bp, Homo sapiens
  misc_feature: GYAE6OF02FXQNJ.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttgccgggcgagtcgccgactattaggtacttttttggccttggtttcagcgaggacgcctggaccaaacgcccctaagtccctgtacttcgttttcgtcggtacttcctacgtttgaaagtaggtggtacgtccccagcccgtaaggttcaggccggctaggttcgggttctcggggacctaaccgtacttttccacttccgtaccacccgtatccgtacggctaacgccttcggcctaagtccctagggtaagtactttcggaccgtaacgtttacttaccgtcggaccctaaactaactttacgttttaccttttttttaacgtacccgtttaacgttacggtttttccgggaccgtaacgggggtaacctaacgggtccgtaggaacgtaacgttaacggaaaacggtaccgttgacggtcgtacgtccctaaccgtacttcggttacttctttaccgtaacttcccgtttaccccggcttacgtccttagttactaacgttacttaccgttcgtacgtacggtacggtccgggtcgttacggacggtacggtccgtacgtaacg

SEQ ID NO: 289305 - DNA, 588 bp, Homo sapiens
  misc_feature: GYAE6OF02FIOU6.44.75.G09.1.454.CMB.1.raw
  modified_base (252)..(252): a, c, t, g, unknown or other
  misc_feature (252)..(252): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaaagcccctaagtccctgatcttttcnggatccactttgaagagtggagtccagccaggttcagcggcagtggttctgggacacatttcactctcacatcagcagcctgctagcctggagtagtttcgcgtacttattacgtgaccaaactaataacttcttttttactacctactagtttttcggacctaggggaacctaaggcctaggagtattacgaaaacggtaacttggtacgcgttacgctaccaattcccttagttcctttactaacttccgtttccccgtcccgtaacttcttacgattagttaacttactcggttacttcgtacgcgggtctgggtactaacgggcgtacgacg

SEQ ID NO: 289306 - DNA, 740 bp, Homo sapiens
  misc_feature: GYAE6OF02H7GDM.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctagttggggacagagtcaccatcacgttggccgggagagtcgaccaactagttaggttacttttttcggtccgttcggtttacaggacgagggacgtccgtaggacgtaaacgccccctaaggtccctagtacttacttttcgtacggtactaccgtacgtttaggaacgtacggtacggtacgtacccgagtacccgtaggttccaaggccggaccgtagggtttcggttcgtacggggtactactaatttccgacctttaccgtacctaaccgacttaccgacgtaccgaacgtcccgtacggtccgacgtaccggttaagggtacgttaaccgtttacggtaccgttaactttaaacgtttaacctacggtaaccctaaaactaactttaacttttactttttttacgtaccgtttacgttacgttttacggaaccgtaacggggaacctaaggtaccgttaggaacgtacgtaaacgtaacgggtacgttacggtcggaccgttagacccgtacgtacgttcgttacgttacctttaccgtactttaccccg

SEQ ID NO: 289307 - DNA, 688 bp, Homo sapiens
  misc_feature: GYAE6OF02F1A4V.44.75.G09.1.454.CMB.1.raw
  modified_base (681)..(681): a, c, t, g, unknown or other
  misc_feature (681)..(681): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcgaggagcctggccaaacgcccctaagtcccctgacttcgttttctggtactcctacttgaagaggtggagtcccagtccaggttcacgcggctaggtggttcgtggggaccacgtcttttcaaccttctaccacccagttccagcgacgcccgttgccgtacgccgtaggacgtacgtttcgcggtaacctttattaccgtcgaccctaaacgtaatttacttttacctttttttactacccggtttaacgttacggttttaccgggacccggtaacggggtaaccgtaacggacgttaggggagttaacctaacggtaaacggtaccgttagggtcggtacgtcggaccgtaacccattccgtacgtttcccgtcttacgttcccttacccgccttagtcttacgtactagttaacgttacttcgtacgtggaaccggtcgggtactaggtaccggacggtacgngtaacgg

SEQ ID NO: 289308 - DNA, 758 bp, Homo sapiens
  misc_feature: GYAE6OF02IF4MW.44.75.G09.1.454.CMB.1.raw
  modified_base (227)..(227): a, c, t, g, unknown or other
  misc_feature (227)..(227): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgtcgtctagtggggacagtacgtcaccatcacttcggccgggcgagtgccgactagttaggtacttttttcggccttggttacagcaggngctggacaacgccctaagtcctgtacttctttcaggtactcctacgtttaggaagagtggacgtccgacgtccgtaggttccaggccggtcgtggttggttcggtgggaacctacttacgtttccactccgtaccaccactacacgacgcgtccgtacgcgaccgtccggtagggtacgttaccgtttcgacgttaacttacgtttaccacggtaacctaaattaacgtttcttttacctttttagtaccccgtttagttaacggtttccgggtaccggtaacgggtactaacggttccgtaaggtacgtaacgtaaccggtaaacggttcgtacgggtcggtccgtacgtaacccgtaccgtaactttccgttacgttcccgttaccgttaccggttcccctttacccggacccttacggtttaacttcggttaacctttaacgttaaccgtttcgttaccggttaaccgttcggggttaacggccgggttaccggaccgggtttaacggaccgggtccggtaacgtacg

SEQ ID NO: 289309 - DNA, 755 bp, Homo sapiens
  misc_feature: GYAE6OF02H6KOF.44.75.G09.1.454.CMB.1.raw
  modified_base (230)..(230): a, c, t, g, unknown or other
  misc_feature (230)..(230): n is a, c, g, or t
  modified_base (261)..(261): a, c, t, g, unknown or other
  misc_feature (261)..(261): n is a, c, g, or t
tcagacagtatatacacgaccggtgctcgatttagtatagacatcagggacttagggctttgccaggctcctgctgctctgtttccccggtgccaggtgtgacatcgagatgacccagtctccgtcctcactgtctgcgtctattggggacagagtcaccatcacttgccgggcaagtcagaccattaacagcttatttaaattggtatcagcagacgaccagggaaacnccctgaactctgatctctgctgcctcctacncgtgacgtaaggtcgacgttccttcgttacgtaaggtttccaggtggctaaggtcggtatccgtggggaacctaggttaccttttacgaccttacctcctaaccctacgtttccctcccgttaagtttcgtacgtaccgtaaaccccgttgaaaacggttttccgttttaaagaacccgttaaaccttttacctaacgtttcggtaaccctaaacgaggtttaacgttttaactaccggtttaccggtaccccgttttagtttacccggttttacgggggacccggggtaaacctacggttaccggtagggttaactacgttaaccgtaaaaaccggcgtttacggtacggtacctcgaaccctaacctgttacttcgttcgtaaccgtcttcccgttcccgaccgttaactcttacggtaattaaccgtttacgtaaccgtttcggtaccgtacgggttaaccgggtccgggttaccggtaccgggtaaccgg

SEQ ID NO: 289310 - DNA, 816 bp, Homo sapiens
  misc_feature: GYAE6OF02FRXQE.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcagggagcctggcaaacgcccctaagtccctgacttcttttactggacttcctacttttgaaacggtagttgggagttcccccaggtccctaagggtttcaaggtccgggtcgaggtttggggtttacgtgggggtaacctactaagttttccaccgttccgttaccacccgtattccgacgtccgaagtcccctggaccgacggtccccgttagggtaacgttacgtttttacggaccggttaaaccttttaagtttacccgttcggaacccctaaactaaactttaacgtttttaccttttttttaacgttacccgtttaaccgtttacggttttaccgggtacccggtaacgggggtaaccctaaagggttaccggtacgggtaaacgtacgttaaacgtaaaacgggtaaccgtttcgggttaccgggtacgttaccggcccttaaccgaactttcccgttacggttttccttacccttaccgtttcccgtttaccccgtaccgttaccgtccttaggtacctttaacgtttaacttacggtttcgtactacgggtacggtccgggtacggtcggtacggaacgggtcgtacgtaacg

SEQ ID NO: 289311 - DNA, 746 bp, Homo sapiens
  misc_feature: GYAE6OF02IF4P6.44.75.G09.1.454.CMB.1.raw
  modified_base (178)..(178): a, c, t, g, unknown or other
  misc_feature (178)..(178): n is a, c, g, or t
  modified_base (225)..(225): a, c, t, g, unknown or other
  misc_feature (225)..(225): n is a, c, g, or t
  modified_base (227)..(227): a, c, t, g, unknown or other
  misc_feature (227)..(227): n is a, c, g, or t
  modified_base (485)..(485): a, c, t, g, unknown or other
  misc_feature (485)..(485): n is a, c, g, or t
tcagacagtatatacacgaccggtgctcgatttagtatagacatcaggggaggaatcagacccagtcaggacacagcatggacatgagagtcctcgctcagctccgtggggctcctgctgctctcgtttccccggtgccaggtgtgacatcgagactcgacccagtcctccgtcctcnctgtctgctacgtagtgggacagagtccaccatcacgttggccgggngngtcgcgactagtttacggtctttttggcgttggttcagcgaggtagccgtggaccaaacgccccgttaaggtccctagtactttcttttcgtacgggtacttacctaggtttacgtaaggtaggtacggtaccgttacccgacggtacctacgggttacgtacgggccggtacgtagggtttcggttacgggtacgggtaacctaccggttactttacgtaacccttcccgtactaaccctaacttcgacggtaaccncggtcccgtagtacccgacgtccggtagtaacgttccgttccggtactaaccgtttacggttacctacgaaccttaaacctaagtttaccttttaccttttttacgtaccggtttaacgttacggttttacggacccggttaacggaccggtaaactccggagtaaccgtagtaaccggtaaaggtccttagggtccggtaccgttacggaaccttccggtaacttccggttacgttcccggtttactcccggtttacccg

SEQ ID NO: 289312 - DNA, 839 bp, Homo sapiens
  misc_feature: GYAE6OF02IOX64.44.75.G09.1.454.CMB.1.raw
  modified_base (175)..(175): a, c, t, g, unknown or other
  misc_feature (175)..(175): n is a, c, g, or t
tcagacagtatatacacgaccggtgctcgatttagtatagacatcagggacttagggctttgccaggctcctgctgctctgtttccccggtgccaggtgtgacatcgagatgacccagtctccgtcctcactgtctgcgtctagttgggacagagtcaccatcacgttgccgggngagtcgccgactattaggtacttttttcggtccttggtttcagcgaggagccgtaggaccaacgacccctaacgtccctagtacttcttttcgtggtacctacctaacgttttcgaaaggtacggtacggtaacgtaccccgtagaccgtagggtacctaggccggaccgtaggttcgggttaccggttacggggaacctaacgttaacttttacctaccgttaccgtacccgtaacctaactaccgacgtacgtacctaccggtagccgtaacgtcccggttagggtaaccgttagtttaccggtacgtttaacctttaacgttaaccgacggtaaccctaaaacttaacttttaacgtttttaccgttttttaacgtacccgtttaaaggtttcggttttaccgggaccgggtaacgggtaaccgtaacgggtacgttagggaacgtaacgttaacggaaaacggttacggttaggtaccggtacgtccggaacctactaacggtttcgtccgttttaccttacccgtaacctttcccgtaccccggtaaccttacgttaaccgttagtaaaccgttagttaaaccgttccttaccgggttacttaaccggggacgggttccggggaccgttgggaaacccgggtcgtaccggtagtaacgg

SEQ ID NO: 289313 - DNA, 777 bp, Homo sapiens
  misc_feature: GYAE6OF02GB7NI.44.75.G09.1.454.CMB.1.raw
tcagacagtatatacacgaccggtgctcgatttagtatagacatcagggacttaggggctttgccaggctcctgctgctctgtttccccggtgccaggtctgacatcgagatgacccagtctccgtcctcactgtctgcgtctagttggggacagagtcaccatcacttgccgggcgagtgccgacattaggtacttttttggccttggtttcagcaggacgcctggccaaacgcccctaagtcccctgtacttccttttcgtggtacttccctaaccttttggaaagtaggttcgggaacgttccccgagcccaagggtttcaacggccggacgtaggttcggttcgtggggacctacgtattttccacttcctaccaacctatccagacagtccctgccgaacgcccgttaggaacggtacgttttacggaccgttaacctttaacgtttaacgtccgtaaaccccaaaacttaaacttttaactttttacccttttttttaacgttacccggtttaaacgtttacgggtttttaccgggtacccggtaacggggggaaccctaaacggtccggttagggaccgtaagttaaccggtaaaacgggtaacggttgggttacggtacgtcgaccctaaccttagttaccgtttcgttacctttcctaaccgtttcccttaccccgtacttacgttcgttacgtattaacttacgttaccgttacggttaccgtacggtacggtcgggtcgttacggacggaaccggtagtacctaag

SEQ ID NO: 289314 - DNA, 721 bp, Homo sapiens
  misc_feature: GYAE6OF02G11P1.44.75.G09.1.454.CMB.1.raw
  modified_base (257)..(257): a, c, t, g, unknown or other
  misc_feature (257)..(257): n is a, c, g, or t
  modified_base (315)..(315): a, c, t, g, unknown or other
  misc_feature (315)..(315): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggttcagcgaggacgcctggacaaacgcccctaagtccctgattcttttcnggacttccactttgaagagttggacgtcccagccaggttcagcggctaggtcggttcngggacactattcactctcaccntcancagcctgcagcctaggacgtactttcggacgtactttagtactcgaccctaagtaacttacttttacttttttactacccgtttaacttacggtttttacgggacccgtaacgggggtaaccctaacggtcggttacgggtaagtacgttaacggtaaaacggtaacgttaggtacggttacgttacgaacctaaccgttacgttacgtttccggttcctttacccgtaccgttttccccggtttaccccgtaccgtaaccgttccgttacgttaacgttttaaaccgttacggttaaccgtttacggtttaacccgtacgggtaaccgggtccgggtaccggttaccgggaaccggtaacgggtaccgtaccgtaacgg

SEQ ID NO: 289315 - DNA, 658 bp, Homo sapiens
  misc_feature: GYAE6OF02GGX48.44.75.G09.1.454.CMB.1.raw
  modified_base (386)..(386): a, c, t, g, unknown or other
  misc_feature (386)..(386): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacagttaggacttttttggccttggtttcagcaggtagcccttggccaaaacgtcccctaagtccctgacttcttttccgtgggtccctaactttggaagtaggtggtacgtacccagcctaggttcaggtccggctaggttggttcctgggtactactatttcactcgtcaccgatcgacgtcacgcctgcacgcctgagtnttcgcgttacttatcgtacgacctaaactatttacgtttactttttactaccgttaacgttagttttcggaccgtaggggtaaccctaacggtcgtaggtaacgtacgtaaccgtaaagggtaccgttaggtacggtcgtacgtacctacctagttaccttacgttcgttccgtcgttccgttcccgactacgtacctagtacttattacttaacgttcgttacgtacgacgggtccggtagtacggtaccggtaacggcgtacgtagtacg

SEQ ID NO: 289316 - DNA, 669 bp, Homo sapiens
  misc_feature: GYAE6OF02G3UKY.44.75.G09.1.454.CMB.1.raw
  modified_base (276)..(276): a, c, t, g, unknown or other
  misc_feature (276)..(276): n is a, c, g, or t
tcagacagtatatacacgaccggtgctcgatttagtatagacatcaggggaggaatcagacccagtcaggacacagcatggacatgagagtcctcgctcagctccgtggggctcctgctgctctcgtttccccggtgccgaggtgtgacatcgagatcgacccagtcctccgtcctcactgtctgcgttctagttgggacagtacgtcaccatctacgtcgccgggcgagtcgccgatagttacggttacgtttttggccttggttcagcgaggcnccgtaggacaaacgtccccctaagtcccgtgtactttcgttttcgtggtaccttcctacgtttagaagtacgtcggactcccgagtccgtaaggttcaggccggagtaggttcggttcgtacgggtaactacgttactttaccgaaccttcctaccgaacctacgtacgacgtcgaccgtccgacgtcgtaccggtcgtaggtacttaccgttcgacgttacttacgttacacgtaactaaacgtatttaccttttcttttaaccgtaccgttacgttcgtttacggaaccggtacggtaactaggtcgtagaagtacgtaacgtaaggtacgttgtcggtaccgacgtaaccgtacgtacgttcttacgtttaccttacgtacccttcccgg

SEQ ID NO: 289317 - DNA, 817 bp, Homo sapiens
  misc_feature: GYAE6OF02HBQ3N.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagccgtggacaaacgcccctaagtccctgtacttcttttcgtggtactcctacgtttagaagtagtcggacgtccccagccgtaggttccgaggccggacgtaggttgggttctacggggtaaccacgttactttccaccttcctaccaaccgtattaccgaacggtcctaaccggtcccgttaggacccgtacggtcccggtaggggtaaccgttacgttttccggaccgttaacgttttacgttaacccgtacgaaccctaaaacttaaacttttaaccgtttttacctttttttaaccgtacccggttttaaccgtttaacgggtttttaccgggaacccgggttaacggggtaacccgtaaggtaccggtagggtaacgttaactaacggtaaacggtacgtacgggtacgtaccgtacgtaaccgtaccgtacgttcgtttaccgttacccttacttaccgttcccccgttcccgtaaccgttacgtttaccgttacgttaacttacgttaaaccgtttaccgttacggttaccgtacggtaccgggtccggttaccggtaaccggggacggtaacgggtaccgtacgtaacgg

SEQ ID NO: 289318 - DNA, 610 bp, Homo sapiens
  misc_feature: GYAE6OF02GYWUH.44.75.G09.1.454.CMB.1.raw
  modified_base (255)..(255): a, c, t, g, unknown or other
  misc_feature (255)..(255): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaacgcccctaagtccctgattcttttcnggactcctactttgaagtagtggacgtccccagccaggttcagcggcaggttggttctgggacactatttcactctcacatcagcagcctgcagccgtggatacttttcgacgtactttacttactcgacctaaactaatttacttttactttttactaccgttacttaggttttcggaccgtaacggggacctaaggtcgtaggagtagtaacgtaaacggtactggtcgtctcgactacctacttctacgttccttactacttcccttcccgtacctacttcctataacttacttaacttacttcggtcgtaggtacggtccgggtcgtacgggcgaaccggcgtacgtaacg

SEQ ID NO: 289319 - DNA, 737 bp, Homo sapiens
  misc_feature: GYAE6OF02IXBSH.44.75.G09.1.454.CMB.1.raw
  modified_base (164)..(164): a, c, t, g, unknown or other
  misc_feature (164)..(164): n is a, c, g, or t
  modified_base (495)..(495): a, c, t, g, unknown or other
  misc_feature (495)..(495): n is a, c, g, or t
  modified_base (589)..(589): a, c, t, g, unknown or other
  misc_feature (589)..(589): n is a, c, g, or t
tcagacagtatatacacgaccggtgctcgatttagtatagacatcaggggaggaatcagacccagtcaggacacagcatggacatgagagtcctcgctcagctcctggggctcctgctgctcttcgttcccggtgcctacggtgtcgacatcgagatgaccccngtcctccgtctcactgtcctgcgtctagttcgggactaggctcaccgtcaccgttaggtccggcggaggtaccgccggtacgtacgttaggtaccttttacggttccgaggtttcgtacgcggtaggtacggtccgacggtaccgtaaacggtaccccgttaacgtaccccgttcgtaattttccccgtttcgtaggtacccttacgtacgttttagccgtaacgggttcgtaccgtacccggtcgtaccgtacggttacgtaccggcggtcagggttacgttcgtacggtacctacgtacttccgactactcccaacgtactccgggtancccgttacgccctaacggtcctagggaccgtacgtttacggacgttacgttacgttacccgtaggtacccttaacgttactacgtaccttttanacccgtttattacgttttacgaccgttaggggtttaccaaagggtttccgtacgtaacggtccttaggaacgtacgtacggtaacggtcgtaggtctacgtactaccgttacgttccttaccgtactttaccgttacctccgttaacg

SEQ ID NO: 289320 - DNA, 572 bp, Homo sapiens
  misc_feature: GYAE6OF02HMRL3.44.75.G09.1.454.CMB.1.raw
  modified_base (523)..(523): a, c, t, g, unknown or other
  misc_feature (523)..(523): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaacgtccctgactcttttctggatcctactttgaagagtggacgtcccagccaggttcagcggcagtggttctggacactatttcactctcaccatcagcagcctgcagcctggagtactttcgcgtacttattactcgaccaacaacttatttactttttactccgttacttaggttttcggaccgtacggggactaagtcgtgggaagacttacgaaagtacgttgcgactcgcacctactctagttccttactacgttcccttcccgctactctagtactttactnttacctcgttcgtaggtacggcggtcggtcggacggacggtcgactacg

SEQ ID NO: 289321 - DNA, 880 bp, Homo sapiens
  misc_feature: GYAE6OF02I78L2.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacagttaggtactttttggccttggtttcagcaggagcctggacaaacgcccctaagtccctgacttctttctggactccgtactttgaagaggttggacgttcccaggcctaggttcaggcggtcacggttggttctgggacctacgtacttttcaccgttcctacctaacctattaccgaacgtccgaacggtcccttacgaccgtaacgcccgttagggtaacgttacgttttaccggaccggttaacctttaatttacccgtacggtaaacccctaaaaccttaaagttttaccttttaaccgttttttttaacgtaaccccgttttaacggttaaccggtttttttacgggaaccccgggttaaacgggggtaacccgtaaacgggttacccggttacgggtaaacgttaacgttaaaccggtaaaaacgggtaacgttcgggtaacgggtccggtaccggtaacccgtaaccgttaaccggttcccgtttacggttttaccgttaacccgttcccgttttaccccgtttacccccggtaacccttaaccggtttccgttaaccggttaacttttaaccgtttaaacgtttacccgttttacgggttaacccggttagggttaaccccggggtaccgggtttaccggtttaacgggacccgggtaacgggttacccggaacgttaaaccggg

SEQ ID NO: 289322 - DNA, 723 bp, Homo sapiens
  misc_feature: GYAE6OF02GH5ZW.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacatttaggtacttttttggccttggtttcagcaggagcctggacaaacgccccttaagtccctgtacttcttttcgtaggtactcctactttagaagtgtggacgtcccagcctaggttcagcggtcacgttcggttcgtgggaccacgttacttccaacttcctccaacctacttccgagcacgcctacgtcaacgtccgtaggtacgtctttccgacgttaacttactttaaccgtcgaaccttaaacgtaactttacttttactttttaacgttaccgttacgttacggtttttacggaccggttaacgggaaccgtaacggtccggtaggtacgtaacgtaacggaaacggttaacgtggttacggtactacgacctaccgtaacgtttccttcggtttaccttccgttaaccttccccgttacccgttaccgtacctttccttagttaattacgtttaacgttaacctttacggttacccgttaggttacgggcgggtttccggagggtaacccggacgggtacgtacggtacg

SEQ ID NO: 289323 - DNA, 759 bp, Homo sapiens
  misc_feature: GYAE6OF02GP4RJ.44.75.G09.1.454.CMB.1.raw
tcagacagtatatacacgaccggtgctcgatttagtatagacatcgagggagaatcagacccagtcaggacacagcatggacatgagagtcctcgctcagctcctggggctcctgctgctctcgtttccccggtagccaggtgtgaccagtcgagatgacccagtctccgtcctcactgtctagcgtcgtagttgggacaggacgtcaccatcctacgttcggccggcgagtcgcccgtactagttacggtactttttggccgttggtttcagtcgaggactccgtagacaacgccctaacgtccctagacttcgtttcgagtactccgtacgttaggacgtaggtacgtacgtacccgtagtaccgtaggttaccacggtcggacgttacggtttcggttacgtcgggtaaactacgtaactttccaacgtcctaccgaacgtacgtacgtacggtacaacggtccctaggacctacggtcccgtaagggtacgttaccgttaccgtacttaaccgtttaactaccggtacaaccgtaaactaaattttaccgttttacgtttttaccgtaaccgtttacggtttaacggttttaaccggaccgggttaaccgggtaaaccttacggtaacggtttacggaaacgttaccggttaaaccggtaaacgggttaaccttacgggttacgtaccgtaaccgttacccgtaacgtttcgtaccgttttacggttcctttaacccgtacgttttaacccccgg

SEQ ID NO: 289324 - DNA, 679 bp, Homo sapiens
  misc_feature: GYAE6OF02GSBJG.44.75.G09.1.454.CMB.1.raw
  modified_base (253)..(253): a, c, t, g, unknown or other
  misc_feature (253)..(253): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccacattaggactttttggccttggtttcagcaggagcctggacaaacgcccctaagtccctgatcttttcgngatccactttgaagagtggagtcccagtccgaggttcagcggcagtggttcgtgggacacgtatttcgacctcgttacaccgaatcagcgacgcctgctagcctggatacggggggtttccacggactttaattaccgtcgtaccctaaacgtaacttaacttttacgttttttaacctaccggtttaactttacggtttttacgggacccggtaacgggggtaaacctaaacgggtccgttaagggtaacgtaacgttaaccgaaaagggtaaacgttggtacgggcgtacaccgtaacctactcttacgttctaccttacgtttcccgtacccgtacctacttccgtagtacctagttacgttacgttcgtacgttacggacgggtccgggtacggtacggaccggtaaggtcccggataacgg

SEQ ID NO: 289325 - DNA, 835 bp, Homo sapiens
  misc_feature: GYAE6OF02GCS6F.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttcgccgggacgagtgccgacattaggtacttttttggccttggtttcagtacaggacgacctggacaaacggcccctaaagtcccgtgtattccgtttttacgaggtacttacccgtacgttttagaaagtacggtacggtaacggtaccccctaaggaccctaacgggtttcaaacgggccggtacgtacggtttacggggtttacccgtagggggtaacctaaccgttaacgttttacccggtaaccgtttccctaacccgtaaaccgttaacttaccggaaggtacctaacgggtccccgtaggtaccgtaacggtacccggtacgggtacgttaacgttttacccgaaccggttaactttaacgttaacgtacggaaccctaaaactaagtttaacttttaccgtttttaacgtaccgttaagtttacggtttacggaccggtaacggggaacctaacggtcgtagggtaagtaacggtaaacgtaaacgggtaacttacggtggtacctacggacctaccgtacgtaccgttacgttccttaacggttaccttacccgttcccggtaaccttaacttccgttaagttaacctaacgttaattacccgttgttaaccgtacggtacgggaccgtcggtaccggttagacccgggtacacgtaag

SEQ ID NO: 289326 - DNA, 662 bp, Homo sapiens
  misc_feature: GYAE6OF02I4KGO.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcctctagttgggacagacgtcacatcacttgccgggcgagtcgccgactaagttacggtacgttttttggcctttggtttcagtccaggacgtccgtggaccgaaacgtcccccttaacggtcccctagacttttccttttcgtaggtacttcctactttaggaagtaggtcggacgtcccgacgtccgaggttcacggtcggacgtaggtggttcgtaggactctatttccactctactaccatcgagcacgtcctgccacgtccgtagggacttactttccggacttaaccgtttattaccgtacgaccctaaacgttaaactttacttttactttttacttaccggttacgtttaacgggttttccggacccgtaaggggtaaccctaaggtcgtaacgggactacgtaaggtaaacggtacttcggtggtaccttcgacgttaccgtacttccgttacgttcgttacaccggtttccc

SEQ ID NO: 289327 - DNA, 847 bp, Homo sapiens
  misc_feature: GYAE6OF02JTCUC.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgtcgtctagttggggacagagtcaccatcacttgccgggcgagtgccgacattaggtacttttttggccttggtttcgagtcgagggacgtccgtggactaacgccccctaagtccccgtagtactttccttttacgtggtacttccctaacttttggaagtaggtacgggacgtacccgagcccgtaaggttccgaggtaccggcgtacggtttggttccgtagggaacctacgtacttttccgaccttacctaccctaaccgacgttacctaaccggcgtaaccgtccgtacgaccggtacggtacgttcgggtaaggttacccgtttttcggtacccggttaactttacgttttaacccacccggtaaccttaaaccgtaaacttttccgtttttaccgtttttttaaccttacccggtttaaccgttttagttttacccggggaaccgggttaacccgggtaaccgttaagggtcccgttaaggggtaaccggtagttaaaccggtaaagggttaaacggttcggttacggtccgtacctaacccggtccgttaacgtaccctttagggtttccctaaccgtttccgtttaacccgggttcccctaccgttaacgtcgtacgttaccgttaaacgtttacttacggtttactcccggtaggtaccggtaccgggtttaggaccggacgggttaccggcgacgtaag

SEQ ID NO: 289328 - DNA, 670 bp, Homo sapiens
  misc_feature: GYAE6OF02GYWY9.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtcgccgacattacggtactttttggccttggtttcagcaggacgccgtggacaaacgcccctaagtccctgtacttcttttctggactcctacttttgaagtagttggacgtccccaggcctagggttcaaggcgggcctaggttggttcgtcgggaacacgtattttccactcctcacctatcagccacgcctgcacgtccgtaggacgtacgtttccgacgttaacttacgttaccgtcgaacctaaagtaactttaacgttttccttttttaacgtacccgtttaacgtttagggttttcgggacccggtaacggggtaccaacggtcgtaggaacgtattaacgaaaggtacttggtcgtacgtcgtaccaactcgttacgtcgttcttactaccttccttccccgactacttcctagtaacttaacgttcgttaacgttcgtacgtcggtacggtccggtacgtccgggtacgacgggtcgagtacg

SEQ ID NO: 289329 - DNA, 832 bp, Homo sapiens
  misc_feature: GYAE6OF02IX3IM.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtcgccgactattacggtacttttttcggccttggtttcacgcgaggtagccgtggacaaacggtccccgtaacgtccctagtattcttttccgtggactacctactttagaaagtaggtacggtacgttccccgaagtacccgtaggttccgaacgtccggtacgtaggttacgggttcgtacggggtactaccgtagttttaccaccttaccgtacctaaccacgttccgacgaccgacgtccgtcggacgtaacggtccgttaagggtaacgttcgttttacccggaacgtttaccgtttaaagttaaccgtaccgaacccgtaaaattaaccgttttaacttttaccgttttttaccgtaacccggtttaaccgttaagggttttcccgggtaccggtaacggggaacctaaacgggttcgtacgggtaacgtaacgtaaacggtaaagggtaccgttgggtaccgttccgaccgactaaccgttattcgtccgtttacgttccctaaccggtttccctaccccggtaacttacgtaccgttacggttaacttaagtttaaccggttaccgtttaacggtccgttaccggggtaacgttaccggggtaccggtttaccgggaaccggttaacgggaccggtaccggtaagg

SEQ ID NO: 289330 - DNA, 710 bp, Homo sapiens
  misc_feature: GYAE6OF02JL2KH.44.75.G09.1.454.CMB.1.raw
  modified_base (181)..(181): a, c, t, g, unknown or other
  misc_feature (181)..(181): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattgggacagagtcacatcactgccggcgagtgccganagttaggtactttttggccttggtttcagcaggagccgtggacaaacgccccgtaagtcccctgtacgttccttttacgtacggtactccgtaccgtttgaagtagtggtactaccccaggcctaggttacacggccggcgtaggttcggttcggtacgggtactaccgttaactttccgaccgttccgtaccgaacctaacgttaccgaacggaccgacggtccccttggaccgtaacggtcccgttaagggacgttacttttaccgggaccgtttaacctttaacgttaacctaccggtaaccaaacttaacttttaacttttaccgtttttttaaccgtacccgtttaaccgttaacggtttttcgggaacccggtacgggtacctaacgtcgtacggataacgttacgtaacggtactcgtgtacgcgtacaccgtatcttcgttactccttctcctaccgctacgtactatactagttacctgtagtcgtacgtacggtcggcgtacggacgacggtcagtacg

SEQ ID NO: 289331 - DNA, 812 bp, Homo sapiens
  misc_feature: GYAE6OF02F1T1D.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggacgcctggacaaacgcccctaaagtcccgtagtacttcttttccgtggtactccgttactttaggaaacggtaggtcgggtaaccgttccccgaaggtccgtacgggtttaccaacgggtccgggaccgttagggtttcggggtttacggttacggggaacctaaccgttacttttacccgactttacctacctacccgtacttacgacgtaccgacgtcccgttacgaccgtaccggtcccggttagggtaacgttacgttttcccggacggtttaacctttagttaaccgtaccgtaaccctaaaacgtttaactttaactttttacctttttttacgtaccgtttaacgtttacgggttttaccgggtaccggtaaccgggggtaaccttaacggtcggtacgggtaacgttaaacgtaacggtaaacggttaccgtaggtaccgggtactacggacccgtactaacgttccgtacgttccttacgtaccttcccgtaccgttactcgtacgtcgtaacgtacgttactaaccgttcgtacgttgggtaccggtacggtacgtaccggaacggtacggtacgacgtaacgg

SEQ ID NO: 289332 - DNA, 757 bp, Homo sapiens
  misc_feature: GYAE6OF02HVLQI.44.75.G09.1.454.CMB.1.raw
  modified_base (129)..(129): a, c, t, g, unknown or other
  misc_feature (129)..(129): n is a, c, g, or t
  modified_base (174)..(174): a, c, t, g, unknown or other
  misc_feature (174)..(174): n is a, c, g, or t
tcagacagtatatacacgaccggtgctcgatttagtatagacatcagggacttagggctttgccaggctcctgctgctctgtttccccggtgccaggtgtgacatcgagatgacccagtctccgtcctnactgtctgcgtctattggggacagagtcaccatcacttgccgggngagtgcccgatattaggtacttttttggccttggtttcagcgaggacgcctggacaaacgccccctaaagttcccctaggtatttccgttttctggacttacctacgtttacgaaaggtagttcggacgttaccccaaggccgtaggttccaaggccgcgtaggtgtttcgtagggaacacgtacttttccacgtctaccaccttatccgtacgcacgtcctacgctacgtacctaggtaacgtatttccgaacgtaaccttttactaacgttacgaacccgtaaactaacttttacgttttacctttttttaacgtaccggtttaacgttaacggtttttcggtacccggaaagggttaacccgaagtaccggtaggtaagaataacccgtaaaggacgttaggtacgtgtaccgaccgtacctaattccggtttattccgtttaccgtattttcccggttaccccgtacccgtttaacgaaccgtttcggaactttacgtaaccgtttacgtacggttcccgttaagggtaaccggttccgggacgttaccggtaacggtacgggttaccacggttaacgg

SEQ ID NO: 289333 - DNA, 646 bp, Homo sapiens
  misc_feature: GYAE6OF02FYHUE.44.75.G09.1.454.CMB.1.raw
  modified_base (130)..(130): a, c, t, g, unknown or other
  misc_feature (130)..(130): n is a, c, g, or t
  modified_base (257)..(257): a, c, t, g, unknown or other
  misc_feature (257)..(257): n is a, c, g, or t
  modified_base (334)..(334): a, c, t, g, unknown or other
  misc_feature (334)..(334): n is a, c, g, or t
  modified_base (356)..(356): a, c, t, g, unknown or other
  misc_feature (356)..(356): n is a, c, g, or t
  modified_base (421)..(421): a, c, t, g, unknown or other
  misc_feature (421)..(421): n is a, c, g, or t
  modified_base (434)..(434): a, c, t, g, unknown or other
  misc_feature (434)..(434): n is a, c, g, or t
  modified_base (542)..(542): a, c, t, g, unknown or other
  misc_feature (542)..(542): n is a, c, g, or t
  modified_base (566)..(566): a, c, t, g, unknown or other
  misc_feature (566)..(566): n is a, c, g, or t
  modified_base (585)..(585): a, c, t, g, unknown or other
  misc_feature (585)..(585): n is a, c, g, or t
  modified_base (641)..(641): a, c, t, g, unknown or other
  misc_feature (641)..(641): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctnactgtctgctctattggggacagagtcaccatcacttgccgggcgagtcgccgatattaggtacttttttggccttggtttcaggcaggacgccttgacaaacgtccccctaagtcccctgactttntttttccgaggacttcctacgttttagaagtaggtcggtaacgtccccgaagtccccgaaggtttccaggccggacngttgggttctggggactaactnttttccactcctaccgacctactcgatcacgtcccaggtcaacggccaggtctaagtttcccggnttaacttacgttntacaccgaattactttatttacgttttttacacccttatttcggtttcggtaccggaggaccaagggtgtacggagtaacaccgtaaagtaccgttggcggtcgtacnccacacttcggtctttcgttaacncctttcccggtccctaacngttccttatctaactcttaggtttcgaaggtgacggtcgtacggtagcgggttacnctaag

SEQ ID NO: 289334 - DNA, 703 bp, Homo sapiens
  misc_feature: GYAE6OF02HH0PN.44.75.G09.1.454.CMB.1.raw
  modified_base (157)..(157): a, c, t, g, unknown or other
  misc_feature (157)..(157): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgtcgtctagttggggacagngtcaccatcacttcggccgggcgacgtgacccgactattaggtacttttttcggccttcggtttcacgtcgacggacgccgtggaccaaacgtacccctaacggtccctcgtacttccgttttcgtcggacttcctacgttagaagtacgtcggacgtcccgacggtcctaggttcgacggccggtcgtaggttcggttccggtacggactacttacgtttccaccttccgtaccacctacgtcacgcctacgtccgtgccgacgtcgtaggacgttacgtttccgacgttaactttactacgtcgaacctaaacgttaatttactttttacctttttaaccgcccgtttaacgtttacgggttttcgacccgggtaacggtacccgtaagcgttagggaacgtattaacgaaacgtagtcgcggtacacgactaaccgtcttcgttccttacttcctaccgttacccgtcccgatacgtatctaactttacgttctcgttgtaccgtacgacggtccgggagttccgacgggtacgtcctagtcg

SEQ ID NO: 289335 - DNA, 716 bp, Homo sapiens
  misc_feature: GYAE6OF02FY5QF.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcgaggagcctggcaaagcccctaagtccctgattcttttcgtggactcctactttgaagagtggacgtcccagccgtaggttcagcggtcaggttggttcgtgggactactactttcacctctcaccatcagcagcctgccacgccgtaggagttacgtttccgacgttactttaacttacgtacgtaaccctaaacgtaacttttactttacgtttttttaacgtacccgtttaacgttacgggtttttacgggtacccggtaacgggggtaaacccgtaacgggaccgtacgggtaagtaacggttaaaccgtaaacgggtaaccgttgggtacggtccgtacggtaccctaaccgttacttacgttccgtttaccgttaccttaccgtttcccttaccccggtaccttacgttcctagtacttaacttaacgttacgtttcggttacgttcggtacggtccgggttcggtaccggtacggtaaccgggtcgacgtacgg

SEQ ID NO: 289336 - DNA, 669 bp, Homo sapiens
  misc_feature: GYAE6OF02GNNDL.44.75.G09.1.454.CMB.1.raw
tcagacagtatatacacgaccggtgctcgatttagtatagacatcaggggaggaatcagacccagtcaggacacagcatggacatgagagtcctcgctcagctcctggggctcctgctgctctgtttccccggtgccaggtgtgacatcgagatgacccagtctccgtcctcactgtctgcgtctagttggggatagagtcaccatcacttcggccgggcgaggtcgaccgactagtttaggtacttttttcggccttggttcagcgaggatccgtggacaaaccgtccccctaagtcccctgtacttcgtttttcgaggtacttccctactttaggaagtggtggacgtcccgagcccgtaggttcgaacggccggtacgtaggttcgggtttccgaggggtaacctaacgttacgtttacctaacgtcctaccgacctactccgagccacgtccctaggcgaccgtcgtagggacttacgtttcggacttaacgtttactaccgtagaacccaactaatttactttactttttacgtacccgttagtttacgtttcgggaccggtacgggtaacctacggacgttaggagtacgtaacggaaacggtacttagggtcggtacgtcgaccgtacgttacgttctacggtttcttacctccgttccccg

SEQ ID NO: 289337 - DNA, 652 bp, Homo sapiens
  misc_feature: GYAE6OF02JO7R6.44.75.G09.1.454.CMB.1.raw
  modified_base (231)..(231): a, c, t, g, unknown or other
  misc_feature (231)..(231): n is a, c, g, or t
  modified_base (290)..(290): a, c, t, g, unknown or other
  misc_feature (290)..(290): n is a, c, g, or t
  modified_base (364)..(364): a, c, t, g, unknown or other
  misc_feature (364)..(364): n is a, c, g, or t
  modified_base (585)..(585): a, c, t, g, unknown or other
  misc_feature (585)..(585): n is a, c, g, or t
  modified_base (632)..(632): a, c, t, g, unknown or other
  misc_feature (632)..(632): n is a, c, g, or t
tcagacagtatatacacgaccggtgctcgatttagtatagacatcagggacttaggggctttgccaggctcctgctgctctgtttcccggtgccaggtgtgacatcgagatgacccagtctccgtcctcactgtctgcgttctagttggggacagagtccaccaatccacttggcccgggtcgaggtgccgacgtatttagggtactttttttgggaccttgggttttacngacgaggtacgccgtgggacaaacggtccccctaagttcccctggactttccttttcgnggtaacttacctacgtttagaagtacggtgacgtccagcctaggttcaggcgcgtaggtggttcaggactactntttcactcctcaccgtatacgcgactacgcctggacgacgtcgtaggtatacgtttcgcgttaacttagttaccgtacaccctaattactttactttacttttttacctcggttaacttacggttttcggaccggtaacgggactaagtacggaggtacgtaccggacgtaacggtagttcgtagtcgtcacacgtactcttcgtcttacacgttcctccncttctactgaacttctaacgttctcgtcggttgcggacgggttaccngggcgtaacggcgtctacgg

SEQ ID NO: 289338 - DNA, 697 bp, Homo sapiens
  misc_feature: GYAE6OF02GHYFW.44.75.G09.1.454.CMB.1.raw
  modified_base (265)..(265): a, c, t, g, unknown or other
  misc_feature (265)..(265): n is a, c, g, or t
  modified_base (382)..(382): a, c, t, g, unknown or other
  misc_feature (382)..(382): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttggggacagagtcaccatcacttggccgggcgagtgccgacattaggttacttttttggccttggtttcagcaggagcccgtggaccaaacgcccctaacgtccctgtattcttttcgnggtactcctactttgaagtaggtggacgtaccccaggccctaggttcaggtccggcaggttggttcgtagggaccacgtactttccactccttccacctattcacgcacgcctgacncgtcctgggtaagtagtttccgacggtactttaacttacgtacgaccgtaaactaactttacttttacttttttactacccgtttacgttcgtttttacgggccggtaaccggggtaccctaacggtacgttcgggaacgtacgttaaacgtaaacggttaacgttggtacgtcgtacgtcctaaccgtcttacgtttcgttaccgttactacttcccttccccgtacgtacttcgtacgtactaacttaacgttacgttcggttacgtacggtcggaccggttcggtcgggaaccgtacgggtacgtcgttaag

SEQ ID NO: 289339 - DNA, 989 bp, Homo sapiens
  misc_feature: GYAE6OF02FWKO6.44.75.G09.1.454.CMB.1.raw
  modified_base (110)..(110): a, c, t, g, unknown or other
  misc_feature (110)..(110): n is a, c, g, or t
  modified_base (178)..(178): a, c, t, g, unknown or other
  misc_feature (178)..(178): n is a, c, g, or t
tcagacagtatatacacgaccggtgctcgatttagtatagacatcagggacttaggggctttgccaggctcctgctgctctgtttccccggtgccaggtgtgacatcganatgacccagtctccgtcctcactgtctgcgtctagttgggacagagtcaccatcacgttggcccgggngagtcgccgaactagtttaggtacttttttgggcccttggtttcaggcgaggacgccgttacggaccgaaaccgtcccccgttaaacgtccccgttaggtactttccgtttttaccgtacgggtacttcccgtaacgttttaggaacggtaaggttcgggtaacggtaccccgaacgcccggttagggtttaccgaacggtcccgggtacgtaacggtttcggggttttaccggtacgggggtaaccctaaccggtttacgttttacccgaacccgtttaccccgttaccgtaacccccgtaaagttcccgttaaaccgggaccgtaaccgggtaccccggttaccggtacccgaccgggttaccccggtagggttaaccggttaacgtttttaccccgggggaacgttttaaaccgttttaaccgtttaacccggtttacgggtaacccccttaaaaacggtttaacttttaacccgttttttaccgttttttttaacgtttaccccgggtttaaacgttttacccgggtttttacggggaccccggggttaaacggggtaacccgtaaacgggttccggttaaacggggaaaccgttaaccggtaaacggttaaaacccggggtaacgtttcgggaacgggtttaccgaccggttaacccgaccgttacgttcccgttttacgttccgtttacctacgttccccgtttaccgtacctacgttaccgttagaaccgtttattaccgtaacgttccggtaaccgtacggtacggtacgggtacgtacgggaccggtacggtcgacttacgg

SEQ ID NO: 289340 - DNA, 800 bp, Homo sapiens
  misc_feature: GYAE6OF02FOMOL.44.75.G09.1.454.CMB.1.raw
  modified_base (235)..(235): a, c, t, g, unknown or other
  misc_feature (235)..(235): n is a, c, g, or t
  modified_base (314)..(314): a, c, t, g, unknown or other
  misc_feature (314)..(314): n is a, c, g, or t
  modified_base (794)..(794): a, c, t, g, unknown or other
  misc_feature (794)..(794): n is a, c, g, or t
tcagacagtatatacacgaccggtgctcgatttagtatagacatcagggacttaggggctttgccaggctcctgctgctctggctcccaggttcgagatgtgacatcgagatgacccagtctccttccttcctgtcttcttctgtttgggaggcagcgtcaccatcacttggccgggcgagtcgaggttcgtttttcggtgctgttcgccttggtttacaaacgaaaaggggggnacggtcccctaaggtcctcgtctcgtcgtacgaaaccagctagggaaggtagacgtcccgtctaggttcagtcgaccgngtccgagggtgggcgggccggacgtccacttccgtacctaaccgtagtttacggaccgtaccgtgggccgggtccgtaggtaacgtactttcctcggaccttaactttttagttttccgttagtaccgacggtactaggttaacgttcctaacgtttacggttccccgggtacccccgttttacgtttaccgtttttccggggacccggtaacgggggtaacccgtaacggtaccggttaagggtaaacttaaacccgtaaaaccggtaaccggttagggtaccggtaccgtacgtaccgtaaccgttaccggttctttacggttcctttaccgtaccgtttcccgtttaccccggtaccctttacgttaccgttacgttaagttaacgttactttaaccgttcggttaccggttcgggtaaccgggttccggggttaccgccggggttaacgaccgggtccggtaaccgtaggttacgntagtcg

SEQ ID NO: 289341 - DNA, 640 bp, Homo sapiens
  misc_feature: GYAE6OF02HLVPT.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagccgtggcaaacgcccctaaagtccctgacttcttttcgtggactcctactttgaagtagtggacgtcccagccaggttcagcggcaggtggttcgtgggaacactatttcacctctacaccatcagcagcctgcagcgtggacgtagtttcgacgtactttatacgtcgaccaaactaatttacttttactttttactaccgtttacgttacggttttacgggaccgtaacgggaacctaaggtcgtagggaacgtaagtaacgtaaacgggtaacttaggtcggtactacgacaaccgtattccgtcgttacttactacttcccgttacccgacctacgttacttagaactttacttaagttaccttcggttacgtacggtacggcggggttacgtacggaccgaaggtccgaagtacg

SEQ ID NO: 289342 - DNA, 835 bp, Homo sapiens
  misc_feature: GYAE6OF02FKV5T.44.75.G09.1.454.CMB.1.raw
  modified_base (390)..(390): a, c, t, g, unknown or other
  misc_feature (390)..(390): n is a, c, g, or t
tcagacagtatatacacgaccggtgctcgatttagtatagacatcagggacttaggggctttgccaggctcctactgctctgtttccccggtgccaggtgtgacatcgagatgaccctagtctccgtcctcactgtctgcgttcttagttgggggaacagagtccaccatcacttgccgggcgagtcgccgtactagttacggtacttttttggccgttggtttcagtcagggacgtccgtgggaccaaacgtcccccgttaaagtcccgtgtacttcgttttcgtggtactccgtactttaggaaacgtgtggtacgttcccgaggtccgaaggtttccgaggtcggtcttacgggttcgtcggtacgggacctacgttacgttttccnctaccgtctaaccgtatccagtcctaacgtcccgtgaccgtacgtccgtaacgggttacgttacgtttcggaaccgttacgtttacttaaccggtcgtaacccttaaaaaccgtagtttttaactttttaccggtttttaaaccgttaccggtttaaccgtttaacggggtttttaccgggtacccggtaaccggggtaacccgtaacgggttaccgttagggggtaaccttacggttaaccggtaaacgttaccgggtttaacggtcgttaccgtacgtaaccgtaacgtacgttcgttacggttacctttccgtaacgtttcccgttcccgtaccggttctaccgttcgttaacgtttaacttaccgtttacggttcgtaccgttacgggtaccgtacgggttccgaacgggttaccgtaagggtccgttaacgtagttacgg

SEQ ID NO: 289343 - DNA, 772 bp, Homo sapiens
  misc_feature: GYAE6OF02HAB3I.44.75.G09.1.454.CMB.1.raw
  modified_base (166)..(166): a, c, t, g, unknown or other
  misc_feature (166)..(166): n is a, c, g, or t
  modified_base (247)..(247): a, c, t, g, unknown or other
  misc_feature (247)..(247): n is a, c, g, or t
tcagacagtatatacacgaccggtgctcgatttagtatagacatcagggacttagggctttgccaggctcctgctgctctgtttccccggtgccaggtgtgacatccagatgacccagtctccttccctccctgtctcgtcttctagtaggagacagagtcgccancactgccgggacaacgtcacgacctaattaacagtacttaatttaaagttggtaactcagcaagacgaccgaagggaaacncccctagaacctcctagactcgtctcgccttgaccctccactacgtcgacgaggtggacgtcttcgttacgaagtttcgaagtcggtacgtagtacggattcgtacggtacgtaacgtactttctaacgttcctacaaccttactcctaccgtactccgtacgaccgtaaccgtagtaacgttatttacgtaaccttaacggttacctaactcgtaacctaagtaacgttacgttaactacgtaccgttcccctttacgttacggttttaccgggacgggtaacacggtacgtaacgttaactaaaccgaacgtacgtacggtacggtactaccggacctacccgtacgtttacccgttaggtttaccctttacgtaacccgtttacccgttaccccgttaccgttaccggttaacccggtttaacgtaacgttttaaacccgttaaccgtttacggttaaccccgttagggtacccgggtacccgggtttacggtacggtaacccgggtaaccgggttaacccg

SEQ ID NO: 289344 - DNA, 703 bp, Homo sapiens
  misc_feature: GYAE6OF02HKFRM.44.75.G09.1.454.CMB.1.raw
  modified_base (154)..(154): a, c, t, g, unknown or other
  misc_feature (154)..(154): n is a, c, g, or t
  modified_base (269)..(269): a, c, t, g, unknown or other
  misc_feature (269)..(269): n is a, c, g, or t
  modified_base (375)..(375): a, c, t, g, unknown or other
  misc_feature (375)..(375): n is a, c, g, or t
  modified_base (618)..(618): a, c, t, g, unknown or other
  misc_feature (618)..(618): n is a, c, g, or t
  modified_base (689)..(689): a, c, t, g, unknown or other
  misc_feature (689)..(689): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtactagttgggganagagtcaccatcacttggccgggacgagtgccggacattaggtacttttttcggccttggttcagtcgaggacgtcctggacaacgcccttaacgtccctagtacttcttttacngggtactccttacgttaggagtacggtggaacgtcccagccgtaggttaccgaggtccgcgtaggttccgttactgggactacttacgttctacgtctactaaccnttacgacgctacgtcccgtagaccgtaggccgttaggagttacggttttccgaccggttaactttacttaccggtacaaccgtaaactaagtttaacgtttttcttttacgtacccgtttaggtacggttttacgaccgtaggacctaggtacgtacggtagtaccgaaacggtaacggtacctaggtcgtcgtacgacctaaccttacgtcgtaccgttcgttacctcttaccccggttccnccgttgtaacctggtaaccttgtacgttaccgtgttaccggttagaccgtgggtacggttaccgagggacnccgggttacaacgg

SEQ ID NO: 289345 - DNA, 733 bp, Homo sapiens
  misc_feature: GYAE6OF02G42LR.44.75.G09.1.454.CMB.1.raw
  modified_base (223)..(223): a, c, t, g, unknown or other
  misc_feature (223)..(223): n is a, c, g, or t
  modified_base (670)..(670): a, c, t, g, unknown or other
  misc_feature (670)..(670): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcgaccatcacttggccggcgaggtgccgacattaggtacttttttggccgttggtttcagcagganccgtggacgaaacgccctaacgtccctagattccttttctggactcctaactttggaacgtagtggacgttcccgagtcctaggttcagggtccgcgtaggtggtttcgacgggactagtactttcgaactcctcgaacctatcgacgtacgacgccgttacgacgacggtaccgttagggacttaagtttcccggaacgtaaccttttaaagttacctagtaacccgtaaacgttaaacgtttaacttttaccgttttttacttacccggtttaacttacggttttaccgggaccggttaaaccggggaaccgtaaaggttccggtaacgggtagtaaaccgttaacgtaaaacggtaaccgttggtaacccggtgtaaccgccgtaacctaacgttacgttccgttacttaccgtactttccgtacccgtcctaattcccgttanactttagtaactacgttgtaacttcggacggtacgtcggacgtaacggacggtacgtactacg

SEQ ID NO: 289346 - DNA, 749 bp, Homo sapiens
  misc_feature: GYAE6OF02JJCJ1.44.75.G09.1.454.CMB.1.raw
  modified_base (280)..(280): a, c, t, g, unknown or other
  misc_feature (280)..(280): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctatggggacagagtcaccatcacttgccgggcgagtcgaccgactagttaggtacgttttttggccttgggtttccagcctaggacgcctggaccgaaaacgcccccttaaacggtcccctagtacttcctttttcgnggtacttcccgtacttttgaaacggtagtgggacggttcccccaggtaccctacggtttaccaggccgggactaggttagggttccgttaggggacctaaccgtatttaccactccttaccgacctatccacggtccacgtcctagactacgtccgtaggacgttacgttttccggacgtactttaacttaccgtacgtaaaccaaaaattttcgtttaacttttttactccgttaactttacggttttcggtacccgtacggggtaaccgtacggtacgttacgggtaagtacgtaacgtaaacggtacgttagtacgggtcgacgtaccacctaacgttcgttacgtccgttacttaccttcccgttccccgtaccgttaccttacgtacgttacttacctaacgtttactacgttacgtcggtcgggtaccgggtccgtcgggaccgtacggcccgtagactacgg

SEQ ID NO: 289347 - DNA, 687 bp, Homo sapiens
  misc_feature: GYAE6OF02GMF8Q.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgactattaggtacttttttggccttggtttcagcaggagcctggacaaacggcccctaagtccctgattcttttctggactccactttagaagagtggtagtccccagccaggttcagcggcagtggtctgggacactatttcacttctcaccatcagcagcctgcacgcccgtagggagtacttttccggacgtaaccgtttattaaccgtcgtaaccctaaactaaactttacttttacttttttacttacccgttacgttaggttttcggtaccggtacggggtaaccgtaacggtaccgtagggaacgtagtaaacgtaaacggtaacgttaggtacggtacgtcggaccgaaccctacgttaccgttacgttcctttacgttaccttcccgtttccccgtacctaacgtttccgtataacttaacgttaacttaaccgtttcgttacgtacggtacggcggggttccgtacgggtaccgaacgggtaccgtacgtaacgg

SEQ ID NO: 289348 - DNA, 659 bp, Homo sapiens
  misc_feature: GYAE6OF02GHGSK.44.75.G09.1.454.CMB.1.raw
  modified_base (262)..(262): a, c, t, g, unknown or other
  misc_feature (262)..(262): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (338)..(338): a, c, t, g, unknown or other
  misc_feature (338)..(338): n is a, c, g, or t
  modified_base (571)..(571): a, c, t, g, unknown or other
  misc_feature (571)..(571): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtcctgcgtctattggggacagagtcaccatcacgttgccgggcgaggtgccgacagttaggtacttttttggccttggtttcagcaggacgcctggacaaacgtcccctaagtccctgattctttcgngactctactttgaagagtggactccagccaggttcngcggcngttggttcgtgggacactattcactcgtcaaccntacacgcacggcctgccacgcctgacttgtattttcacgtaaactttacgttacctacgtaaccctaactaagttacgttaaagtaacgttttaactttcgtacgttaacggtttaggttttaccgggacccgttaaaggggaacccaaggttcggtagggtaacgtaacgtaccaaaacgtacgtgtacgtctcgactactagttctcgttctactacctcccgttaacccnccttacgttacgtacgtacgttaacccttaagttacctttgaccggtttcggaccgggttaccggcgggttaacgaccggtaaccggg

SEQ ID NO: 289349 - DNA, 653 bp, Homo sapiens
  misc_feature: GYAE6OF02H5WYF.44.75.G09.1.454.CMB.1.raw
  modified_base (265)..(265): a, c, t, g, unknown or other
  misc_feature (265)..(265): n is a, c, g, or t
  modified_base (290)..(290): a, c, t, g, unknown or other
  misc_feature (290)..(290): n is a, c, g, or t
  modified_base (298)..(298): a, c, t, g, unknown or other
  misc_feature (298)..(298): n is a, c, g, or t
  modified_base (599)..(599): a, c, t, g, unknown or other
  misc_feature (599)..(599): n is a, c, g, or t
  modified_base (650)..(650): a, c, t, g, unknown or other
  misc_feature (650)..(650): n is a, c, g, or t
tcagacagtatatacacgaccggtgctcgatttagtatagacatcagggacttaggggcctttgccaggctcctgctgctctgtttccccggtgccaggtcgtgacatcgagatgaccagtctccgtcctcgactgtctgcgtctagttggggacagagtcaccatcacttgccgggcgagtgaccgactattaggtactttttttcggccttggtttccagtcaggtagcctggacaacgccctaagtccctgtattcttttcngctcctacttgagtgtggactccgnccagttcngcggcaggtgttcgtaggactactacgtttcacctcttaccaaccgtatcgacgacctacgtcctacgctacggtccgtaggtaacgtacgttttcggaccttacgtttactttactcgaacctaaacttacgtttactttttaccgtttttactacccgtttagtttcgggttttaacggaccggtaacgggacgtaacgtccggtaggtaactaaacggttaacgtaaacgggtattcggtagtacctcggacctacgtatccgtacgttcgtacttaccgtcctcccggactacgttntagtattactaattcttaggtcttgaccggtcggtcgaggacgtacggtancgg

SEQ ID NO: 289350 - DNA, 985 bp, Homo sapiens
  misc_feature: GYAE6OF02GR4VM.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgaccgactattaggtacttttttggcctggtttcagcaggagccgtggacaaacgcccctaagtcccctgtacttcttttcgtgtactcctaacgtttgaagtaggtcggacgtaccccgagaccgtaggttacacgcggacctaaggttcggttcgtacgggacctaacgtacttttaccaaccgttccctaaccgtaaccctaacgttaccgaacggtaccgtaacggtaccccgttacggacccgtaacgggtaccccgttaggggtaaacggttaaccgtttttaccgggaacccggtttaaccttttaaacgttttaacccgtaccggtaaacccttaaacgttaaaacgttttaaccttttttaacccgtttttttaacgtaacccccgggttttaaaccggttttaaacgggttttttaaccccggggaccccgggttaaacggggggtaaaaccccttaaacggggtacccggtttaccggggaaaacggttaaccgttaaaacccgggtaaaaacggggttaaaccggtttacggggttacgggtaacccgttacgggtaaccccgttaaccgttaaccgtttacccggtttacgttttacccgttttaaccccggttaaaccgttttcccccggtttaacccccggtaaccccttaaggtttacccggtttaacggttaaactttaaccgtttaaactttaccggtttaccgttaccgggttacggggtaacccggggttacggggtacccggttacgggggaacccggtaacggggttaccgtaccgttaaacgg

SEQ ID NO: 289351 - DNA, 692 bp, Homo sapiens
  misc_feature: GYAE6OF02F9325.44.75.G09.1.454.CMB.1.raw
  modified_base (315)..(315): a, c, t, g, unknown or other
  misc_feature (315)..(315): n is a, c, g, or t
tcagacagtatatacacgaccggtgctcgatttagtatagacatcagggacttagggctttgccaggctcctgctgctctgtttccccggtgccaggtgtgacatcgagatgacccagtctccgtcctcactgtctgcgtctagttggggacagagtcaccatcactttcggccgggcgagtgaccgacagtttaggtactttttttggccttggtttcagcgaggacgccgtggaccaaacgcccctaagtccctgtacttcttttctggactcctatttgaagtaggtggacgtccagtctaggttcagcgtnagttggttcgaggacactacttcactctcacatccagactgcctgcacgtcgtagacgtagtttcgacgtaatttacgttaactacgaacccttaaactaactttacgttttacttttttacgttacgttacgtttaggtttacggtaccggtaacgggtaaccgtaacgtacggtacggtaagtaacgtaacgaaaggtaacgttcgtacgtcgtacgacctaccgggggggtacttcgttacgttacttaccgttacctttcccgttacccgtaacctaccgttacttacgttaacgttaacttacgtttaccgttacggttacgttacggtacggtacggtcgggtaacgggtaacggacggtaccgtagtacg

SEQ ID NO: 289352 - DNA, 687 bp, Homo sapiens
  misc_feature: GYAE6OF02IQ9MQ.44.75.G09.1.454.CMB.1.raw
  modified_base (260)..(260): a, c, t, g, unknown or other
  misc_feature (260)..(260): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgtgtctattggggacagagtcaccatcacttggccgggcgagtgccgacattaggtacttttttggccttggtttcagcgaggacgcctggccaaacgcccctaagtccctgacttcttttcnggtactcctacgtttgaacgtgtacggacgttccccgtaaggcctaggttaccacggcggacaggtttcggtcggtacgggactacgtactttcgaccttctactacccgatcgtagacctagacctgacgtacggccgtagggacgttacgtttccggacgttacttaagttaccgtcgaccctaaagtaatttacgttttcttttttacgtacccgtttacttacgggttttcggaccggtaagggtacccaacgggtcttagggatacgttaacggaacggttacgttcgtacggtacgcgtacctactacgttacgttcggttaccgtcttaccttcccgtcccgtactacgttcgtgttactagtaccttagtcgttccgtaggacggtccggggttacgtggaccggtaacgcgtactacg

SEQ ID NO: 289353 - DNA, 795 bp, Homo sapiens
  misc_feature: GYAE6OF02JRCXV.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatcgacccagtcctccgtcctcactgtctgcgtctagttggggacagagtcaccatcacttgccgggcgagtcgaccgactagttaggttacttttttcggccttgggtttcagcgaggagcctaggaccaaacggtcccctaagtccctgtactttcgtttcgtggactcctactttgaagtagtagacggtacccagccgtaggttcaggcgaccgtaggttggttcggtaggactacgttacgtttacctaccgtactcccgtacctactaccgaagtcccgaagtcctacggaccgacggtcccgtaagggtcgtacgtttcgaccttacggtttacttacgtacctaaccgtaaacgttactttaaccgttttaccgtttttacttaacccgttaacgttttcgggtttaccggtaacccggtaaccggggtaaccttaacggtccggttacggtaaacgtacggttaaaacccggaaaggttaccggtttacgacgggtaacgttacccggaccgttaaccctacggttcctttacggttccgtttaaccctccgttttaacccccgtccctaaaccggttcttaccgggttactacgtttaattcccgtaaagtttcgtaaccggtaccggggttaccggccgggttagacccggttacgacggtacggtacccgtag

SEQ ID NO: 289354 - DNA, 791 bp, Homo sapiens
  misc_feature: GYAE6OF02G0I8P.44.75.G09.1.454.CMB.1.raw
  modified_base (726)..(726): a, c, t, g, unknown or other
  misc_feature (726)..(726): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcaactgtctgcgtctagtgggacagagtcaccatcacgttgccgggcgagtcgccgacagttaggtactttttggccttggttcagcgagacgccgtcggtacaaacgcccctaaacgtcccgtagtacttacgttttacgtcggtactacctaacgtttacgaagtacgtacggtaacgttaccccgaagtacccgtaaggttcgaacggtccggtaaccgtaggttcgggttacggtacgggaaaccgtaaccgtaagtttttaccgaaccgttacctacccgtaaacccgtaataccgtaaggaccgtaacgtccgttacgaccgacgggtacccgtaagggaacgttaacggtttacgaaccgttacgttttaaacgttaaccgtacgtaaaccctaaaacgtaatttaacctttttacgttttttaaccgtacccgtttaaagtttaccgggttttaacgggaacccggttaacggggaaaccctaaacggtcgtaaacggtaacgtaacgttaaacggtaaacgttacgtaggtacgtacctacgaccgaacgtactcgtacgttctaccgtcgttaccgtcccgtacgtntactgtaactacgttaacgtacttagtcgtaggtcggacgtacggtcgacgacggtagacgtagg

SEQ ID NO: 289355 - DNA, 927 bp, Homo sapiens
  misc_feature: GYAE6OF02H25FM.44.75.G09.1.454.CMB.1.raw
tcagacagtatatacacgaccggtgctcgatttagtatagacatcagggacttagggctttgccaggctcctgctgctctcgtttccccggtgccaggtgtgacatcgagatcgaccagtctccgtcctcactgtctgcgtctagttgggactagagtccaccatcctagttcggccgggcgtaggtcgccgtacagttacggttacgttttttcggcccttgggtttaccaggtccgagggtactccgtacggtacctaaaccggtccctaaacgttcccgttgaactttctttcgacggtacttccgttacgtttgaacgtacggttcggtaccgtacccgtacggtccgtaggtttaccgaaccggtccggttacgtaacggtttcgggttacgtccgggtaaaccttacgtaaccgtttccgtaacttaccgttaccaccgttaactcgacggtactacgccgttacgaccgcgtcgtacggagttcttacgacgtttacttagtaccgtacgtaaccgtaaacgttacttttactttacgttttaccgtaccgttacgtttacgggttttaccggacgggttaaaccgggttaaccgtacgggttaccgcgggttaaaccgtaacggttaaacgttaaaacgggttaacgtccgggtttaaacgtaccgaacccgggtttaaccgaacccggttttaccggtaccggttttacccgttttaccgtttaacccgttaaccggttacccccgtttaccggaacccgttttaaccgttaaccggtaccggttttaacggtttaccctttaacccgggttttaaccggttccggtttaaacccggttacgggttaaccccgggttcgggtttaacccgttaaccgggttaccgggttaaaccggttcccggttaaccggttaacgg

SEQ ID NO: 289356 - DNA, 702 bp, Homo sapiens
  misc_feature: GYAE6OF02G1LMQ.44.75.G09.1.454.CMB.1.raw
  modified_base (264)..(264): a, c, t, g, unknown or other
  misc_feature (264)..(264): n is a, c, g, or t
  modified_base (335)..(335): a, c, t, g, unknown or other
  misc_feature (335)..(335): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttggccgggcgagtgccgacattaggtacttttttggccttggtttcagcaggagcctaggccaaacgccccctaagtccctagtacttcttttacgnggtaactcctactttagaagtaggtggacgtcccgaagcctaggttcacggtccggctaggtcggtttcgngggtactactaagtttccacttcctccgaaccacttaccagtacgacgccgttcgcgacggtccgtagggtagtacgttttcgacgtaacctttagttaccgtacgaaccgtaaactaactttacttttaccttttttacgttaccgtttaacgttacggttttaccgggaccggttaacggggaaccctaaagtcggtagggacgtaattaacggaaacggtaacgtgggtcgtacgtacggacctacgtattcctacgttaccttctacgttccctacccgtccacgttctagttactaagttacgttactacgttacgtggtacggtacgggtcggttacggaccggtacggacggtataccgg

SEQ ID NO: 289357 - DNA, 668 bp, Homo sapiens
  misc_feature: GYAE6OF02GHJ17.44.75.G09.1.454.CMB.1.raw
  modified_base (145)..(145): a, c, t, g, unknown or other
  misc_feature (145)..(145): n is a, c, g, or t
  modified_base (362)..(362): a, c, t, g, unknown or other
  misc_feature (362)..(362): n is a, c, g, or t
tcagacagtatatacacgaccggtgctcgatttagtatagacatcaggggaggaatcagacccagtcaggacacagcatggacatgagagtcctcgctcagctcctgggctcctgctgctctcgttcccggtgccaggtgtgacntcgagatcgaccagtctaccgtcctcactgtctgcgtctagtgggacagacgtccacatcacgttcggccggacgtagtcgacatagttagtacgtttttcggcttaggttcacgtgaaggagtccgaggacaacgacccctaacggtcctgtacttcttcgaggtactaccgtatttaggaagtaggtcggtacgtccgaggtaccgtaggttacncggacgtacgtacggttcggttcgagggtaactacgtacttaccgtcgttactacctaccgtactacgacgtaccgtaacgtccgtacgccgtaacgcgtaaggtaacgttcctttaccggaacttacgtttaactaccgtacgaacctaaacttaagtttaccttttacttttaccgaccttacgttagtttccggaccgtaagggtaacccaagtcggtagacgttaacgaagtaaacggtaacgttggtaccgtagtacgaccgtaacgttcttaaccgttcgtcgtttactaccgttacccc

SEQ ID NO: 289358 - DNA, 756 bp, Homo sapiens
  misc_feature: GYAE6OF02GT17C.44.75.G09.1.454.CMB.1.raw
tcagacagtatatacacgaccggtgctcgatttagtatagacatcaggggaggaactcagacccagtcaggaccacacgcatggacatgagagtcctcgctcagctacctggggctcctgctgctctcggtttccccgtgccaggtgtgacagtcgagatgaccagtcctccgtctcactgtctgcgtctagttcgggacagagtccacctatcgtaccgttggcccggggacgaggtcggcccgaagtaacgtttaaggttaccgttttttggaccgtttgggtttaccacggtcgaacgggtaacgtccgtaggaaccaaaccgtaccccgttaacggtccctagtactttccgttttacgtacggtacttccgtacgtttagaacggtacggtacggtaccgtacccaacggaccgtacgggttacgacggtccggacgttagggttcgggttacgtacgggtaacctaacgttactttaacctacgttccgtacctacctacgtacacgtccgaccgtccgtacgacgtacggtccgtaggacgtacgtttccgacgttacttacttacgtacgaacctaactactttactttactttaccgtaccgttacgtacggtttcggacgttaacgggaccgtagtcgtacggtacgtacgacggtaaaccggtaggttacggtacgtaccgtacgtaaccgtaacccgtacggtttacccttacggtttacccttaccggttaacctttcccccg

SEQ ID NO: 289359 - DNA, 596 bp, Homo sapiens
  misc_feature: GYAE6OF02FTQCX.44.75.G09.1.454.CMB.1.raw
  modified_base (224)..(224): a, c, t, g, unknown or other
  misc_feature (224)..(224): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
  modified_base (583)..(583): a, c, t, g, unknown or other
  misc_feature (583)..(583): n is a, c, g, or t
  modified_base (590)..(590): a, c, t, g, unknown or other
  misc_feature (590)..(590): n is a, c, g, or t
  modified_base (593)..(593): a, c, t, g, unknown or other
  misc_feature (593)..(593): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcaacaaaaagggggnaggcccctaaggtcctcgtctctcgtgaaaccagactggaaggtagagttcccgtccaggttcagtgccagtccaggtggtgggccggagtccacgtctcaccattacgcgacctgcgcctgaagnttcngcaactttattcngtcagcagtatcatagtcnccccgttanacttttggccgaggggaccaagctaggaaatacaaacgaactggtgactgacacaatccgtgtccttcaacgttccttcccgacctagttccttagtaacttaagtaactttacgtacgttccgttacggtaacgggtccggggtaccgttacgggaacgtaaaccggggaccgtacacggttaacgngtaccgngtnacg

SEQ ID NO: 289360 - DNA, 659 bp, Homo sapiens
  misc_feature: GYAE6OF02FX9KO.44.75.G09.1.454.CMB.1.raw
  modified_base (280)..(280): a, c, t, g, unknown or other
  misc_feature (280)..(280): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
  modified_base (347)..(347): a, c, t, g, unknown or other
  misc_feature (347)..(347): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgactattaggtaccttttttggccttggtttcagcgaggacgcctggacaacgcccctaacgcccttgattcttttcgtggactcctacgtttgaagnggtgacgtcccagccaggttcagcggacaggtggttctgggacactatttcactcncaccatcancncgtcctgcacgcgtaggacgtactttcgcgtaactttactactcgacccaaagtatttactttactttttacgtccgttaacgtacggttttcggaccggtacgggtaacctaaaggtccgtagggtacgaacgtacgaaaacgggtacgttacggtcggacctagtacccgaacctaccttcgttaccgttccgtttactaccttccccgttaccccgcttactccgtacgtacttaagttaacttacgtttcggtacgttacgggtaccggtcgggttccgtagggtaccggacgggtaccgtcggtaag

SEQ ID NO: 289361 - DNA, 535 bp, Homo sapiens
  misc_feature: GYAE6OF02FRJLD.44.75.G09.1.454.CMB.1.raw
  modified_base (268)..(268): a, c, t, g, unknown or other
  misc_feature (268)..(268): n is a, c, g, or t
  modified_base (342)..(342): a, c, t, g, unknown or other
  misc_feature (342)..(342): n is a, c, g, or t
  modified_base (378)..(378): a, c, t, g, unknown or other
  misc_feature (378)..(378): n is a, c, g, or t
  modified_base (422)..(422): a, c, t, g, unknown or other
  misc_feature (422)..(422): n is a, c, g, or t
  modified_base (522)..(522): a, c, t, g, unknown or other
  misc_feature (522)..(522): n is a, c, g, or t
  modified_base (530)..(530): a, c, t, g, unknown or other
  misc_feature (530)..(530): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaagcccctaagtccctgatcttttctggatccactttgaagngtggagtcccagccaggttcagcggcagtggtctggacacatttcatctcaccatcagcagctgcagcctgganattttcgacgtacttattactgccaaacaatacttntttttactcgtactagttttcggcaggggacctaagcgttgganatacaaaggactgtggctgactacattctgttcttctaatccttacccgcctatcgtgaacttaagtacttacgtcgtctggagcggggtctacgggtanaacgggtncgtag

SEQ ID NO: 289362 - DNA, 637 bp, Homo sapiens
  misc_feature: GYAE6OF02HEJEQ.44.75.G09.1.454.CMB.1.raw
  modified_base (333)..(333): a, c, t, g, unknown or other
  misc_feature (333)..(333): n is a, c, g, or t
  modified_base (388)..(388): a, c, t, g, unknown or other
  misc_feature (388)..(388): n is a, c, g, or t
  modified_base (401)..(401): a, c, t, g, unknown or other
  misc_feature (401)..(401): n is a, c, g, or t
  modified_base (597)..(597): a, c, t, g, unknown or other
  misc_feature (597)..(597): n is a, c, g, or t
  modified_base (631)..(631): a, c, t, g, unknown or other
  misc_feature (631)..(631): n is a, c, g, or t
tcagacagtatatacacgaccggtgctcgatttagtatagacatcagggacttaggggctttgccaggctcctgctgctctgtttccccggtgccaggtgtgacatcgagatgaccctagtctccgtcctcactgtctgtcgtctagttgggacagtagtcaccatcacttggccgggcgagtcgccgaacatttagggttacttttttggccgttggtttcagcgaggagctcggacaaaccgcccctaaacgtccctgtactttccttttacgacggtactcctactttaggaaggacggtgggtacgtccccgtagccgtaggtcgacgnggtctaggttgggttccgagggaactactcgttacctctcctaccactataccgncacgtcctcgacngtccgtggattccttcggtacttattacttacgtccgaacaacttaatttcttttacttttacttacccgttagtttacggtttcggaaaaaaaaaaacggcgggtaacgacgtacgagacgtacacgaaagtacgtagtcgtacgtcacactactcgtctcctcttaccgtcctaccctcttctactctaacttntcgtagttcgtgagtcggacggtcgtggacgagngactac

SEQ ID NO: 289363 - DNA, 710 bp, Homo sapiens
  misc_feature: GYAE6OF02JR9GP.44.75.G09.1.454.CMB.1.raw
  modified_base (177)..(177): a, c, t, g, unknown or other
  misc_feature (177)..(177): n is a, c, g, or t
  modified_base (221)..(221): a, c, t, g, unknown or other
  misc_feature (221)..(221): n is a, c, g, or t
  modified_base (256)..(256): a, c, t, g, unknown or other
  misc_feature (256)..(256): n is a, c, g, or t
  modified_base (304)..(304): a, c, t, g, unknown or other
  misc_feature (304)..(304): n is a, c, g, or t
  modified_base (664)..(664): a, c, t, g, unknown or other
  misc_feature (664)..(664): n is a, c, g, or t
tcagacagtatatacacgaccggtgctcgatttagtatagacatcagggacttaagggctttcgccaggctcctgctgctctgtttccccggtgccaggtgtgacatcgagatgacccagtctccgtcctcactgtctgacgtctattgggacagagtcaccatcacttcgccgggngagtgccgacagttaggtactttttggccttggtttcagcaggngcctggacaacgccctaagtccctgacttcttcgngactctatttacgaagtgtcgacgtccagacctggttacgaggccggngtaggttcggttcggtaggtaacgactagttttaccgaccttctaccgaacctagttaccaagggtccaacggtcccctaggacccgtacggtacccgtagggtacgttaacgtttccccggagtttaaccttacgttacgtacgtaccctaactaactttacgttttacttttaccaccggtttacgttacggttttaccgaccggtaacgggtaaccagttccgtaggaacgttacgaaccgttaaaggaccgttacgggttacgaccgtacggtaccgttaacgcgtttactccggttacttacgttaacctttccgtacgtaccgtccttaagtcttaagacggttctaacgtttnaacggtcgttaaggcggtcggtcctacggtacgacggttcgtaacg

SEQ ID NO: 289364 - DNA, 868 bp, Homo sapiens
  misc_feature: GYAE6OF02HX7ED.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgctctattggggacagagtcaccatcacttgccgggcgagtgaccgactagttaggtacttttttggccttggtttcagtcgaggacgtcctggaccgaaacgcccctaagtccctagacttacttttcgtaggtacttacctacttttaggaacggtaaggtagggacgttaccccgaaggtccccgtaagggtttacaacggtccgggtaactaaggttcggttttaccggtcgggggtaaccaaccgtagtttttacccaaccgttaccttacccaacccgtaacttccgaaggtaccgtaacgaccccgtttaggaccctacgggtcccttaggggaacgtacgttttaaccggccggtttaaacctttaacgttaaccgttacggtaaccctaaacgtaaaactttacgttttaaccttttttttaaccgtacccggttaaactttacggtttttaccgggacccggtaacggggtaaaccaacgggtaccgtagggtaacgtaaagttaaccgaaaacgggtaacgttacggtacgggtactaacggacctaaccgtacgttacgttaacgttcgttactaaccgtttacccgttaccccgaaccgttaaccgttacgttaccggtatttaaacgtaacgtttaaccggttacgttacgttaacgggtaccgggttaccgggtaccgttacggggtaaacgacgggttaccgacccgttaaaagg

SEQ ID NO: 289365 - DNA, 715 bp, Homo sapiens
  misc_feature: GYAE6OF02IUVQQ.44.75.G09.1.454.CMB.1.raw
  modified_base (164)..(164): a, c, t, g, unknown or other
  misc_feature (164)..(164): n is a, c, g, or t
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
  modified_base (390)..(390): a, c, t, g, unknown or other
  misc_feature (390)..(390): n is a, c, g, or t
tcagacagtatatacacgaccggtgctcgatttagtatagacatcagggggggggtctcaggaggcagcgctctcaggacgtcaccaccatggcctgggctctgctcctctcacctctcactcagggcacaggatcctgggactcgagtctcgccctggctacncgcctcccgtccgtcgtccgggtctcctggacngtcgagtccaacntcctctgcacgtcgaacaactgtcacgtcgttcgtttcaccgtctcgtccgtggtacctagcacggaacccaggaaaccacggtacccccctaaatctaacttattacgtcgacggtactaattcgtcctccgttacggtcctctggaacgcggtcttcgtcgtcggtacgtaacgttcncgggtactaaccggccgtcctaaccgtcggactcgtacgtccgtacggcctcgacggtctggaacgtacggtagcgtagaacgtttactaacgtgacggtacgtaccttacgtactaacgtacggtaacgtaacggggtaaaccttcctttaaacgttacgacccgggttaccgaccggttaaacggggaccaaaccggttggttacccgtacccgggtaccgtttacggggaccgttacggaaccccggtaggtacccgtacccggttacccccgtaccggttcccggttactaccccggttacccgttaccccgttaaccccc

SEQ ID NO: 289366 - DNA, 719 bp, Homo sapiens
  misc_feature: GYAE6OF02FOUZP.44.75.G09.1.454.CMB.1.raw
  modified_base (205)..(205): a, c, t, g, unknown or other
  misc_feature (205)..(205): n is a, c, g, or t
tcagacagtatatacacgaccggtgctcgatttagtatagacatcaggggaggaatcagacccagtcaggacacagcatggacatgagagtcctcgctcagctcctggggctcctgctgctcgttcgtttccccggtgccaggtgtgacatcgagatcgacccagttcctccgtcctactactgtctgcgtctagttgggacagngtccaccatcacttcggccgggacgtagtcggacccgatacggtttacggttccgttttttggccgttggtttacagacgtaggacgtccgtgaccaacggtccctaacgtcctatagttctttcgtggacttcctacttagacgtgtacggtacgtccgacgtacgtacggttcacggtcggtacgtagggttcgttcggtacggtactacgttacgtttactaccgttacctaccgtaccgtaacgtacgaacgtccgtacgtccgtacgaccgtacgccgtaagggtacgttacgtttacccgagttaacctttacgtacgttacgtaaaccctaaagttacttttaaccttttacgtttttaaccgttaccgttaacgtttacgggtttccggtaacggaacgggttaaccgtaaggttcgtaaggtactacgttaacgaaagggttacgttggaccgtaccgttagaaccggtactccgttacgttacgtcttacgtaccctttcccgg

SEQ ID NO: 289367 - DNA, 862 bp, Homo sapiens
  misc_feature: GYAE6OF02IRVPV.44.75.G09.1.454.CMB.1.raw
  modified_base (174)..(174): a, c, t, g, unknown or other
  misc_feature (174)..(174): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctagttgggacagagtcacatcacttgccgggngagtgccgatagttaggtactttttggccgttggtttcagtcgaggagcccgtggaccaaaccgccccttaacgtccctagtactttccgttttcgtaggtacttaccctacgttttaggaaaaggtacggttacgggtaaccggttacccccgaacgggtccccgtaacgggtttaccgaacggaccgggtaccgtaagggtttcggggtttccggtaccggggtaacctaaccgtttaacgttttacccaccgtttacctacccgtaaacccattaccgaacgtccgaacggtcccctaggccaaccggtcccgtagggtacgttaacgttttccggaaccgttaacttttaacgtttaacccgtcgtaaacccctaaaattaaacgttttactttttaaccgtttttttaaccgttaacccggtttaaacgtttacgggtttttaccgggaccgggttaaaccggggaaaccgtaacggtacggtaagggtaaacggtaacgttaacggtaaaacggtacgttacggtacggtaccgtcgaccgtacctacgttccgttcgttacgttcgttaccgttcccgttccccgtacttaccgttacgttagtaacttacgttaacttaccgtttaggtccgtaggtaccggtaccgggtacggtccggaacggtacggaccgtagtacg

SEQ ID NO: 289368 - DNA, 815 bp, Homo sapiens
  misc_feature: GYAE6OF02GYMLE.44.75.G09.1.454.CMB.1.raw
  modified_base (738)..(738): a, c, t, g, unknown or other
  misc_feature (738)..(738): n is a, c, g, or t
  modified_base (749)..(749): a, c, t, g, unknown or other
  misc_feature (749)..(749): n is a, c, g, or t
  modified_base (811)..(811): a, c, t, g, unknown or other
  misc_feature (811)..(811): n is a, c, g, or t
tcagacagtatatacacgaccggtgctcgatttagtatagacatcagggacttaggggctttgccaggctcctgctgctctcgtttccccggtgccaggtgtgacatcgagatcgacccagtctccgtcctcactgtctgcgtctagttggggacagagtcaccatctacttggccgggcgagtcgccgactagttacggttacttttttcggcccttggtttcacgtcgagggacgtccgtggaccaaaaccgtcccccttaaacgttccccgtagtacctttcttttacgtcggtacttcccgtaacgttttaggaaacggtaggtcggtaacggttccccaacggaccgttacggttccgaaggtccgggcgtaagggtttcggttacggttcggggaaccttaaccgtacgttttaccaacctttcccctaccgaacctaagttacccgaacggtcctaaccggtcccgttcgaccggttacccggtaccgttaagggtaaccggttacggttttaccggtaaccggtttaacgtttaaacgttacccgttaacggtaacccctaaaagttaacttttactttttaccgttttttacctaccggttaacgtttacggtttaccggacggtaaccgggaactaacgggtcgtaggtaacgtaaggtaacgaaacggtacggttacgcggtactacgtactaccgtattcgtacgttcttactcgttccccgtccnccgttacgttntacgttgtaacttcgttaccttgtcgtacggacggttcggtacgtcggaacggaccggtcgntacg

SEQ ID NO: 289369 - DNA, 734 bp, Homo sapiens
  misc_feature: GYAE6OF02IOE6P.44.75.G09.1.454.CMB.1.raw
tcagacagtatatacacgaccggtgctcgattttagtatagacatcagggggaggaatcagacccagtcaggacacagcatggacatgagagtcctcgctcagcctcctggggctcctgcctgctcgttcgtttccccggtgccgaggtgtcgacactcgagactcgaccctacgttcctccgttacctcgtacttggtctggtcgttacgttaggttcggggacagacgtccaaccacctacgttcggaccgggcgtaggtccgaccgtactagtttacggttacgtttttcggcgttggtttcacgtcgaaggtacgcgtacggaacctaaaccgtacccctaacgtaccccgtagtacttttccgttttacgtacggtaccttacgttaacgttttaggaaacgtacggtacggtaccgtacccgtacgtaccggtaagttacgacggacggtcgttacgggttcggtacggtacggtactaacgttcttaccgtactcctaaccacgtaacgtcgaacgcgtaccgtaccgtcgacgacgtcggtaggtatacgttccgtacttacttacgttcaacgaactaacttacttacctttacttttacgacgttacttacggttacgaccgtaacgggtaactacggtagtaggtaacgtaacgtacgaaacggtcgttacgtcgacgttacaccgtacgtacgttactcgttactaccttaccgtacctccg

SEQ ID NO: 289370 - DNA, 587 bp, Homo sapiens
  misc_feature: GYAE6OF02FVK3L.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggcaaacgcccctaagtccctgtattcttttctggactccgtactttgaagtagtggactcccagcctaggttcagcggtcagttggttctggacactatttcactctcaccatcagcacgtcctgcagccgtgacgtattcgacgtacttattactcgaccaactaattactttactttttactccgttacttagttttcggaccgacggggtaaccaggtcgtaggagagtaacgaaaggtacgtcgtggctcgacacctattctcgttctactacttcctcccgtactacgtctagtactacttactacgttcgtccgttaggacggtcgggtacgtacggacggtacggaccgtagtaacg

SEQ ID NO: 289371 - DNA, 817 bp, Homo sapiens
  misc_feature: GYAE6OF02J1O6J.44.75.G09.1.454.CMB.1.raw
  modified_base (167)..(167): a, c, t, g, unknown or other
  misc_feature (167)..(167): n is a, c, g, or t
tcagacagtatatacacgaccggtgctcgatttagtatagacatcagggacttaggggctttgccaggctcctgctgctctcgtttccccggtgccaggtgtgacatcgagatcgacccagtctccgtcctcactgtctgcgtcgtagtgggacagtcgtcacatcncttggccggcgagtcgccgacgtatttacggttcgttttttcggccttggttacagcgtaggacgtcctaggacctaaaccggtcccctaacgtcccttgtactttcttttacgtgactccgtaagtttaggaagtggtacgggtacgtaccccgagtccgtacgggttacgacggaccggcgtttaggttcggggttacgtacggaacctacttacgttttaccaaccgttcctaccggtaacccagtttaccaaggtccggttaccgcccgttacgccgtcgtacccgtacgggtattacggtttccgacgttttaaccttacggttaacgtcccaaccttaaaactaacttttttcccttttacgtttttttaaccgtacccggtttaacgttttacgggtttttaacgggacccggtagggttaacccgtaaggtggttaacggtacgtaacgttaacgtaacgggttaacgtccgggttagtccgacgtacctacctacggttccttaacgtttccgtacccttacttcccgttaccctcgttacgttccgttacgtaagttttaccgttaacgttcgttacgttacgggacgtaccggggttacgaccgggttcgggttacggaccggtaccgttaacgtaacg

SEQ ID NO: 289372 - DNA, 996 bp, Homo sapiens
  misc_feature: GYAE6OF02F4FFY.44.75.G09.1.454.CMB.1.raw
  modified_base (130)..(130): a, c, t, g, unknown or other
  misc_feature (130)..(130): n is a, c, g, or t
  modified_base (137)..(137): a, c, t, g, unknown or other
  misc_feature (137)..(137): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctnactgtcngcgtctattggggacagagtcaccatcacttgccgggcgagtgccgacattaggtacttttttggccttggtttcaagcgagggacgccgtggacaaacgtcccctaacgtccctgtagttctttttcgtaggactccactttggaaacgtaggtaggacgtaccccacggccgtaagggtttccaaggccgggtactaaggttcgggtttacgtgggggaacctaacgtaacttttcaccttaccgttccgaaccctaattacccgaacggtccaacggtccccttacggacccgtaacgggtccccgttaggggggaacgttaacgtttttacccgggtacggttaaacccttttaacgtttaaacccgttacgggtaacccctaaaaaaccgtaaaactttttaacgtttttaaccctttttttttttaaaccgttaccccgggttttaaaaccgtttaacgggtttttttaccggggtaaccccgggttaaacggggggttaaaccccctaaagggtaccggttaacggggtaaagttaaacggtttaaccggtaaaaaacgggttaaacccggttacgggttaccggggtaaccgtttacgggaaccccgttaaaccccgttaaacgtttacccgttttacgggtttacccgtttttacctaaaccggtttttaccccgtttacccccggttaaccccgttaaccgtttaacccgtttacggtttaaaccgtttaacggtttaaacgtttaaccgtttacgggttaaccggttacgggttaaccggggtcccggggtttaaccggttaccgggggtaaccggtaacggggttaccccggtacgggttaaaccgg

SEQ ID NO: 289373 - DNA, 868 bp, Homo sapiens
  misc_feature: GYAE6OF02HUXSP.44.75.G09.1.454.CMB.1.raw
  modified_base (130)..(130): a, c, t, g, unknown or other
  misc_feature (130)..(130): n is a, c, g, or t
  modified_base (843)..(843): a, c, t, g, unknown or other
  misc_feature (843)..(843): n is a, c, g, or t
tcagacagtatatacacgaccggtgctcgatttagtatagacatcagggacttaggggctttgccaggctcctgctgctctgtttccccggtgccaggtgtgacatcgagatgacccagtctccgtcctnactgtctgctctagtgggacagagtccacatccacgttcggaccgggtcgagtcgccgtaactagttacggttacgtttttttcgggccttgggttttccgacggtcgtacgggacgcccgttacggaaccaaaacggtaccccgtaacggttcccctagtaactttccgttttacgtcgggtacttccgtaacttttggaaacgtaggttacgggacgttaccccgaggtaccgtacgggttaccacgggtccggaacgttacgggtttacgggtttccggttacgggggtaaacctacgttaaccgttttaccttacccgtttacccgttaccgaacccttaactaccggtaagtccgtaacgtcccgttacggaccgtacggtaccgttagggtaacggttaccgtttaccggtaccgttaaaccttttacgttaaccctcggtaaccctaaagttaaacgtttacttttaccgtttttaacgtacccgtttaacggtttagttttacgggaccccggttaacggggaaccttacgggtacgtaacgggtacttaacggttaaccggaaagttaccggttacggttacgtaccgttacgtaccgtaaccgtgttacgttcgtacccttgtaccttttcccggcccgtacctttacgttccgtattaacgttacgtacttaccgttcgtactcgggtagtacccgggttcncggtaaccggaggtccggtataacg

SEQ ID NO: 289374 - DNA, 779 bp, Homo sapiens
  misc_feature: GYAE6OF02HB4V2.44.75.G09.1.454.CMB.1.raw
  modified_base (534)..(534): a, c, t, g, unknown or other
  misc_feature (534)..(534): n is a, c, g, or t
  modified_base (756)..(756): a, c, t, g, unknown or other
  misc_feature (756)..(756): n is a, c, g, or t
tcagacagtatatacacgaccggtgctcgatttagtatagacatcagggacttaggggctttgccaggctcctgctgctctgtttccccggtgccaggtgtgacatcgagatgaccctagtccttccgtcctacacgttgtctgcgtcgtagttggggacagagtaccaacctatccgacgttcggcccgggacgaaggtcggaccccgtagtaagtttacggttacgttttttcgggtccgttgggtttcaggccgaagggtacgtcgtcggaaccgtaaacctaccccgttaacgtcccctaggtaacttccgttttcgtaggtacttacctacgtttaggaacggtagtcggaccgttcccgagtaccccggtaggttacgacggtacgacgtacggttggttaccggtcggaactaccgtacgtttccaacgttcctaccgtactacgtcacgtacaccgtccgtgacgtacgtaccgtcgtagttacgttcctaagttacttaagtacctacgtaacctattaactttntttaccgttttaacttacccgttagtttaccgggtttaccgacgggtaaccgtaacgtacggtacgtaaggtacgtaacgtaacgaaagttcgtacgggtacgtacaccggtaactaccgtacgttcgttaccttaccgtcttaacccgttcgttcccgaacgttcgtaccgttatacgtttaccttacggacgtttcgaccggtaccggtcgtacggtccngggttaacccgattcggacctag

SEQ ID NO: 289375 - DNA, 777 bp, Homo sapiens
  misc_feature: GYAE6OF02JA5PF.44.75.G09.1.454.CMB.1.raw
tcagacagtatatacacgaccggtgctcgatttagtatagacatcagggacttaggggctttgccaggctcctgctgctctgtttccccggtgccaggtgtgacatcgagatgacccagtctccgtcctcactgtctgcgtctatggggacagagtcaccatcacttggccgggcgagtgccgactattaggtacttttttggccttggtttcagcgaggagcctgggaccaaacgcccctaagtcccctgtactttcttttcaggtactcctactttgaagtggtggacgtacccagcctaggttcacgcggctaggtcggttcgtagggaccactacgttttcaccttctcctaacctacttccaaggtccctaaggtccccttggaccaccggtcccgttaggggaaacttaccgggttttacccgacgggtttaaaccctttaacggtttaaccctcggtaaacccctaaaaaccttaagtttttaaccttttacgttttttttaaccgtaccccggtttaaacgtttttacgggttttaccgggtaaccggtaacggggttaaaccgtaaacggtaccgtaaacgggtaaaactaacgttaaaacccggtaacgtacggttccggtacctaccggtaccctaacgtacgttccgttacgtttacgttacctacgtttacccgttcccgtaaccctacgttacgtagtacttacgtacttaaccgttcgttacgtaggtacggcgtcggtacggacgtacggcgtacgacgtg

SEQ ID NO: 289376 - DNA, 803 bp, Homo sapiens
  misc_feature: GYAE6OF02HCV3V.44.75.G09.1.454.CMB.1.raw
  modified_base (226)..(226): a, c, t, g, unknown or other
  misc_feature (226)..(226): n is a, c, g, or t
  modified_base (456)..(456): a, c, t, g, unknown or other
  misc_feature (456)..(456): n is a, c, g, or t
  modified_base (755)..(755): a, c, t, g, unknown or other
  misc_feature (755)..(755): n is a, c, g, or t
tcagacagtatatacacgaccggtgctcgatttagtatagacatcagggacttaggggctttgccaggctcctgctgctctgtttcccggtgccaggtgtgacatcgagatgaccagtcctccgtcctcactgtctgcgtctagtgggacagagtcacatctacttgccgggcgagtcgccgactagttaggtaccttttttggccttgggtttcagcgaggtacnccgttagaccaaacgtcccctaagtccctgtatttcttttacgcggtactaccttacgtttaggaaggtaggttcggaacgttccccgaggtaccgtaacgggtttaccaggtaccgggacgttacggttcgggggtttaccgttacgggggtaaaccctaaccgttaacgtttttccgaacccttccttaccgaaccgttagttaaccggacgaccgtaaggttccccngtaaccgacggttccgttagggaacgttagttttaccgaccgttaacgtttaactaccggtccaacgtaacttaacgtttacgttttactttttacgtaccgttttacgtaacggttttccggaaccggtacgggaacctaacggttccggtaggtaaaccgtacggttaaacgtaaacggtacggtcgttaacgggtccgttaagacccgttaccgtaacttcgttcgtacttaccgtaccttcccgttaccggaccttagtactacggttaactcttaacgttacgtacttaccggngttacccggtaggggtaccgttggaacccggtagtaccgtggtaacgg

SEQ ID NO: 289377 - DNA, 711 bp, Homo sapiens
  misc_feature: GYAE6OF02JI77V.44.75.G09.1.454.CMB.1.raw
tcagacagtatatacacgaccggtgctcgatttagtatagacatcagggacttaggggcttgccaggctcctgctgctctgtttccccggtgccaggtgtgacatcgagatgacccagtctccgtcctcactgtctgcgtctattggggacagagtcacatcacttgccgggcgagtcgccgacattaggtacttttttggccttggtttcgagcaggtacgccgtggacgtaaaaccgccccttaagtccccgtagtacttccgttttctggaacttcccgtaacgttttaggaaggtacggttcgggtaacgtccccgacggaccccgtaagggtttcccgacggtccggtacggttacgggttcgggtttacgtaggggaacctaccgttacgtttttaccaccgttaccgtacctaaccctagtaccgtacggacctaacggtcccgtcgtaccaacggtccgttaggtaaccgttaacgtttcggacgttaccgtttaactacgtcgaaccctaagtaacttactttacgtttttactacgtacgttcgttacggtccgaggaccgtagtcgtagacgtactacgtaacgtacgtggagtcgacgtactactagtcctacgttacgtctcttccgtaccgcctagtctagtactatacgtacctgtacgttagcggtacgcggtaccgacgtacggacgtagtacg

SEQ ID NO: 289378 - DNA, 551 bp, Homo sapiens
  misc_feature: GYAE6OF01ED6B4.25.53.E09.1.454.CMB.1.raw
  modified_base (301)..(301): a, c, t, g, unknown or other
  misc_feature (301)..(301): n is a, c, g, or t
  modified_base (340)..(340): a, c, t, g, unknown or other
  misc_feature (340)..(340): n is a, c, g, or t
  modified_base (344)..(344): a, c, t, g, unknown or other
  misc_feature (344)..(344): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
  modified_base (393)..(393): a, c, t, g, unknown or other
  misc_feature (393)..(393): n is a, c, g, or t
  modified_base (412)..(412): a, c, t, g, unknown or other
  misc_feature (412)..(412): n is a, c, g, or t
tcagactgtacagtcacgaccggtgctcgatttagagagagtgtgttgggtttgggggggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggaggcgtggtccagcctgggaggtccctgagactctcctgtgaagcctctggtattttagttcagtggttctggcatgcactgggtccnccaggctccgaggcaaggggccgagtggttggcagttangcanatgatggaagttcngaatnttangcagactcgagaaggctatcacatcncagagacaattccggaatnttgtgtacgttaggaaatggtacagcctagagacggtcggaggactcgggctcgtagtattacgtgtacgcggaagtagtcggggaggttgggtaaggttacggtttaacgttacccggggcgtcgtagtggtaccggg

SEQ ID NO: 289379 - DNA, 616 bp, Homo sapiens
  misc_feature: GYAE6OF01DHWW8.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaagaacatgaagcacctgtggttcttcctctgctggtggcggcgcccagatgggtcctgtcccagctgcgtctgcaggagtcgagcccagggcaggtgaagccttcggagaccctgtccctcacctgctctgtctctggtcgactccatcaccagtaatgctcattacgtggggctcggctccgccacgccccgagggtaacggcctggagtggattgcgattgtctttcagtaggtgggtagtcgcctactacgacgtccctcctacaagtcgtcgacgtcacctagtttcggttagactacggtccacgtcacgtctagttcgtctactgacctcgtcgtacgtcgtcgtccgccggtcccgccgacgaccggtccgttactaactttaccggtgtacgacggtagtacggttacgaagggtaccgggtaacccgggtaaacccccttaaccgtaaacccccgttacgtttaccggaacccgtacccgggttcggggaaccccggg

SEQ ID NO: 289380 - DNA, 570 bp, Homo sapiens
  misc_feature: GYAE6OF01BVCW3.25.53.E09.1.454.CMB.1.raw
  modified_base (357)..(357): a, c, t, g, unknown or other
  misc_feature (357)..(357): n is a, c, g, or t
tcagactgtacagtcacgaccggtgctcgatttagagagagtgtgttgggtctgggggaggcgtggtccagcctgggaggtccctgagactctcctgtgaagcctctggattttagtttcagtggttctggcatgcactgggtccgccaggctccaggcaaggggccggagtggttggcagttatagcacatgatggaagttctgaatattatgcagactcgtgaagggccattcaccatctccagagacaattcccggaacattgtgtacttggaaatggtcagcctgagagtcgaggactcggctctgtattactgtgcgagagtcgggaggttggtagtagttattaccgggcncagtgacgtggggccaggggaccctgggtccaccgtctccgtcagcctccaccgaacgggcccagtccggtccttcccccgtggccgccctgcctccgaggacgccacctccggacgacgccacgacgccggcccgtgggcctcgcccgtgggtccgaaagggtcctaaccttcccacgttcgtaccgtacgtctaggaggccgggctacggg

SEQ ID NO: 289381 - DNA, 670 bp, Homo sapiens
  misc_feature: GYAE6OF01ATRKG.25.53.E09.1.454.CMB.1.raw
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccggccagactgttgacaacgacttagcctggtaccaacagaagcctggccaggctcccaggcctcctcatctatgatacttccaggtacggccacgtggcactcccgacgccccgtcttacgaggttcgggacctaggttcggggtcctagggggacctaggtacgttttacctctacaacctatcctaccaggtcccttaaggacgtcctagaagtagttttgcttagtttacttactgtacacgtcctaccgacaaagtaacgtcggtaccctacctaattacttccgtaccgttttcccggaccccgttacggggaaccctaaaggttcgggtaacttaacgtaacgtaaaccggtaaacgttcggtacgggtccgtagaccctaaccctattcccgttacggtttacctttaccgtaacctttcccgttacccccgtacccgttac

SEQ ID NO: 289382 - DNA, 542 bp, Homo sapiens
  misc_feature: GYAE6OF01A6R3G.25.53.E09.1.454.CMB.1.raw
  modified_base (354)..(354): a, c, t, g, unknown or other
  misc_feature (354)..(354): n is a, c, g, or t
  modified_base (433)..(433): a, c, t, g, unknown or other
  misc_feature (433)..(433): n is a, c, g, or t
tcagactgtacagtcacgaccggtgctcgatttagagagagtgtgttgggtctgggggaggcgtggtccagcctgggaggtccctgagactctcctgtgaagcctctggattttagtttcagttggttctggcatgcactgggtccgcaggctccaggcaaggggccgagtggttggcagttatagcacatgatggaagttctgaatattatgcagactccgtgaaggccattcaccatctccagagacattcccggaacattgtgtacttggaaatggtcagcctgagagtcgaggactcggactctgtattactgtgcgagagtcgggagtggtagtagttagttaccgggngcagtgacgtggggccaggggccctggtcaccggtctccgtcacgcctccaccgaacgggcccatccggtcttccccgngccgccctgcctccgacggacgccacctaccgacgacgtaccacgcgccggccgtcggcgcgcgtcgacgacgtactacctcactgactcgtcgagcggcggtcgacgg

SEQ ID NO: 289383 - DNA, 562 bp, Homo sapiens
  misc_feature: GYAE6OF01B6XCW.25.53.E09.1.454.CMB.1.raw
tcagactgtacagtcacgaccggtgctcgatttagagagagtgtgttgggtctgggggaggcgtggtccagcctgggaggtccctgagactctcctgtgaagcctctggatttagtttcagtggttctggcatgcactgggtccgccaggctccaggcaaggggccggagtggttggcagttatagcacatgatggaagttctgaatattatgcagactccgtgaagggccattcaccatctccagagacaattcccggaacattgtgtacttggaaatggtcagcctgagagtcgaggactcggctctgtattactgtgcgagatcgggaggtggtagtagttagttaccgggcgcagtgacgtgggggccaggggaccctgggtccaccgtctcctcacgcctccaccgaagggcccagtcggtccttcccccgtggccgccctgcctccgaggacgccaccgtccgacgacgccacgacgccggccctggggcctcggccctgggtccaacgggtaccttaccttcccactcgtaccagtctggacggtcgggctcggg

SEQ ID NO: 289384 - DNA, 585 bp, Homo sapiens
  misc_feature: GYAE6OF01AKFNQ.25.53.E09.1.454.CMB.1.raw
  modified_base (407)..(407): a, c, t, g, unknown or other
  misc_feature (407)..(407): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcgggagacccctgtcccctcacctgctctgtctctggtgactccatcaccagtaatgctcattacgtggggctggctccgccacgccccgagggacggcctggagtggattgcgtattgtctttcagtaggtgggagtcgcctactactacgtccctccctacaagtacgtcgagtccacctatttcggttanacctacgtcccacgcagctagttctctctgacctctgaccgtctgtccgaccggcccgccgaccgaccggtcccttactacttaccgtggtacgcgagtacgtcgaggtacggtaccggaaaacccccttacccgtaaacccccttacgtttacggacctaccggttcggggaccccg

SEQ ID NO: 289385 - DNA, 597 bp, Homo sapiens
  misc_feature: GYAE6OF01C7XDY.25.53.E09.1.454.CMB.1.raw
  modified_base (147)..(147): a, c, t, g, unknown or other
  misc_feature (147)..(147): n is a, c, g, or t
  modified_base (185)..(185): a, c, t, g, unknown or other
  misc_feature (185)..(185): n is a, c, g, or t
  modified_base (316)..(316): a, c, t, g, unknown or other
  misc_feature (316)..(316): n is a, c, g, or t
  modified_base (466)..(466): a, c, t, g, unknown or other
  misc_feature (466)..(466): n is a, c, g, or t
tcagactgtacagtcacgaccggtgctcgatttagagagagtgtgttgggtctgggggaggcgtggtccagcctgggaggtccctgagactctcctgtgaagcctctggattttagtttcagtggttctggcatgcactgggtcccnccaggctccaggcaaggggccgagtggttggcagttanagcacatgatggaagttctgaatattatgcagactccgtgaaggccattcaccatctccagagacaattcccggaacatgtgtacttggaaatggtcagcctgagagtcgaggactcggctctgtattacngtgcgagagtcgggagtgtagtagttagttaccggcgtcagtgacgtcggggccaggggaccctggtcctacccggtctacctcgacgccctaccgaccgaacgggtcccaagtccggtcctcccccgtgccgccctgcctccgagtacncctaccgtccgacgacgtcgaccgacgccggcccgtcgggctcggcccgttggtaccgaaacggtcccttaccgtcccgtaacccgtggtaaccctacggttctagggtaacggccgggtcgtaaccgggg

SEQ ID NO: 289386 - DNA, 553 bp, Homo sapiens
  misc_feature: GYAE6OF01A4DJJ.25.53.E09.1.454.CMB.1.raw
  modified_base (332)..(332): a, c, t, g, unknown or other
  misc_feature (332)..(332): n is a, c, g, or t
  modified_base (371)..(371): a, c, t, g, unknown or other
  misc_feature (371)..(371): n is a, c, g, or t
tcagactgtacagtcacgaccggtgctcgatttagagagagtgtgttgggtttggggggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccgccagactgttgacaacgacttagcctggtaccaacagaagcctggccaggcctcccaggctcctcatctatgatacttccagtacgggccactggcatcccagccccgnttcagtggcaggtggggtctggggacaggtacgtttacnctcaccatcctccagcctaggacgcctagaagtattttgactagtttattactgtcagctccgacaagaacgtcggcctacctaattacttctacgtttccggacccgtagggaacctaaaggtggataactacaaacgtactgtcggtctgccacatctcgtcttacattcctcccgctac

SEQ ID NO: 289387 - DNA, 774 bp, Homo sapiens
  misc_feature: GYAE6OF01B26FD.25.53.E09.1.454.CMB.1.raw
  modified_base (283)..(283): a, c, t, g, unknown or other
  misc_feature (283)..(283): n is a, c, g, or t
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtcgtccgggggaacagccaccctctcctgcgagggccgccagactgtgacaacgctagcctaggacaacagaacgctggccaggctcccaggctccncatctatgatacctcagtacggccacgtggcactcccacgcccgtcttccagtcggctaggtcgggttcgtaggggactaaggtacgtttaactccgtacaccgtatccctacgacgtacctaacggcgtaccgtaggaaacgttacgtttttacggacctttaaggtttttaacttaacgttcggttacctaggttacccgttcccggaacggtaaaacggtaacggttccgggtaccccttacctaaaacgttttaaccgtttacccgttaaccggtttttaccccgggacccccggttttaacggggaaaaccccggtttaaaagggtacgggttaacttaaaaccgtttaacccggaaaaaacggttaaccgttaggttacgggtacccgttacggaaccctacccgttaacgtttaccgttaccgggtttaccctttaccgttaaacccttttcccccgtttcccccggtaccctttaaacccggg

SEQ ID NO: 289388 - DNA, 595 bp, Homo sapiens
  misc_feature: GYAE6OF01CYKOP.25.53.E09.1.454.CMB.1.raw
  modified_base (299)..(299): a, c, t, g, unknown or other
  misc_feature (299)..(299): n is a, c, g, or t
  modified_base (348)..(348): a, c, t, g, unknown or other
  misc_feature (348)..(348): n is a, c, g, or t
  modified_base (392)..(392): a, c, t, g, unknown or other
  misc_feature (392)..(392): n is a, c, g, or t
  modified_base (432)..(432): a, c, t, g, unknown or other
  misc_feature (432)..(432): n is a, c, g, or t
tcagactgtacagtcacgaccggtgctcgatttagagagagtgtgttgggtttggggggaactgctcagttaggacccagagggaaccatggaagccccagctcagcttctcttcctcctgctactctggctcccagattccagcggacgaaactgtgttgacacagtctccagccaccctgtctttgtcgtccgggggaacagcccaccctctcctgcacgggccggccagactgttgaacaacgacttagccttggaaccaacgagaacgcctggcccaggcctcccaggcctcctnatcgtatgatacttccagtagggccacgtcggacactcccagccccgtnttcgagtcgggcagggtcggtcgtagggaacagtacgttttacnctaccaacctatcctacagcccgtagacgtctagaacgtnttttgactagtttattacgtgtcagtcctcgacaagaagtcggacccttacaatctttacgtacctttccggacccgtaggaaccaaaggtcgtatacgtacgaacgtacgtggtacgctacggacacgtacttcttcgtaccttcacttccttcccgctacg

SEQ ID NO: 289389 - DNA, 686 bp, Homo sapiens
  misc_feature: GYAE6OF01CMJI3.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattacgtgggctggcctccgccacgcccccgagggacggcctggagtggagttgcgtagttgttctttcagttaggtgggtagtcgtacccttaactaccgtacgttcccctcccctacgaacggtacgtaccgacgtacctaccttagttttccggttagacctaccgttacccaccgctaacgcgttagttcgttctcgtacgaaccgtaccgttacgtaccgttacgtcggtacccgacccgggacccgtcccggaacccgtacccgggtcccggttaccttaacgtttacccgttgggtacgaccggtaagtaccggttcgaacggtcccggggtaaccggaaaaaccccccttacccgtaaacccccttacgtttacccggaacctaccccgggttcggggaaccccggg

SEQ ID NO: 289390 - DNA, 638 bp, Homo sapiens
  misc_feature: GYAE6OF01CHF1O.25.53.E09.1.454.CMB.1.raw
tcagactgtacagtcacgaccggtgctcgatttagagagagtgtgttgggtttggggaggtccaactcataagggaaatgcttttctgagagtcatggacctcctgtgcaagaacatgaagcacctgtggttcttcctcctgctggtggcggcgcccagatgggtcctgtcccagctgcgtctgcaggagtcgagcccagggcagggtgaagccttcgggagaccctgtcccctcacctgcctctgtctctggtgactccatcaccagtaatgctcattacgtggggctcggcctccgccacgcccccgaggggacggcctgggagtggattggcgtagtttcgttctttcgagttaggtgggagtcgtcctactacgtacgttcccctcctacgaagtcgtcgacgtccaccttagtttccggtacgaccgtaccgtcccacgcagccgtagtttcgtctcgtacgtacctactcggtaccgttctcggtccgacccgggtcccgaccgaaccgtccgggtcccttcttaacgttccgtggttcggaccggtaggtacgtacgaaggtacgggtacccgaaaccccttacccgtaaacccctttacgttaccgaccgtcccggtggggtaaccccgg

SEQ ID NO: 289391 - DNA, 645 bp, Homo sapiens
  misc_feature: GYAE6OF01DWMHA.25.53.E09.1.454.CMB.1.raw
  modified_base (278)..(278): a, c, t, g, unknown or other
  misc_feature (278)..(278): n is a, c, g, or t
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcaccgtgctctgtctctggtgactccatcaccagtaatgctcattacnggggctggctccgccacgccccgagggacggccgtggagtggattgcgtattgtctttcagtagtgggagtgcctactacacgtccctccctnaacgngtcgagtcacctatttcggttgaccacgtccacgcagctagtttgtcctacgtcgactacgttcgacgttctcgtccgaccgggtcccgaccggaaccgaccgggtccccgttactaacgttttaaccgtcggttacggacgtaacgggtaacgttaccgaacgggtccggggttaaacccggtaaaaccccccctttaaccggtaaacccccccttttacggtttacgggaaacccccgtacccggttccgggggggtaaacccccgg

SEQ ID NO: 289392 - DNA, 711 bp, Homo sapiens
  misc_feature: GYAE6OF01DJKVM.25.53.E09.1.454.CMB.1.raw
  modified_base (268)..(268): a, c, t, g, unknown or other
  misc_feature (268)..(268): n is a, c, g, or t
  modified_base (273)..(273): a, c, t, g, unknown or other
  misc_feature (273)..(273): n is a, c, g, or t
  modified_base (280)..(280): a, c, t, g, unknown or other
  misc_feature (280)..(280): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgacgcccgagggcaggtgaacgccgttcggacgaccctgtcctcacctgctctcgctgtgtgactcatcacagtaancgctnattacgngggctcgcctccgccacgccccgaggacgcgtgagtgagtgcgtattcgttctttcgagtggtagggtacgtcgtaccttactacctaccgttccccttaccgtacgaaaggtacgtcgtacgtacctaaccgttagttttccggtaccgtaacgtaccgttcccgaacgtcaacggtcttacggttcgtcttaccgtagtaaccggtactggtaccgttacgtcgtacccggcccgggccccgtacgaacccggaccgggttcccgttactttaaccgttacggtcggttaccgacgggtaacgtaccgggttaccgacgggttaccccgggttaaaccggaaaaaccccccctttacccggtaaaaccccctttaggttttaaccccggaacccgtttacccgggggaccggggttaaacccccggggg

SEQ ID NO: 289393 - DNA, 713 bp, Homo sapiens
  misc_feature: GYAE6OF01D2WYJ.25.53.E09.1.454.CMB.1.raw
tcagactgtacagtcacgaccggtgctcgatttagagagagtgtgttgggtttggggaggtccaactcataagggaaatgctttctgagagtcatggacctcctgtgacaagaacatgaagcacctgtgttcttcctctgctggtgcggcgcccagatgggtcctgtccagctgcgtctgcaggatcgagcccgagggcaggtgaacgtccgttcggacgaccctcgtccctcaccgtgcctctgtctctggcactcatcacagtaatgctctattacggtgggctcggcctccgccgaccggaccccgaggggtaacgggccttgggagtggattggcgtaagtttcgttcttacagtaggtaggagtcgtacctacgtaaccgtcgtccccttacctacgaaaggtcgtacgtacgtactaacccttagtttaccggtttacaaccgtaccgttcccgaacgacgacgtaccgtaagtttcgtaccttacgtagtacctaacgttagccgttacgttccggtacccgacccgggacccgaccccgtaacggtacccgttaccgttacgttaacgttaacgttggttacgaaccgggacggttacgtacggtaacccggtacccgggttaacccgtaaaaccccccgttaaccctaaaccccccgttttgtaacccggaaccccgttaaccgggccgggttaaaccccgggg

SEQ ID NO: 289394 - DNA, 750 bp, Homo sapiens
  misc_feature: GYAE6OF01EK5M7.25.53.E09.1.454.CMB.1.raw
  modified_base (146)..(146): a, c, t, g, unknown or other
  misc_feature (146)..(146): n is a, c, g, or t
  modified_base (185)..(185): a, c, t, g, unknown or other
  misc_feature (185)..(185): n is a, c, g, or t
  modified_base (213)..(213): a, c, t, g, unknown or other
  misc_feature (213)..(213): n is a, c, g, or t
  modified_base (244)..(244): a, c, t, g, unknown or other
  misc_feature (244)..(244): n is a, c, g, or t
  modified_base (264)..(264): a, c, t, g, unknown or other
  misc_feature (264)..(264): n is a, c, g, or t
  modified_base (567)..(567): a, c, t, g, unknown or other
  misc_feature (567)..(567): n is a, c, g, or t
tcagactgtacagtcacgaccggtgctcgatttagagagagtgtgttgggtctgggggaggcgtggtccagcctgggaggtccctgagactctcctgtgaagcctctggattttagtttcagtggttctggcatgcactgggtccnccaggctccaggcaaggggccggagtggttggcagttanagcacatgatggaattctgaattattangcagactccgtgaacgggccattcaccatcncagagacaacttcccggaanttgtgtactaggaaatggtcagcctggagtagtcggacggtacgtccggcttcgtgtaacttactggtcgacgtaagagtcggggtaggtgggtaagtttacggtttacggttaacccggggcgacgacgttacgggtacggttcgggggaccgtacgggggttacccccttgggtaccctacccgggttcttcccctacgtacgtcccccttaacccgaacccggaaacggggtcccctaacggttcccggtttccccgttcccccgtcggccccggtcccctcggccctaccgacgggacncccgtacccgtaccggacgtacggaccctaccggaccgggtccccgtcccgggtacgggtcccgtccggtacccggttagggtacccgtaaaccgggttacccttaaccccgtttccgtaacccgtttacggaacccgttaaccggtaccgttaggggaaccgggtcccggggactacggggg

SEQ ID NO: 289395 - DNA, 590 bp, Homo sapiens
  misc_feature: GYAE6OF01CYN6Y.25.53.E09.1.454.CMB.1.raw
  modified_base (144)..(144): a, c, t, g, unknown or other
  misc_feature (144)..(144): n is a, c, g, or t
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
  modified_base (354)..(354): a, c, t, g, unknown or other
  misc_feature (354)..(354): n is a, c, g, or t
  modified_base (440)..(440): a, c, t, g, unknown or other
  misc_feature (440)..(440): n is a, c, g, or t
  modified_base (493)..(493): a, c, t, g, unknown or other
  misc_feature (493)..(493): n is a, c, g, or t
tcagactgtacagtcacgaccggtgctcgatttagagagagtgtgttgggtctgggggaggcgtggtccagcctgggaggtccctgagactctcctgtgaagcctctggatttagttcagtggttctggcatgcactgggtccnccaggctccaggcaaggggccggagtggttggcagttatagcacatgatggaagttctgaatattatgcagactccgtgaagggccattcaccatctcaganacaattcccggaanattgtgtacttaggaatggtcagcctgagagtcgaggctcggctctgttattactgtgcgagagtcgggaggtggtagtagttacgtaccgggntcatggacgtggggccgtaggggacctggtccaccgttctcctcacgtccctacaccgacggcctacgtccggtcccttcccccgnggcccgtacccgtcgccgtccgaggaccgcctacccgtcgacgacgccgtacncggtccggccgtcgggcctcggcccgttggaccgaacgggtaccttaccgttacccgacgttacgtaacgtacgtcgtaggcggcgggtcgtacggg

SEQ ID NO: 289396 - DNA, 734 bp, Homo sapiens
  misc_feature: GYAE6OF01DYZG5.25.53.E09.1.454.CMB.1.raw
  modified_base (410)..(410): a, c, t, g, unknown or other
  misc_feature (410)..(410): n is a, c, g, or t
tcagactgtacagtcacgaccggtgctcgatttagagagagtgtgttgggtttggggggaactgctcagttaggacccagagggaaccatggaagccccagctcagcttctcttcctcctgctactctggctcccagattccagcggcgaaactgtgttgacacagtctccagccaccctgtctttgtcgtaccgggggaacacgcccaccctctcctgcgagggccgccagactgttgacaacgacttagcctggtaaccaacagaacgcctggaccagggtcctacccgaggcctcctcaattctaatcgaacttacttaccgaggtacgggacccacgtggacctactcccacggtccccgtcttcgaggtcggctaggtcggggtctggggactaggacttttacnctacacctatcctaccagtacctagacgtccgtagtaagttacgttttgctttaagttttacttactaggtacacggtccttaccgacgtaaacggtacgtccggtacccttaacgttaaattacgtttacctaccggtttttcccgggaacccggttaaccggggtaaaccctaaagggttacgggtaacttaaacggttaaacccgtaaaacggttaaccgttagggtacgggtcccttaacggaccttaaaccctacgtttccttacggtttacccttttaccgtacccttttaccccgtttaccccggccctttaaaccg

SEQ ID NO: 289397 - DNA, 613 bp, Homo sapiens
  misc_feature: GYAE6OF01DFU4V.25.53.E09.1.454.CMB.1.raw
  modified_base (388)..(388): a, c, t, g, unknown or other
  misc_feature (388)..(388): n is a, c, g, or t
  modified_base (449)..(449): a, c, t, g, unknown or other
  misc_feature (449)..(449): n is a, c, g, or t
  modified_base (604)..(604): a, c, t, g, unknown or other
  misc_feature (604)..(604): n is a, c, g, or t
tcagactgtacagtcacgaccggtgctcgatttagagagagtgtgttgggtttggggggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcacgggccggccagactgttgacaacgacttagcctaggtaccaacagaacgcctggccaggcctacccaggccttccctacatcctatcgattaccttccgaggtacgggccacgtggccactcccagccccgtcttacgagtggcaggtggtcgtgggacagtagtttacnctacacctatcctccagtcctagacgtcctagaagtattttgactagtttattactgtacngtcctcgacaagacgtcggaccctactaattacttcctacgtttacccggcccgtacgggaacctaaagtacggattaacgtaacctaaaacgtacgtggtacggtctacgacctaacctagttccgttacgttcttactactttcccgttcccnccgttaacg

SEQ ID NO: 289398 - DNA, 676 bp, Homo sapiens
  misc_feature: GYAE6OF01B95HM.25.53.E09.1.454.CMB.1.raw
  modified_base (202)..(202): a, c, t, g, unknown or other
  misc_feature (202)..(202): n is a, c, g, or t
tcagactgtacagtcacgaccggtgctcgatttagagagagtgtgttggggtttggggggaactgctcagttaggacccagagggaaccatggaagccccagctcagcttctcttcctcctgctactctggctcccagattccagcggcgaaactgtgttgacacagtctccagccaccctgtctttgtctccgggggaacngccaccctctcctgcagggccgccagactgtgacaacgacttagcctggtaccaacagaacgcctggccaggctcccaggcctcctcatctatgactacttccaggtacgggccacgtggctacgtcccagccccgctttcgaggttgcctagggttggggtctggggaactaggtacgttttacgctaccacctatcctaccaggtccctaggacgtcctagaagttagttttcggacttagttttacttacgtcgtactacggtccttaccggactaaacggtaacggtcggtacccttacctaaagttactttaccgtaacccgttttccgggacccgttacggggaaaccctaaaagggttcgggaacttaacgtaaccgtaaaacgtacgtacggtacggtcgttcggacctaacctagttaccttacggttacctttacgtaaccgtttcccttccccggtacctacg

SEQ ID NO: 289399 - DNA, 846 bp, Homo sapiens
  misc_feature: GYAE6OF01CVVZF.25.53.E09.1.454.CMB.1.raw
  modified_base (718)..(718): a, c, t, g, unknown or other
  misc_feature (718)..(718): n is a, c, g, or t
tcagactgtacagtcacgaccggtgctcgatttagagagagtgtgttggggtttgggggggagaggagcccagcactagaagtcggcggtgttccattcggtgatcagcactgaacacagaggactcaccatggagtttgggctgagtcgttgggttttcctcgttgtcttacgttttaagaggtcgtccactgtcgaggtcgcaccgtggtggaggtcggtggggggaggcggtggtccaggccgtggggacggtccctggacgtacctctcctgtacgacgcctcgtggtacttttagttcgtaggttcggttctggctagtcggcgtacggtcgggtcccgaccgacgggtcctaccggacggacggaacgggggccggtaggttgggttacggacgtaagttacaggacaacgtagttaggtaagttagggtaactttacgtaaggtaaatttaatttagcggtaaccgtaacgtaccgttacgggtaagggtaaccgggtacccgtaatttacccgaacctacgttaccgtaacccgaaagtaaccgtaaaccgttaaccggttaaccccggaaattacggtttacggttaacggtaacgtttaagggtaaacgtttcgggtaccggtaacgttccggtaagggaacggttaaccggtacgggtaaccgggaccgtttccgggtccttacggtttaacggttaactttacggngggttaaccgcggggtaaacggtcggggtttaacgggggtaaggggttttaaggttaacgggttttaaacgggtttacccgggtacccggggtaggtaccgtaaggggttccgggtaaacccgggggg

SEQ ID NO: 289400 - DNA, 719 bp, Homo sapiens
  misc_feature: GYAE6OF01BWWB8.25.53.E09.1.454.CMB.1.raw
  modified_base (167)..(167): a, c, t, g, unknown or other
  misc_feature (167)..(167): n is a, c, g, or t
  modified_base (170)..(170): a, c, t, g, unknown or other
  misc_feature (170)..(170): n is a, c, g, or t
  modified_base (181)..(181): a, c, t, g, unknown or other
  misc_feature (181)..(181): n is a, c, g, or t
  modified_base (243)..(243): a, c, t, g, unknown or other
  misc_feature (243)..(243): n is a, c, g, or t
tcagactgtacagtcacgaccggtgctcgatttagagagagtgtgttgggtttgggggggagaggagcccagcactagaagtcggcggtgtttccattcggtgatcagcactgaacacagaggactcaccatggagtttgggctgagcgtgttcgctagctcttaanagntcatgtcagtncactgtgagtcgtggggagcgtgtccagcctgggacgtccctgagctctcctgtgagtcctntggtatttagttcagttggttctggcatgctacgtggtccgacaggcctaccgagggaccgaaggggggtccgtaggttcggggttagcgtaaggtttaagtacgaccagtagtaggtaagtacgggtaatttcgtaagttaagtttattacgagaaccgtaacgtacccgtacggtaacggtaaaccgggtccttaacttacccgaactacgttccaaccggtaaggtaaacctaaccgtaaccggtttaacccggaactttagtttacggttaacgtttaacggtaacggttaagttcgggttacacgtaccggtaggtaacggtacggtaaccggtacggttaccgttacgtacgttacgttacgttaacgttcgtcgggacgtacgggtacggtacgggttacgggggttaggttaggttaacggtttacgttaccgggtaccgggactacggttagggtcccgggtacggg

SEQ ID NO: 289401 - DNA, 747 bp, Homo sapiens
  misc_feature: GYAE6OF01A8PP6.25.53.E09.1.454.CMB.1.raw
tcagactgtacagtcacgaccggtgctcgatttagagagagtgtgttggggtttgggggggaactgctcagttaggacccagagggaaccatgggaagccccagctccagcttctcttcctcctgctactctggctcccagattccagcggcgaaacttgtgttgacacagtctccagcctaccctgtctttgtcgtccgggggaacgcgcccaccctctcctgccgagggccggcagactggttcgaacaacgtacttacgcctaggtaaccaacagaacgcctggccaggcctcccgaggcctcctacactctatgtacttacttccgaggtacgggcctacgtggaccactcccgacgccccgtcttacgaggtcggcgtaggttgggtcgtagggactaaggttacgtttacctccgtacaaccctacgttccaccgtacgtacccgtaaggtaccgtaccgtagtaacggttagttttacgttacgtttaacggttttaactttacgttacgttaccgtacgtaccgttacccggtaaccgtaaacggtaacggtaccggtacccgttaaccttaaccgttaacgtttaccgttaccgtttacccgggtacccggttaaccgggtaaaccggtaacgtaacggtacgtaacgtaacgtaaaccgtaacgtacggtcggtacgtacgaccgtaccacgtacgttacgttcttacggggttaccttcccttcccgtccttaccg

SEQ ID NO: 289402 - DNA, 744 bp, Homo sapiens
  misc_feature: GYAE6OF01EX2Q5.25.53.E09.1.454.CMB.1.raw
  modified_base (428)..(428): a, c, t, g, unknown or other
  misc_feature (428)..(428): n is a, c, g, or t
tcagactgtacagtcacgaccggtgctcgatttagagagagtgtgttgggtttggggggaactgctcagttaggacccagagggaaccatggaagccccagctcagcttctcttcctcctgctactctggctcccagattccagcggacgaaactgtgttgacacagtctccagccacctgtctttgcgtccggggacagccacctctcctgcgagggccgccagactgtagacaacgtacttagcctggtaccaacagaacgcctggaccaggcctcccaggcctacctcatctatgtaacttaccttccgaggtacgggccacgttcgggccactccccgacgcccctcgtttcgaggttgggcctagggttcgggtacgtaggggacctaaggttacgttttccacgtaccaccctagtttcccnccaaggtcccttaaaggccgtaccgttagtaacgttattttcgactttaacgtttttacgtttacgttacgttccgtaacgtcccgttaccggacgtaaaggtaacggttaccggtacccttacctaaatttacttacgttaacccgttttcccggacccgttacggggtaaaccctaaagggttacggtaacgttaacgtaaacccgtaaaaccggtaaccgttacggggtaccggtaccgttaccgaaccgttaaccctacgttaccgttcgttaccctttacgtacctttccccgttcccgaccctttaaccg

SEQ ID NO: 289403 - DNA, 769 bp, Homo sapiens
  misc_feature: GYAE6OF01BWDUP.25.53.E09.1.454.CMB.1.raw
  modified_base (463)..(463): a, c, t, g, unknown or other
  misc_feature (463)..(463): n is a, c, g, or t
  modified_base (470)..(470): a, c, t, g, unknown or other
  misc_feature (470)..(470): n is a, c, g, or t
  modified_base (511)..(511): a, c, t, g, unknown or other
  misc_feature (511)..(511): n is a, c, g, or t
tcagactgtacagtcacgaccggtgctcgatttagagagagtgtggttcgggtctcggggaggcgtggtccagcctgggaggtccctgagactctcctgtgaagcctctggatttagtttcagtgttctggcatgcacgtggtccgccaggctccaggtcgaagggccgagtggttggcagttatagctacgagtcggagtcggtaaacttcgtaggaaattacgtttagtcggacgtaacgtaccgttcccggtaggtaaacgggtccccgtaatttacccgaacccttaagttccccgttacccggaaggtaaccgtaaccgttaaacgtttacccccgggaaacttaaggttttcggtaaccgtttaaccgtttagggaaaacgtttcgggtacctacggtacccgttaggaacggtacggttcggaacggttactccggtacttcgtagttacttacgngtacggngtagtacgcgggtatcggtagtacggtttacgtaccggggnacgtaggttcgaccggtcggggaccctaggggtaccccgtggtaccctacgttcccgtacgtcgacgtaccctacgaccggtacgacctacgtccgttacctccccgtgacctcccgtgccgtacgagccgtaccgccgtacgacgtacgtccgacgaccgtccgtaccgtggtaccgcggtccgttaggtacgtaaccgtacttacccgtccgtaacgtcgtaccgtacgtacgtaccggacggtccggtcgtacgg

SEQ ID NO: 289404 - DNA, 579 bp, Homo sapiens
  misc_feature: GYAE6OF01CI95C.25.53.E09.1.454.CMB.1.raw
  modified_base (382)..(382): a, c, t, g, unknown or other
  misc_feature (382)..(382): n is a, c, g, or t
  modified_base (418)..(418): a, c, t, g, unknown or other
  misc_feature (418)..(418): n is a, c, g, or t
tcagactgtacagtcacgaccggtgctcgatttagagagagtgtgttgggtttggggggaactgctcagttaggacccagagggaaccatggaagccccagctcagcttctcttcctcctgctactctggctcccagattccagcggacgaaactgtgttgacacagtctccagccaccctgtctttgtcgtccgggggaacgagccaccctctcctgcgagggccgccagactgttgacaacgacttagcctaggtaccaacagaagcctggccaggctcccaggctcctcatctatgatacttccgaagtacgggccacgtcggcactcccagccccgcttccgaggtggcaggtcgggtcgtgggacagtagttttacnctcacctatcctccacgcctagcgtactgaacgttnttttcgacgttaagtttattacgtgtctagtctaccggacaaagtacgtcgcctacaattgttctacgtttccgcccgtggaacctaagtcgatactacgaaacgactggtacgtctggacctcattccttcgttccttacgaccttccttccccgctacg

SEQ ID NO: 289405 - DNA, 658 bp, Homo sapiens
  misc_feature: GYAE6OF01C3H7H.25.53.E09.1.454.CMB.1.raw
  modified_base (568)..(568): a, c, t, g, unknown or other
  misc_feature (568)..(568): n is a, c, g, or t
  modified_base (624)..(624): a, c, t, g, unknown or other
  misc_feature (624)..(624): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcagggtgaagccttcggagaccctgtccctcacctgctctgtctctggtgactccatccaccagtatgctcattacgtggggctggcctccgaccgaaccccgagggacggcctggagtggtattggacgtatttgtctttcagttacggtgggtacgttcgtacccgttaactacctacgttccccctccctacgaacgtacggtaccgtacgtcccaaccgtttgttttaccgggtacgaaccgtaccggttcccaacggtccaagtcgtaaggttttcgtccttcgtacgaacctacgtcggtacgttcgtcggtccgaccgggtcccgacccgtacgtacccgggtccttacttacgttacgnggtagccggtaggacgtcgacggtccggtaccggaaaccccctcgtaaccccgttnttaccgaccgtaccggtcggggacctaaccgggg

SEQ ID NO: 289406 - DNA, 764 bp, Homo sapiens
  misc_feature: GYAE6OF01CZHJ3.25.53.E09.1.454.CMB.1.raw
  modified_base (149)..(149): a, c, t, g, unknown or other
  misc_feature (149)..(149): n is a, c, g, or t
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (247)..(247): a, c, t, g, unknown or other
  misc_feature (247)..(247): n is a, c, g, or t
tcagactgtacagtcacgaccggtgctcgatttagagagagtgtgttgggtctgggggaggcgtggtccagcctgggaggtccctgagactctcctgtgaagcctctggtattttagtttcagttggttctggcatgcactgggtcccnccgaggcctccgaggcgaagggggccggagtgggttggctagttanagcacatgatggaagttcagaatattangcagactcgagaaggccatccacntcacagagacaacttcccggaactattgtagtaacgttaggaaatggtacacgcctggagacggtcgaggactcgctctagttattacgtgtacgcgtaggtagtcggggtaggttaggtaggttaaggtttacgttaccggggcgtactagtacggtacggtcgggggaccgacggggtaccccgttcggtacccgaccccgttcgtcccgtaccgtaccggcccccttacccgaaccggaacccggtaccccgtaacggttcccccggtttaccccttccccccggttccgggtccccggtcccccgtcggtacccctacccggtacggacccggtacccgtaccccggtaccggacgacccgtaccgacccgggaacccgcccgggtacccggtcgggtacgtcccggttaccggtaccgggtacccgtaaacggtaccctttaacccggtttcccgtaccgttggtaacctacgggtttcccgagggaacccggtcggggtccggtacccggg

SEQ ID NO: 289407 - DNA, 669 bp, Homo sapiens
  misc_feature: GYAE6OF01EDM15.25.53.E09.1.454.CMB.1.raw
  modified_base (265)..(265): a, c, t, g, unknown or other
  misc_feature (265)..(265): n is a, c, g, or t
  modified_base (347)..(347): a, c, t, g, unknown or other
  misc_feature (347)..(347): n is a, c, g, or t
tcagactgtacagtcacgaccggtgctcgatttagagagagtgtgttgggtttggggggggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagccgtgggacggtccctgacgactctcctgtgaagcctntggtattttagttcagttggttctggcatgcacgtgggtccgccaggctccgaggcgaagggggccgagtggtgctagttanagcacagtgatggaagttcagtaattattatgctaagaccttccggaggaaacgggtcctatttccgacctacttcctaccgaagacgaactaacgttacccggaaatgtttacgtagttacgttaggaaacgttcggttacagtaccgtaggacggtacggtacgggaacggtaccttcgggtacttacgttagttaacgttacgtacggtggtacccggtagggttacggttacggggggtaaggggttcgggtttaaaggtttaacgggtttaaccggttacccggggacgtacggtaacgggttgggtaaccccgggg

SEQ ID NO: 289408 - DNA, 763 bp, Homo sapiens
  misc_feature: GYAE6OF01DRQOX.25.53.E09.1.454.CMB.1.raw
tcagactgtacagtcacgaccggtgctcgatttagagagagtgtgttgggtttggggaggtccaactcataagggaaatgcttttctgagagtcatggacctcctgtgcaagaacatgaagcacctgtggttcttcctcctgctggtggcggcgcccagatgggtcctgtcccagctgcgtctgcaggagtcgacgccccgaggggcagggtagaacgtcccgttacgggaacgccccttggtccccttcaccttcgcctcgttgtcctcgtaggttcacctccgatccaacctaagtaatcgctcgtaacttcggtgggtccgtcggccctccgaccgaccggcccccggaagggaaccgggtccggtagggtagtgggtagttggcgttagtttcgttcgttttgaaggtttagggtcgggtagttcccgtaaccgtttacgtaacccgtcccgtttcccctacccgtacgtaaaggtccggtaccgtacgttcctaaccgtttacgggttttcggttacgacccgttaaccgtaccgacccgtacggtagtaccggttacgtttccggttctacccgtacgtaacctacggtttacgaccgttcgtccggtaaccgccccggtccccgaccgtaacccggccggttacccgttattaacgttcgacggttcgacgtacggtcgacgtacggtacccggtacccgtaaacccctaccgtaacccgttacgttaccgaaccttccgggaacggggtacccgg

SEQ ID NO: 289409 - DNA, 713 bp, Homo sapiens
  misc_feature: GYAE6OF01DAKP4.25.53.E09.1.454.CMB.1.raw
  modified_base (258)..(258): a, c, t, g, unknown or other
  misc_feature (258)..(258): n is a, c, g, or t
  modified_base (287)..(287): a, c, t, g, unknown or other
  misc_feature (287)..(287): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgacgcccgagggcaggtgaagtccttcgggacgacccttcgtccctcacctgcttctgtctctggtnctcatcacctagtaatgctctagttacgngggtctggcctccgccgacgccccgagggacggcgtggagtgagtgcgtatttgtcttcagttaggtgggtacgtcgtcctacgtaccaccgttcccctaccttacgaacggtcgtaccgtacgttaccgaaccgtttacgtttaccgggtttaaccgaaccgtacccggttaccccgtaccgaccgtaacgggtccgttacggttttcgttaccgttaccgtacggtacccttaacggtcggttaccccggttcgttaccggtacccggaacccgggttcccgaccccggaaccgtacccgggttcccgttaccttactttacgcgttacggccggtaagtacggtacggtacgggtacccggtaaccgtaaaaccccctcccgttaaaccccttacttagaccccgtacggtccggggaacccg

SEQ ID NO: 289410 - DNA, 616 bp, Homo sapiens
  misc_feature: GYAE6OF01AV3XX.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccgagggcagggtgaacgtccttcgggacgaccctgtcccctcacctgctctgtctctggtgactccatcaccagtaatgctcattacgtggggctggctccgccacgccccgaggggacggccgtggagtggattcgcgtatttcgtctttcgagtaggtgggatcgacctactactacgtcccctcctagaacgtcgtcgacgtcaccgtagtttcggtcgacgtaccgtaccacgcagtctagttctctcgtgacctactggtacctcgtcgtaccgccggcccgaccggaccgaccggtccttacttacgttccgtggtcgacggacggtacgtacgacgggtcccggtaaacccgaaacccccttaccgtaaacccccgttagttaccgaacccgtccgggtccggggtaacccgg

SEQ ID NO: 289411 - DNA, 673 bp, Homo sapiens
  misc_feature: GYAE6OF01C5OVJ.25.53.E09.1.454.CMB.1.raw
  modified_base (281)..(281): a, c, t, g, unknown or other
  misc_feature (281)..(281): n is a, c, g, or t
  modified_base (555)..(555): a, c, t, g, unknown or other
  misc_feature (555)..(555): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggacgaccctgtcccctcacctgctctgtctctggtgactccatcaccagtaatcgctcattacgnggggctggctccgccaccgccccgagggaacggccgtggacgtggattcggcgtatttcgtctttcagtaggtgggtagtcgtacccttaacgtacgaccgttccccctcccgttagaaacggtgtaccgacgttcctaaccgttagttttccgggttacgaccaccgttcccaacgcctaagccttagtttcgtctcgtagacctacgtgtaccgttctcggtaccgaccggcccggtaccgaccgtaccgggtccgttctaagttttaccgnggtacgtccgaaggtcggtacgacgggtacccgggtaaacccggttaaaacccccctaacccgttaacccccgtttaagtttccggaaaccccttcccgggtcgggggtaaaccccgg

SEQ ID NO: 289412 - DNA, 756 bp, Homo sapiens
  misc_feature: GYAE6OF01BYS5T.25.53.E09.1.454.CMB.1.raw
  modified_base (734)..(734): a, c, t, g, unknown or other
  misc_feature (734)..(734): n is a, c, g, or t
tcagactgtacagtcacgaccggtgctcgatttagagagagtgtgttgggtttggggggagaggagcccagcactagaagtcggcggtgtttccagttcggtgatcagcactgaacacagaggactcaccatggagtttgggctgagtcgttgggttttcctcgttgtcttacgttttaagaggttcgtccacgttgtcgaggtgccaccgtggtggagtcggtgggggagtcggtgtccagccgtgggacgtccctgacgacttccgtccgtgtacgacgtccttacgtagttaattttgttcgaggtttggttccgtggcctagtcgaccgtacggtacgggtccccgaccgaggtcccgtaccggacgggaccggaacgggggtccggtaggttcgggtcggtacgtaagtttaagacgtacgaacgtaggtacgtaggttaggttaacgttacgtaagtaactttagttacgtacgactaacggtccgtacggtaggaacgggtcttactacccacgttactaccgtaccgaagtaccgtaaaccgtacgtacccgttaatagtttacggttaaccgttagtaacggtaaccgttggtacctaacgtcgtagaacggttacgtacggtaacgtccgtcgtacttacgttagttaacgttggtggtaacggcggtaaggtacgggtcgggtttaaggttaccggttaagttaccggtttaaccggcggtanagtaacgggttcgaaccggggg

SEQ ID NO: 289413 - DNA, 738 bp, Homo sapiens
  misc_feature: GYAE6OF01CMIZV.25.53.E09.1.454.CMB.1.raw
  modified_base (399)..(399): a, c, t, g, unknown or other
  misc_feature (399)..(399): n is a, c, g, or t
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtcgtccgggggaacacgccaccctctcctgcgagggccggccagactgttgacaacgacttagcctggtaaccaacagaacgccgtggcccaagggcctacccaggcctcctcatctatgataccttccaggtacggccacgtcggcactcccacgccccgtcttcgaggtcggccagggttcgggtctaggggactaggtaacgttttaccncttaccacctatccttaccaacgtcctaaggacgtaccgtagaaacgtttacgttttacggactttaacggttttactttacgttacgttaacgtaccgtacctacccgtaaacgtaaacggtaacgttaccgggtacccttaaccgtaaacttttactttacccttacggttttaccccggtacccggttacggggtaaacccgtaaaggttacgggtaacttaaacgtaaccgtaaaaccggtaacttacgggtacggttccgtacggtaccctaaccctaactttccgttaacgtttccgttaccttacctttccccgttccccgtaccttaaccg

SEQ ID NO: 289414 - DNA, 886 bp, Homo sapiens
  misc_feature: GYAE6OF01B5EOP.25.53.E09.1.454.CMB.1.raw
tcagactgtacagtcacgaccggtgctcgatttagagagagtgtgttgggtttggggggaactgctcagttaggacccagagggaaccatggaagccccagctcagcttctcttcctcctgctactctggctcccagattccagcggcgaaactgtgttgacacagtctccagccaccctgtctttgtcgtccgggggaacacgccaccctctcctgcgagggccgccagactgttgacaacgacttagcctaggtaccaacagaacgccgtggaccaggcctcccgaggccttcctcatctatcgacttaccttccgaggtacgggccaacgtcggaccaccgtccccgaggcccccgtctttaccgaacggtcgggtaccgtacgggttgggggttccgttacgggggaaacttaagggttaacgtttttaccctacccgttaccgaaaccctagtttccccgttacccgaaggtaccccgttaaggaccggtacccgttaggtaaacggtttacgtttttacggaccgttttaacggtttttaactttaaccgttcggttaccgtacggtacccgttacccggtaacgtaaacgggtaaacggtttccgggtaacccctttaaccgttaaactttaaccgtttacccgtttaacccggtttttacccccggggtaccccgggtttaaaccgggggtaaacccgttaaaacgggtttacgggtaaactttaaaccggtaaacccggttaaaaacccggtaaaccggtttacgggttaacgggtacccgttacgggaacccttaaacccgtacgtttacccgtttacggtttaccctttacccttaacccgtttcccccgtttaccccgtacccgtttaaaccgg

SEQ ID NO: 289415 - DNA, 637 bp, Homo sapiens
  misc_feature: GYAE6OF01DJVNX.25.53.E09.1.454.CMB.1.raw
  modified_base (194)..(194): a, c, t, g, unknown or other
  misc_feature (194)..(194): n is a, c, g, or t
  modified_base (279)..(279): a, c, t, g, unknown or other
  misc_feature (279)..(279): n is a, c, g, or t
  modified_base (371)..(371): a, c, t, g, unknown or other
  misc_feature (371)..(371): n is a, c, g, or t
tcagactgtacagtcacgaccggtgctcgatttagagagagtgtgttgggtttgggggggagaggagcccagcactagaagtcggcggtgtttccattcggtgatcagcactgaacacagaggactcaccatggagtttgggctgagcttgggttttcctcgttgcttcttttaagaggtgtccatgtcaggtncactggtggagtctggggagcgtggtccagccgtgggacgtccctagagctcgtcctgtagaacgcctgtaggtaatttgttacngttggttcgtggctagtgactacgtcgggtccgccgaggcctaccggagggaccggtaagggggccggtaggttggttggacgtaagtttanacgacgactagtgagttaggaagtttacaagtaattaagttacgagactagtacctacggaggtaacgggcctattaccactatcctacgaagacgactaacgttaccgaactagttgtagtaacgtaggtaactggtacacgtcgtagacggtagtacgacggtcgtcgtctcgtagttacgttacgtggtacgagaacggtaggtcggggtagttacggtagtttaacgttacgggttacggcgtagtacgtcggtaaccgggg

SEQ ID NO: 289416 - DNA, 605 bp, Homo sapiens
  misc_feature: GYAE6OF01BOILA.25.53.E09.1.454.CMB.1.raw
  modified_base (253)..(253): a, c, t, g, unknown or other
  misc_feature (253)..(253): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (278)..(278): a, c, t, g, unknown or other
  misc_feature (278)..(278): n is a, c, g, or t
  modified_base (286)..(286): a, c, t, g, unknown or other
  misc_feature (286)..(286): n is a, c, g, or t
  modified_base (320)..(320): a, c, t, g, unknown or other
  misc_feature (320)..(320): n is a, c, g, or t
  modified_base (478)..(478): a, c, t, g, unknown or other
  misc_feature (478)..(478): n is a, c, g, or t
  modified_base (524)..(524): a, c, t, g, unknown or other
  misc_feature (524)..(524): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgctctgcaggagtcgagcccagggcaggtgaacgccttcggacgaccctgtcccctgacctgctctgtctcgtggtnacctcatcacagtatnctnatacgnggctgccncgccacgcccgagggacgcgtggagtgatgcgtnttcgttcttagagtaggtggacgtcgtacctacgtacgtaccgtcccctacctaccgaagcgttacgtacgtacctaccgtagttttccggtacgacccgtacgtcccgacgccgtaagtcgtacgtttcgtacttctacgaacctcgtacgtacgtntacggtccgaccggccccgtacgaccgtccggtcctactcgttacngtcgcgtaagtcgtacgcggtacgacgtaacccgtaaacccctccgtaaccccttagtaccgaccgtccgggtaaccgggg

SEQ ID NO: 289417 - DNA, 755 bp, Homo sapiens
  misc_feature: GYAE6OF01CFHBU.25.53.E09.1.454.CMB.1.raw
  modified_base (735)..(735): a, c, t, g, unknown or other
  misc_feature (735)..(735): n is a, c, g, or t
tcagactgtacagtcacgaccggtgctcgattagagagagtgtgttgggtttgggggggagaggagcccagcactagaagtcggcggtgttccattcggtgatcagcactgaacacagaggactcaccatggagtttgggctgagtcttgggttttcctcgttgctcttttaaggaggtgtccatgtcaggtgcacctggtggagtcgtgggggagcggtggtccagccgtggggacggtccctggacgtactctcctgtcgaagccctgtggtattttgttcagttggtctggcatcgctacggtcggtccgccgaggtcctaccggagggcggaaacgggggcccggtaggttgggtacggtactaggtttagacggctaactagtagtaggtaggtaaacgtttgtaagtaaattagtttaagtcggaactaggtaaccccgttcggaacgggaaaccggggtcctaactttaccaccctaattcccgaaccgaagggaacccgtaaactaacccggtttaacccgggaaatttaggtttacggtaccgttaaacggtttaaggaaagttttcgggtaacacgtcggtaacgtaagggtacggtaacgggtaacggtacccgttcgggtctttacgtacgtttacgttaacgtcggtagggtcggtaaaggtcgggggttacggggttgggttaagttgggtttaagttaccggggttaccggcgtaaacgnggttacccggggaccggggg

SEQ ID NO: 289418 - DNA, 602 bp, Homo sapiens
  misc_feature: GYAE6OF01EK3UM.25.53.E09.1.454.CMB.1.raw
  modified_base (262)..(262): a, c, t, g, unknown or other
  misc_feature (262)..(262): n is a, c, g, or t
  modified_base (470)..(470): a, c, t, g, unknown or other
  misc_feature (470)..(470): n is a, c, g, or t
tcagactgtacagtcacgaccggtgctcgatttagagagagtgtgttgggtttggggggaactgctcagttaggacccagagggaaccatggaagccccagctcagcttctcttcctcctgctactctggctcccagattccagcggcgaaactgtgttgacacagtctccagccaccctgtctttgtcgtccgggggaacagcccaccctctcctgcagggccgccagactgttgacaacgacttacgcctggtaaccaanagaagccgtggcccaggcctcccgaggcctcctcatctatgattacttccaggtacggccacgtggccactcccagccccgcttcaggtggcaggtcgggtctggggacaggtacgtttactctaccgaccattcctaccgagtccctagacgtcctaggaacttacgttttgacttaagttttacttacgtgtacacgtcctccganaacggtagtcgacctacaattactcctacgtttccggccgtagggaacctaagtcggatacgtacgaaacgtacgtaggtcgtctgacctccattccgttcgttaccttcaccgtttccttccccgctaccg

SEQ ID NO: 289419 - DNA, 773 bp, Homo sapiens
  misc_feature: GYAE6OF01AF3IL.25.53.E09.1.454.CMB.1.raw
  modified_base (158)..(158): a, c, t, g, unknown or other
  misc_feature (158)..(158): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctctgctggtggcggcgcccagngtgggtcctgtccagctgcgtctgcaggagtcgacgccgagggcaggtcgaacgtccgttcggacgtaccctcgtccctccaccgtcgtccgtctcgttcctcgtacgggtcaccttccactccaccgtaagtaacgtccgtactacgttacgtcgggtcggtcgtccgccgtccgaccgaccccggacgggaacgggccggtacggtaggtacggtagttcggtcgtacggttgtttcttcgtaaggtacggtcgggtacggcgttcccgtacgtaacccgtacgttcccttaccctaccgaagttacggtccggtactaccgttaccgtaccggttttaccttacggggtaccctaaccgtccggtacccgtacggacccttaggtacccggtttacgttcctcgtaccgttacgaccttacggttaccgttaccgtcgtcccggtaaccgccccggacggtaccggtaaccgtcccgtacttacgtaccgttcgcggacggtaccgtcgggacctacgggaccggttaaccccgggtaaaccccctaaaccgttccccttacccggtttaagtaccccggcccgggtttaacggccggggtaaaccccgggg

SEQ ID NO: 289420 - DNA, 944 bp, Homo sapiens
  misc_feature: GYAE6OF01BSTLQ.25.53.E09.1.454.CMB.1.raw
tcagactgtacagtcacgaccggtgctcgatttagagagagtgtgttgggtttgggaggtccaactcataagggaaatgctttctgagagtcatggacctcctgtgcaagaacatgaagcactgtggttcttcctctgctggtggcgcgccagatcgggtcctgtcccagctgcgtctgcaggagtcgacgcccgagggctagggtcgaaacgtcccgtttacgggaacgtaccccgttcgttacccctcaaccgttcggcctttacgttcgtccgttcgtgggtactacctcctaactaccaaccgtaagttaactcgtccttactaagttccggtggggtcctacggtcctcccgaccgaacccggcccccggaaggggacggtcccgtaggggacgttacggtagtttcggcgtttaactttcggtttaccgttttacgaaggttacggggttacgggtaacggttaccggtaaccctttaaccgtaaccgtaacccggtttccccccttaaccgtaaccgtaaacggtaaccgggttacgtaaccgttacccgttaacccgtttacggttttacggggtaaccttaacccggtacccgggttaacccctagggacccttaagggtacccgttttaacgggtttccgtttccgtacccggttttaacgaacccgtttaaccgtttcccgggttaaccgttcccggtttaaccgggaccccggggtaccggtaacccccggtacccccgggtaaaccggttacccggttacccccgggtttacttttaaaaggttcccgggtggttaaccggtaccggtaaacgggtcgtaaccggtacgggttaaccccgggtaaaacccccttaaaaccccgtaaccccgtttaaccctttaaccgggttacccggtacccggtaccgggtaccggggggtaaaccccgg

SEQ ID NO: 289421 - DNA, 599 bp, Homo sapiens
  misc_feature: GYAE6OF01ENRUX.25.53.E09.1.454.CMB.1.raw
  modified_base (386)..(386): a, c, t, g, unknown or other
  misc_feature (386)..(386): n is a, c, g, or t
  modified_base (467)..(467): a, c, t, g, unknown or other
  misc_feature (467)..(467): n is a, c, g, or t
tcagactgtacagtcacgaccggtgctcgatttagagagagtgtgttgggtttgggggggaactgctcagttaggacccagagggaaccatggaagcccccagctcagcttctcttcctcctgctactctggctcccagattccagcggcgaaactgtgttgacacagtctccagccaccctgtctttgtcgtccgggggaacacgccaccctctcctgcagggccgccagactgttgacaacgacttacgcctggtaccaacagaagcctggccaggcctcccgaggcctcctacatctatgtaattaccttccgaggtacgggccacgtggcactcccagccctcttcgagtggctaggtgggtctagggacaggtactttacnctaccgaccatcctaccacgtcctagcgccttagaacttagtttgacttagttttacttaacgtgtcacgtccgtaccganaagtacgtcgacctactaatcttcctaacgttcccggtcctacgggaactaaggtgaatacgtactaaacgtacgtggtcgcgttagaccgactattccgtcgttccttacgactttccgtcccgccttacg

SEQ ID NO: 289422 - DNA, 734 bp, Homo sapiens
  misc_feature: GYAE6OF01EK972.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcgaggagtcgacgcccgagggcagggtagaacgtccgtttacgggacgtaccccttcgtcccctcacctgccttcgtgtctcgtggtcgtacctccactccaaccgtaagttaatcgcttacgtacgttacggtggggtcctcggcctcccgacccgaccggacccccggaaggggacgggccgtgggaggttggtacgttggacgttagtttcgttcctttacgagttaggtgggtacgttcgtaccttactaccgtccgttacccctccctacgaacgtacgttacgtacgttacctaccgttacggttttccggtaacgacccgtaccgtacccgaacggccagtccgttagttcgtcctacgtacgactcgtcgtcgttcgtccgtccgacccggcccgtaccgaccgtaccggttcccgttacttacggttccgtaggtcgacggtacggtacgtaccggtacggtaacccggtaacccgtaaaccccctaaccgttaccccgtttacggtaccgaacccgttcccgggtacgggtaaaccccggg

SEQ ID NO: 289423 - DNA, 792 bp, Homo sapiens
  misc_feature: GYAE6OF01BLN1L.25.53.E09.1.454.CMB.1.raw
  modified_base (250)..(250): a, c, t, g, unknown or other
  misc_feature (250)..(250): n is a, c, g, or t
  modified_base (281)..(281): a, c, t, g, unknown or other
  misc_feature (281)..(281): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatcgctctattacggnggggctggcctccgccacggacccccgaggggaacgggtccgtgggaggtcggtagttcggcgtagtttcgttctttcgaagttagggtaggggtagttcggtacccttaacgtaacctaccgttcccccctcccttaaccgtaaacggtacggttccggtaacgttacccgaacctttacggtttttaccgggtttaccgaaccccgtaacccggtttaccccgaaccggtccaaacgggttcccgttaagggtttccgtttacccgttccgttaccgggacctaccttacgggtaccgtttaccgtccggtaccggacccgggccccggtaccccggtaaccggacccggtccccggtttacttaaccgtttaccggttcgggtacggacggtaacggacggttaccggaacggtacccggggttaaccccggtaaaacccccttacccgtaaaccccccgttttcgtttaaccggaaccccgttacccggggtaccggggtaaccggg

SEQ ID NO: 289424 - DNA, 731 bp, Homo sapiens
  misc_feature: GYAE6OF01B4ETM.25.53.E09.1.454.CMB.1.raw
  modified_base (323)..(323): a, c, t, g, unknown or other
  misc_feature (323)..(323): n is a, c, g, or t
  modified_base (327)..(327): a, c, t, g, unknown or other
  misc_feature (327)..(327): n is a, c, g, or t
  modified_base (389)..(389): a, c, t, g, unknown or other
  misc_feature (389)..(389): n is a, c, g, or t
tcagactgtacagtcacgaccggtgctcgatttagagagagtgtgttggggtttggggggggagaggagcccagcactagaagtcggcggtgtttccattcggtgatcagcactgaacacagaggactcaccatgggagtttgggctgagcgttgggttttcctcgttgcttacttttaaggaggtcgtccactgtcaggtgcaccgtggtggagtcggtgggggaggcgtcggtccagccgtgggacggtccctgacgactctctgtagaacgcctcgtgtattttagttcgagttgttctggcagtcgcacgtcgggtccnccgnggctcgaggacgacggggccgaggtcggtagctaagttgagcagtgtgtagtaggtaacttntagaaacttgttaatcggactacggtacgttccggaaggtaaacggggtccctaagtttacccgaaccctaacgttacccgtacgaaacggtaacgaaacccttaaaccgttaccccggtaaacgtagtttacggttagttaaccgtaaggtaacggttcgtacgacgtcggtagaacggttacggtacggaacggtaccgttccggtacgttgttaacgttacgtttacgtagggtggaaccggtagggtacgggttacggggtagggtttacgggttaaagtttaacgggttaccggtttaccggggcggtaaccctagggttcccgggtaacccggggg

SEQ ID NO: 289425 - DNA, 775 bp, Homo sapiens
  misc_feature: GYAE6OF01B5YS9.25.53.E09.1.454.CMB.1.raw
  modified_base (153)..(153): a, c, t, g, unknown or other
  misc_feature (153)..(153): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcncccagatgggtcctgtcccagctgcgtctgcaggatcgacgcccgagggccaggtgaacgtccttcggacgaccctcgtccctcacctcgcttctagtcttcgtacgtacgtacctccgaactccaaccgtaagttaactcgtaccttacgttaacgttacgggtccgggtcgtccggtccgtcccggacccgtaacccggacccccggaagggggtaaccgggtcccgtaggggtacggttcggtaacgttcggacgttacgtttcggtttcctttacgagttacgggtaggcgtacgtacctaacgtccgtaacccgttcccctaacccgtagtaaggtacggtccgtaacgtaccttaccgtttaagtttccggttaacacccggtaccttaccgaccgagtaccgtacgttagttccgttactaccgagaccctaacgtcggtaaccttcgtacgcccgtaccggcccgacgacccggtaccgtcccgtagtttaatccggtagtcggtaaaccgtgtaaccggttcgggaaacccggttcccgggaaaacccctaaacccccgtttacctaaaccccgtttagtacccggacccgtccggggtccgggaaaacccgg

SEQ ID NO: 289426 - DNA, 647 bp, Homo sapiens
  misc_feature: GYAE6OF01BKAZP.25.53.E09.1.454.CMB.1.raw
  modified_base (348)..(348): a, c, t, g, unknown or other
  misc_feature (348)..(348): n is a, c, g, or t
  modified_base (570)..(570): a, c, t, g, unknown or other
  misc_feature (570)..(570): n is a, c, g, or t
tcagactgtacagtcacgaccggtgctcgatttagagagagtgtgttgggtttggggagtccaactcataagggaaatgctttctgagagtcatggacctcctgtgacaagaacatgaagcacctgtgttcttcctcctgctggtggcggcgcccagagtcgggtcctcgtcccagctgcgtctgcaggagtcgacgcccgaggggcaggtgaacgccgttcggacgtaccctgtccctcacctgctctgtctcgtggtcactcatcaaccgtagtatgctctagttcgtcgggcgtcggacctccgcgaccgaccccgagggacggctggagtgattgctattcgtnttacagtaggtcggagtcgactactacgaccttcccgtaccacgaacgtcgtacgtacgtacctacgttacgtttcggtacgacctacggtaccaacgtcgacgtctacggttcgtacgttcgtacaccgttacgtcgttaccgttcgtacgtaccgaccggcccgtacgaccggtacgtacccgtacttaacttacgtgtccggaactacggtacgtaccncgggtaaccggtaacccgtaaaccccgtaaccgtaccccgttacttaccggaaccgttaccggggcgggtaacccgg

SEQ ID NO: 289427 - DNA, 757 bp, Homo sapiens
  misc_feature: GYAE6OF01CSK4N.25.53.E09.1.454.CMB.1.raw
tcagactgtacagtcacgaccggtgctcgatttagagagagtgtgttgggtttgggggaactgctcagttaggaccagagggaaccatggaagcccagctcagcttctcttcctcctgctactctggctcccagattccagcggcgaaacttgtgttgacacagtctccagcctaccctgttctttgtcgtaccggggaacgacgccaccctctcctgcgacggccggcagactgtagacaacgtacttacgcctacggtaaccaacgacgaacgccgtacggaccgaacggtcctacccgacggtccctccctactaattaccgttatacggtacttaaccgtttccgaaaggttacggacctacgtcggactaccgtcccacggtccccgtcttacgaggttgggcctaggtcggggttcgacggggtaacgtacgttacggtttaacctcgtaccaactacgtaccgtacctacggtaccttaggaacgttccgttaagtaacgtttagttttacgtacgtttaaagttttaaccttacttacgtacgtaaccgtcctaccgtaacgaaacggtacgtccgaccttaacgtaacttacgtttaccgtaccgttttacccgggacccgttaagggaacctaaacggttgaacgttaacgaaacctaaacggttacccgtgggtaccgtaccgtacgttaccaacgttacttcttacgtttaccctacgttaccttcccgtcccgtaactaaccgg

SEQ ID NO: 289428 - DNA, 819 bp, Homo sapiens
  misc_feature: GYAE6OF01EOJVP.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccgagggcagggtgaagccgttacggacgtacccctgtcccctcacctgcctctgttctcgtggtcactccatacaccagtaatgctactagttacgtcggggtctcggcctccgccgaccggacccccggaaggggaccgggtccgtagggaggtcggtagttgcgttagtttcgttactttcgaaggttagggttaggggtacgttaccggtaccctttaaccgttaaccggtacccgttcccccttaccccgtacgtaaacggtcggttaaccggaacgttacccgtaacccgtttaacgttttacccggggtactaacccgtaaccggtccccgaacggtaccgtaggtacccgttaacggtttccgttaccgttaccgtacggtaacccgtaacgttacggtaaccggttcgtaccggttacccggaacccgggtcccggtaccccggaaccgtaccccggggtacctttaccgtttaaccgttcggtcggtaccggtacgggtaacgtacggtacggaacgggtacccgggtaaaccccgtaaaacccccttaaaccccgtaaacccctttacggtttaaccgacccggttacccggggtaccgggggtaaccccggg

SEQ ID NO: 289429 - DNA, 789 bp, Homo sapiens
  misc_feature: GYAE6OF01DAO8L.25.53.E09.1.454.CMB.1.raw
tcagactgtacagtcacgaccggtgctcgatttagagagagtgtgttgggtttgggggaactgctcagttaggacccagagggaaccatggaagcccccagctcagcttctcttcctcctgctactctggctcccagattccagcggacgaaactgtgttgacacagtctccagccacctgttcttgtcgtaccgggggacacgcccaccctctcctgccgacgggccgccaagtactggttacgaccaacgtacttacgccgtacggtaaccaaacgacgaacgccgtggccgaacggcctcccgacggtccctccgtactacgtaccttaagtacgtaactttacccgtttacgacgggtaccgggtaccctaacggtcggacctacccgtcccgaccggtcccccgttactttacgacggtcggaccggtagggtcggggtcgttacggggaacgtacgttacgtttaccgtactcccgaacctcctccgttaccacgtccgtaacggacgtaccgtagtaacgtttacgtttacgtacgtttaacgtttacttacgtacgttcacggtcctccggtaacgtaacggtacggtacccgtaccgttaacctaaacgtttacgttacccgtaaccgtttacccggcccgggttaacggaaacccggttaaggttacgtacgtaacgttaaccggtaaacgtacgttccggtacggtaccgtcgtacctaccgtacgttcgttaccggtttacctttaccgtaccgtttccccgtccgttacgtaaccg

SEQ ID NO: 289430 - DNA, 816 bp, Homo sapiens
  misc_feature: GYAE6OF01D5UTW.25.53.E09.1.454.CMB.1.raw
  modified_base (174)..(174): a, c, t, g, unknown or other
  misc_feature (174)..(174): n is a, c, g, or t
tcagactgtacagtcacgaccggtgctcgatttagagagagtgtgttgggtttggggaggtccaactcataaagggaaatgctttctgagagtcatggacctcctgtgcaagaacatgaagcacctgtggttcttcctcctgctggtggcggcgcccagatgggtcctgtcccngctgcgtctgacagggagtcgacgcccgagggcagggtgaagccgttcggacgacccttcgtccctccacctgccttcgtgtcttcgtggtacacctccactccaacctaagttaactcgcctactagttacggtcggggtcttccggtaccgtccccgaccgtacccggacccccggaagggggaaaccgggtccggtagggtaacggttagggtaacgttcggtaccggttagtttcgttcctttaacgtagttacggggtgggtacgtccgtaacccttaacgtaaccgtcccgtccccgtacccgtaacgaacggtacggttaccgtaacgtaccgtaaccgtttaacgggttttccggtaaccgtaaccccgttaccccggtaaccgaccggtaacgtacggtcgttagttacccggttcttaccggtacgaaccgttcgttacgggtaccgttccgtaccgtcccggaacccggtcccggtacccgaaccggtcccggttaccgttacgttacgtttaaccggtcgggttacggaacgggtacgacggttaccggacgggttaacccgaacccggtaaacccctaaacccgtacccgtttaacgtacggacccgtaccgggtcgggtaaaccccgg

SEQ ID NO: 289431 - DNA, 807 bp, Homo sapiens
  misc_feature: GYAE6OF01E1O3G.25.53.E09.1.454.CMB.1.raw
tcagactgtacagtcacgaccggtgctcgatttagagagagtgtgttgggtttggggggaactgctcagttaggacccagagggaaccatggaagccccagctcagcttctcttcctcctgctactctggctcccagattccagcggcgaaactgtgttgacacagtctccagccaccctgtctttgtcgtccgggggaacagccaccctctcctgcgagggccgccagactgtgacaacgacttagcctggtaccaacgagaacgcctggccacggcctcccgaggcctcctcacttctagtgacttacgttccgaggtacggcctacgtggcacgtcccgacgtccccgtcttacgacggtcggacgtacgggttcggggtcgtcggggaactaaggttacgtttacctctaccgaacctagttcccaccgtccggacccgttaaggaccgtaccgttaaggaacgttttagttttacgtacgttttaagtttttaactttaccgttacggttacgtaccggttcccgttaacccggtaacgtaaaacgggtacgggttacccggtaaccctttaacccgtaaagttttaaccgtttcccgttaacccgggttttccccgggtaccccggtttaacgggggtaaaaccctaaacgggtttacgaaaccgtttaacgtaaacccgtaaaaccggttacgttacgggttacggtaccgttacgtacccaaacccgtttacgtttacccgtttaccgtttacccttacccgtaaccgttttcccccgtttcccccgacgtttaacccg

SEQ ID NO: 289432 - DNA, 755 bp, Homo sapiens
  misc_feature: GYAE6OF01C3TMN.25.53.E09.1.454.CMB.1.raw
  modified_base (245)..(245): a, c, t, g, unknown or other
  misc_feature (245)..(245): n is a, c, g, or t
  modified_base (253)..(253): a, c, t, g, unknown or other
  misc_feature (253)..(253): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccgagggcaggtgaagtccttcggacgacccctgtccctcacctgctctntctctggnactccatccacagtatgctcattacgtggggctggcctccgaccaccggcccccggaaggggaaccgggtccgtgggaggtaggtagttggcgtagtttcgttctttacagttagggtgggtagtccggtacccttaacgtacctaccggttccccctacccgttaagaaacggtacggttaccggtaacggttccctaaccgtttaggtttttcccgggtaaccgaaccctaacccggttaccccgacgtaccgtaacggtcttaacgggtttccggtccttaccgtacgtaccgtaccgtttacggacccgtttcgtaccggtccggaacccgggcccggtacccggaccggtaccgggttcccttattacgtttaccggtggacggtacggtaacggtcggtacggtacgggttaccgggtaaaccgttaaacccctcccgtttaaaaccccgttaacccctttagttaacccggaccgtacccggggttaaccggggg

SEQ ID NO: 289433 - DNA, 850 bp, Homo sapiens
  misc_feature: GYAE6OF01DJVYD.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaaagaacatgaagcacctgtggttcttcctcctgctggtggcggcgcccagagtgggtcctcgtcccagctgcgtctgcaggagtcgacgcccgagggcaggtagaacgtccgttcgggacgacccttcgtccctcacctgcctcgtgtcctcgtggtactaccttccaactccaaccgaagtaatcgccttactacgttaccggtcggggtctcgggtccctccccggaccgacccggaccccccgggaaggggaacggggtcccggtaggggtaagggtagggttaacgttcgggtaacgttagtttacgttctttacgtaggttaaggggtcggggtagtacgtacccgttaactccgtaccgttacccctcccgtaacgaacgtacggtacgtacgtacctaaccgtttacgtttcggttaaccgtacccgtaacgtccccacggaaccgtacggtacgtacggttttacgtcctttaccgtacggtaacctaccggttacgttacccgttacggttccgttacccgggaacccggtaccccggaccccgggtaaccggtaccccgggttcgttacccttacggtttaccggttcggtacgggcgtaacgggttaaccggtaccgtaaccggggtacccgggttaaaccccggtaaaaacccccgttaacccgttaaaacccccgtttaccgtttacggaaaccccgggtcccgggttaacccgggggtaaccccggg

SEQ ID NO: 289434 - DNA, 580 bp, Homo sapiens
  misc_feature: GYAE6OF01D3JNT.25.53.E09.1.454.CMB.1.raw
  modified_base (515)..(515): a, c, t, g, unknown or other
  misc_feature (515)..(515): n is a, c, g, or t
tcagactgtacagtcacgaccggtgctcgatttagagagagtgtgttgggtttgggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggacgaccctgtcccctcacctgctctgtctctggtgactccgactcaccagtaatgctcattcgtgggctggctccgccacgccccgagggacgggctggagtgatgcgtagttcgtcttcgagtaggtggagtcgctactactcgtccctccctacaagtcgtcgtacgtcaccttagtttccggttcgactaccggtccaacgcagtctagttcgtctctgactcgtcgtacgtctcggccgaccggcccgaccgaccgtacggtcccgtcgtaacttcgtgtcgacgtaggcgtnaacggccgggtaacgaaaccccctacccgtaacccttacgttacgacccgtccggtggggacccg

SEQ ID NO: 289435 - DNA, 628 bp, Homo sapiens
  misc_feature: GYAE6OF01CFIOK.25.53.E09.1.454.CMB.1.raw
  modified_base (290)..(290): a, c, t, g, unknown or other
  misc_feature (290)..(290): n is a, c, g, or t
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtcgtccgggggaacgagcccaccctctcctgcagggccgccagactgttgacaacgacttagcctggtaccaacgagaagctggccaggcctcccaggcctccncatctatgatcttccgagtacgggccaacgtggcactcccagccccgtcttacaggttcggcgaggttgggtcgtaggggactaggtagtttacctcgtacacctactcctccagcctagcgtccgtagaagttatttgattagtttattacgtgtactacgtcctaccgtacgaagtaacgtcggtaccctactaacgttactaccgtaccgtttaccggacccgttagggtaaccctaagttagacttaagtaccgtaaaacgtacgtaggtcgtccgtacgactaccctaacttcgttcgtttaccttctacctttcccgttcccgtccttaccg

SEQ ID NO: 289436 - DNA, 769 bp, Homo sapiens
  misc_feature: GYAE6OF01EZAMO.25.53.E09.1.454.CMB.1.raw
  modified_base (185)..(185): a, c, t, g, unknown or other
  misc_feature (185)..(185): n is a, c, g, or t
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (664)..(664): a, c, t, g, unknown or other
  misc_feature (664)..(664): n is a, c, g, or t
tcagactgtacagtcacgaccggtgctcgatttagagagagtgtgttgggtttgggggggagaggagcccagcactagaagtcggcggtgtttccattcggtgatcagcactgaacacagaggactcaccatgggagtttgggctggagcgttcggtttcctcgttagctacgttttaagaggtntccactgtcgnggtcncaccgtggtggacgtcggtagggggngcgtggtccaggtccgtggggcgtccctgaacgtcctctccgtgacgacgtcccgttattaggttaattttacggtttcaggtttcggttacgtcggctagtcgccgtacgtcggggtcccacgtaggccttccggagggccggaaacggggtccggtaggttcgggtttggacttagtttagacgacgtagtagtaggtacgtaggtaacgttcgtaaagtatttaattggacgtataacgtccgtcggtaacggacgggttacccttagttacccaacccgttaccgttacctaacgaaaggtaaacccgtaaacccgttaaccggttaaccccggtaaagtttcgttttacggtaaaccgttacgttaaagggtaccggttacggtactaccggtaccgtgggtaaagccggttacggacgtacgtcccggttntaccgttaattacggtacgtggacgagggtaaggtacgggttagggtaggttaaggttacggttaccggtaacgggtcccggagttaacggtgtaccgggtcggg

SEQ ID NO: 289437 - DNA, 735 bp, Homo sapiens
  misc_feature: GYAE6OF01ANS5A.25.53.E09.1.454.CMB.1.raw
  modified_base (170)..(170): a, c, t, g, unknown or other
  misc_feature (170)..(170): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcgcgccagatgggtctgtcccngctgcgtctgcgaggagtcgacgcccgagggcaggtcgaagccttcggaacggtcccctggttcccctacaccgtcgccgttctggtccttcgtcggtacgtaccttccaatcctaaccgaagttaacgttcgactttacgtacgtttaccggtcggggtcgttcgggtacccgtcccggccgaccggcccccggaagggggaacggtcccgtagggcgttaacgggtgttcggtacgtacgtttacggttctttacgtaagtacggttggggtacgttcgtaccgtaacgtaccgtacgttcccctaccgtacgaagtacggtcgtacgttaccaccgttacgtttacggtcgtacctaccgttccacggtcacgtccgtagttcgttcgactcgactacgttagcgttacgtcgtaccgaccgggccgtccggtaccgtacgggccctttacgtacgttaccgtggtccggtacgtacgtacggtccgtacggacggttaacccgaaacccctacccgttaacccgttactttaaccggccttacccgggtcgggtaaaccgg

SEQ ID NO: 289438 - DNA, 760 bp, Homo sapiens
  misc_feature: GYAE6OF01ERE8N.25.53.E09.1.454.CMB.1.raw
  modified_base (259)..(259): a, c, t, g, unknown or other
  misc_feature (259)..(259): n is a, c, g, or t
  modified_base (434)..(434): a, c, t, g, unknown or other
  misc_feature (434)..(434): n is a, c, g, or t
tcagactgtacagtcacgaccggtgctcgatttagagagagtgtgttgggttggggggagaggagcccagcactagaagtcggcggtgtttccagtccggtgatcagcactgaacacagaggactcagacagtggagtttgggctgcgcgttgggttttcctcgttgcttcttttaaggaggtctccgtagtgtcagatgcaactggcggaggtcggggagcgtggtccacggacgggacgtccagagacctcgtctgngctagtcgtccgtccgtccgtaccgttccgttcggtttggacctagttccgacgttcggaccgtccgacggccgtaccggaggtccggtaaaacggtccgtagggtacgggtgggtcgggtcgtactagtaggttggtagggtatagggaagttaacgtcgtacttaagttttancggtactaaccgtacgttaccgggtaacggtaccgggtaccctaaccgtaccaaccgttaaccgtcctaaccggaacggtaacggcgaaccgtcccgtaaaccgaaacggttaaaccctttaccgttttaactccgttaacgaaccgtttaacgtaaacccggtaaacgtacggtaaccggtaccgaccgggtaaccacggtacggtacctacgttaacttacgttacgtaacgggcggtccgggttacaacggtaaacgaccggttcggggaccggtccgtacgtacgcgtaacgtcggaccgttccgggaggtaccgtaaccgg

SEQ ID NO: 289439 - DNA, 916 bp, Homo sapiens
  misc_feature: GYAE6OF01BWR14.25.53.E09.1.454.CMB.1.raw
tcagactgtacagtcacgaccggtgctcgatttagagagagtgtgttgggttggggaggtccaactcataagggaaatgctttctgagagtcatggacctcctgtgcaagaacatgaagcacctgtgttcttcctctgctggtggcggccgcccagagtcgggtcctcgtcccagtctgcgtctgcgaggagtcgacgcccgagggcaggtgaacgtccgttcggacgtccctcgtccctcacctcgcctcgttcggtccttcgtcgggtacctacctcctactacctaaccgtaagttacgttcgtacctacgttaacggttccggtcgggggtccgtccggccccgtaccccggacccggaaccccggacccccgggaagggggaaccgggtccgttagggacggttagggtacgtggtcggttatttcggttacctttaggtggtagggtcgggtactcgtacccgttaactaccttacccgtcccttaccgtaacgtaacggtacgttacggtaccgttaccgtaccgttagggttttaccgtaccgtaaccgtacccggtacccggtaacgtaccgtaaccggttcgtttaccggtttaaccgttcccggttaaccgtacgtaaccgtcccggttacttacccgggtttcggtacccgggttacccgacccggggttaaccccggccccgggttacggaaacccccgggtttccgtttaacgtttaacccggttttacggacggttacggaacccggggtaaggtacccgggttacccggggaaccgggttaaaccccggggtaaaaccccccggtaaacccccgttaaaacccccgtttacccccgtttaaccgggttacccgggtaaacccccgggtaaaccccggggttccgggggtaaaaccccggg

SEQ ID NO: 289440 - DNA, 718 bp, Homo sapiens
  misc_feature: GYAE6OF01E1AH3.25.53.E09.1.454.CMB.1.raw
  modified_base (320)..(320): a, c, t, g, unknown or other
  misc_feature (320)..(320): n is a, c, g, or t
tcagactgtacagtcacgaccggtgctcgatttagagagagtgtgttgggtttggggaggtccaactcataagggaaatgctttctgagatcatggacctcctgtgcaagaacatgaagcacctgtggttcttcctctgctggtggcggcgcccagatgggtcctcgtcccagctgcgtctgcgaggacgtcgacgcccgagggcagggtgaacgtcccgttacggacgtaccctgtccccttcacctgtcctcgtcgtctcgtacgggtcacctccactccaaccgtaagtaactcgactactagtacggtcggggccntcgtccgtccgccgaccgaccggacgggacggtacggtacggtacgtacgtacgtacgtacgtacgttcgttacgttacgtagtacggtacggtacgtacgtaccgtaccgtaccgtaccgtacccgtacccgtacgtacggtacgtaccgtacgtaccgtaccgttacgttacggtacgtaccgtaccgtaccgtacgacgtacgtacgtacgtacgtcgtcgtacgtacgtacgtacgtacgtcgtacgtaccgaccggtaccgtaccgtaccgtaccgtaccgtacgttacgtacgtacgtacggtacgtacgtacgtacggtaccggtacccggtaacccgtaaccccgtaacccgtaacccgttaccgtaccgtacccggtaccggtaccggg

SEQ ID NO: 289441 - DNA, 748 bp, Homo sapiens
  misc_feature: GYAE6OF01CJBY9.25.53.E09.1.454.CMB.1.raw
  modified_base (308)..(308): a, c, t, g, unknown or other
  misc_feature (308)..(308): n is a, c, g, or t
tcagactgtacagtcacgaccggtgctcgatttagagagagtgtgttgggtttggggagtccaactcataagggaaatgctttctgagagtcatggacctcctgtgcaaagaacatgaagcacctgtggttcttcctcctgctggtggcggcgccagagtgggtcctgtcccagctgcgtctgcaggacgtcgacggcccagggcaggtgaacgtccgttcggacgaccttcgtcccctcaccgtgcttcgtgtcctcgtggtcgacttccaatccaaccgtaagtaactcgctcgtagtttaccggnggggcgttcggcctcccgccgaccgacccccgaggggaacggtccgtgggtaggtggtagttcggcgttagtttcgttacttttcgaacgttagggtagggttagttccgtacccgttaagtaaccgtaccgtccccttaaccgtacgtaaacggtacgtacgtaacgtccgtacccgtttaagtttccgggttaacaccgtaacccgtccgaccgtcacggttacgtacgtttcgtacgtctacggacctgtcgtaccgtttcgtcgtaccggcccgcccgtaccccggaacgtccggttacccgtttacgtacgttaccgtagggtcgtaggtacggaccggttacggaccggttaacccgggtaccccgtaaaacccccttaccggtaaacccctttaccgttaacgaccccggttacggtccgggggtaaccccgg

SEQ ID NO: 289442 - DNA, 1012 bp, Homo sapiens
  misc_feature: GYAE6OF01BFYDB.25.53.E09.1.454.CMB.1.raw
tcagactgtacagtcacgaccggtgctcgatttagagagagtgtgttgggtttgggggggagaggagcccagcactagaagtcggcggtgtttccattcggtgatcagcactgaacacagaggactcaccatggagtttgggctgagtcgttgggttttccttgttgctcttagtaaaggtgtccattgtcgaggtgcgtaggtttggtgcgaggttcggtggggggtacggtccttcgtacgtaacggccgtggggtaccgggttcccctaggacgtaccttccttccgttggtacgtaacggttccttcgtaggtactttaccacctatactaagttacgtaacctttaacttttacgtcggtccgtaggtacctcccgaccgtacggtccgtaccgggaaagggggtaacggggtccgttagggtaggttaggttaacttttcgttaattttaacgtaacgttaaggttaagttacgggtaaggttaagtacggtaactttaattttaaacgtaacttacccgaacgttacccgttacccgtaccggggaccggggtaccccttaccgttaccccgacccgttacgttaccccgtaacccgggaacggggtaaaccccgaacccgggtaaccctaaaccgtaaacgtttaccccgttaaacccgttttccgttttaaccgtaccgtaaaccgttaaccggttaacggaaccccggttaacccgggttaccggaaccgggtaccccgggaaacggtaaccccgggtaaccgggtttaccccgttaaacctttaccgttaccgggttcggtaaccgggtaccggggtttaaggggtttaaccggggggttttttacggggtttaaactttagggttaacgggtacccgtttaaccgggtaaccccgggttttaacgggttttaaccccgggttttaaaccccccttaaaccccccggttttaaacccccggtttaaaccgtttttaaaacccggggttttaacccccgggg

SEQ ID NO: 289443 - DNA, 763 bp, Homo sapiens
  misc_feature: GYAE6OF01A9UZ4.25.53.E09.1.454.CMB.1.raw
  modified_base (228)..(228): a, c, t, g, unknown or other
  misc_feature (228)..(228): n is a, c, g, or t
  modified_base (281)..(281): a, c, t, g, unknown or other
  misc_feature (281)..(281): n is a, c, g, or t
tcagactgtacagtcacgaccggtgctcgatttagagagagtgtggttgggttgggggaactgctcagttaggaccagagggaaccatggaagccccagctcagcttctcttcctcctgctactctggctcccagattccagcggcgaaactggtgttgacacagtctccagccaccctgtctttgtcgtcggggaacagccacctctctgcagggccgcagactgtnacaacgctagcctaggtaccaactagaagcctggccaggcctccaggcctccnatcatgataccttcaggtacggccagtcggactacctcccgacgtcccgtctttccgaggtgggacctaggttcggggtactacgggggaactaggttaagtttaccgtaccgtacctaaccagtttccctaccgtaagtacccgttaaggaccgtaccgtacggtaaacgttacgtttttacgtaacgttaaacggttttaacgtttaacgttcgggttaacctaacggtaccgttacccggtaaacggaaaggttaaaccggttcggtaacccttaaccgtaaaccgtttacgtttacccgttaacccgttttcccgggtaccccgttaacggggtaaccgttaaacgggttacgggtaattaaaccggtaaccgttaaaaccggtaacgttacggttacggtaccgttacggaccctaaacggtaccgttacttaccggttcctttaccgacctttacccgtttccccgtactaaaccg

SEQ ID NO: 289444 - DNA, 755 bp, Homo sapiens
  misc_feature: GYAE6OF01COPMS.25.53.E09.1.454.CMB.1.raw
tcagactgtacagtcacgaccggtgctcgatttagagagagtgtgttgggtttggggaggtccaactcataaagggaaatgctttctgagagtcatggacctcctgtgcaagaacatgaagcacctgtggttcttcctcctgctggtggcggcgcccagagtgggtcctgtcccagctgcgtctgcaggagtcgacgcccgagggcaggtgaacgtccgttcggaacgcccttcgtccctcaccgtgtccttcgtacgtctcgtcggtacacctaccagtccaactagttatcgtactacgtacgttaacggtcgggtaccgtcggtcccggtaccccgaccgaccccggaccccgggaacgggtaaccgggtccgtagggtagtcggtacgtcgtacgtatttcgttctttaacgtagtaggttagggtacgtaccgtaacttacgttaacctacccgttacccctcccgtaagtaacggtcgttaccgtacgtaccgtacctttacggtttacgtacgaaccgttccgtaccgaccgtcgtaggcgtttaggcctttacgcgtactaccgacgtctacgtcgtcgtaccggacggtcccgaccgtacggtccgtaccgttataacgtttcggcgttacgaggtacgtacgttaccggaaccggttcccggaaaccccgtaaaccccgttaccccgtaaaccccgttttaaggaccccgtttaccgaacccgggggttcgggtaaaaccccggg

SEQ ID NO: 289445 - DNA, 758 bp, Homo sapiens
  misc_feature: GYAE6OF01B4OSO.25.53.E09.1.454.CMB.1.raw
  modified_base (178)..(178): a, c, t, g, unknown or other
  misc_feature (178)..(178): n is a, c, g, or t
  modified_base (657)..(657): a, c, t, g, unknown or other
  misc_feature (657)..(657): n is a, c, g, or t
tcagactgtacagtcacgaccggtgctcgatttagagagagtgtgttgggtttgggagtccaactcataagggaaatgctttctgagagtcatggacctcctgtgacaagaacatgaagcacctgtgttcttcctctgctggtggcgcgccagagtcggtcctcgtcccagctgctcngcaggagtcgacgcccgagggcaggtgacgtccgttacggacctaccctcgtcccctcaccgtcgtccttcgttcgtcctcgtggtactacctcctactaccgaaccgttagtaacgtcgtaccttacgtaacgttcggtcgggtcgtccggacccgtccccggacccgacccggacccccgggtaaggggtacccggtaccggtagggtacggttaggtaacgttcggtacgtaacgtttcggttactttaccggaaggttaggtacgggtacgtaccgtacccgtttaactacccggtacccgttccctacccgtaacgtaacggtaccggtcgaccgttcctaaccgtttgttaccgtacgaccgtaccgtaccgacgtcacgtcgtacgttagtccgtacgcgtaactacgtcgtacgtcgacccgtacgacccggcccgacgtaccgtacccgtccgttacgtcgttacggtancggacgtacggtaccgtcgtaccgggttaacccgaaccccgtaaaccccgtacccttaaaccccgttgtaacccacccgggtcccggaacgggtaacccgg

SEQ ID NO: 289446 - DNA, 719 bp, Homo sapiens
  misc_feature: GYAE6OF01AXSNU.25.53.E09.1.454.CMB.1.raw
  modified_base (397)..(397): a, c, t, g, unknown or other
  misc_feature (397)..(397): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcgcgcccagagtgggtcctgtcccagctgcgtctgcaggagtcgacgcccgagggcaggtagacgccttcggacgaccctgtccctcacctgcctctcgtctcgtggtcacctccactccaccgtaagtaactgacctactacgttacggtggggtctacggtcctccggacccgtacccggaccccggtaaggggaccggtaccggtagggtaggtaggtcgttaggtcgttagtttcgttacgtttnacgtagggtacgggtagtaccgtaccgtaacgtacgtccgttaccctacctacgtaacgtacgtacggacgttactaccttaggttttccggtacgaaccccgttcgaccgtaacgcgtaacgtcggttacgttcgacctttccgtaacgtacccgaacgttcgtaccgtcttaccgggtccgaacccgggtcccgaccgaccggtccggtacccttagttacgtacgttgtgggaacgtacggtacgtaccgacgggttacccgtaacccgaaaaccccttccgaacccgtttacgacggaccgacccgggtgggacccgg

SEQ ID NO: 289447 - DNA, 978 bp, Homo sapiens
  misc_feature: GYAE6OF01BY4FO.25.53.E09.1.454.CMB.1.raw
  modified_base (284)..(284): a, c, t, g, unknown or other
  misc_feature (284)..(284): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctggtggttcttcctcctgcgtggtggcggccgcccagtagtcgggtcctcgtcccagctgcgtctgcagggagtcgacgccccgagggacagggtcgaacgtccgttacggaccgacccctcgtcccctcgacctcgtccttctcgttcctcgtaggtcncctccactacgacctaaggtaactgtcctacttaacgttcggtgggtcctcggtcccgtcccgcccacccggaccccggaggggtacgtacccggtgggtaacggttggtacgttcggacgttatttacggttactttacggtaaggttaggggtacgggttacggtaccgtaaccgtaaccgttacccggtacccttcccccggttaacccgtaaacgttaacgggtacccggttaaccggtacgttacccgttaaccgtttagggttttacccggtaccgggttaaaccccgtacccggttaccccggaaacgtacccggtaagtacccggtttacgggtttaccttaccgtacgttaacccggtaacccgttaacccgggttcgggttaaccccggtttccgttttaaccggggaccccccggtaaccccggggttacccccgggaccccggttaacccggtacccccgggttaccccggttttaccgtaaccggttttacgggttcccggaccggggtaacggttaacggttaacccgggttaaccgtacccccgggggtaaaaccggttttaaaccccccgggtaaaaaccccccccttacccggtttaaaaacccccccggttttacggtttaccccgggtaaacccccgggtacccggggttaaccccgggggggggtaaaccccgg

SEQ ID NO: 289448 - DNA, 661 bp, Homo sapiens
  misc_feature: GYAE6OF01B6HAO.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatcgctcattacgtggggctggctccgccgacgcccccgagggacggcctggagtgattgcgtattgtcttcatgtggagtcgcctactacacgttcccctccctagaacgtacgtacgacgtcctaaccgtcgttttaccggtgaccgtaccgtccccgacgtacagtctacggtttgtccctcgtacgacctacgtacgtaccgtcgttacggtacccgacccggcccgtacccgtacccggaccgggttccccgttacgttaacgtttacccgtaggttccggacggtaccggtcgtaccggacgggacccgggttaacccgtaaaccccccttaacccgtaacccccgtttacgtttaacccgacccttacccgggtcggggtaaaccccgg

SEQ ID NO: 289449 - DNA, 549 bp, Homo sapiens
  misc_feature: GYAE6OF01AONIR.25.53.E09.1.454.CMB.1.raw
  modified_base (299)..(299): a, c, t, g, unknown or other
  misc_feature (299)..(299): n is a, c, g, or t
  modified_base (338)..(338): a, c, t, g, unknown or other
  misc_feature (338)..(338): n is a, c, g, or t
  modified_base (365)..(365): a, c, t, g, unknown or other
  misc_feature (365)..(365): n is a, c, g, or t
  modified_base (402)..(402): a, c, t, g, unknown or other
  misc_feature (402)..(402): n is a, c, g, or t
  modified_base (453)..(453): a, c, t, g, unknown or other
  misc_feature (453)..(453): n is a, c, g, or t
tcagactgtacagtcacgaccggtgctcgatttagagagagtgtgttgggtttgggggggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggagcgtggtccagcctgggaggtccctgagactctcctgtgaagcctctggatttagttcagtggttctggcatgcacgtgggtccnccaggctccaggcaaggggccgagtggttggctagttanagcacatgatggaagttcagaatattntgcagactcgtgaaggccgattcacactctaccaganacaacgttcccggaaactattgtagtacgttaggaatggtacagcctgagngtacgaggacttcggctcgtgtattagtggtgacgacgtagtcgggagggttcggtaagttaggttaacgtacccggggtcacgtgtggtaccggg

SEQ ID NO: 289450 - DNA, 888 bp, Homo sapiens
  misc_feature: GYAE6OF01ASYKB.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaagaacatgaaacacctgtggttcctccctcctgctggtggcagcctcccagagtgggtcctgtcccaggtgcagctggcagggacggtcgggcccaggtacgtgggtacgaacgtcccttacacgacgtacccctggtcccctaccgacctggcctacgttcgttcctcgtcgggttacggtccttacccaacttcctaacccgtaggtttacgtttaactccgtaacgttaaccgtcgggacgtaccgtacggtaacccgttccccgacccgtaagaccccgaaacccgggtaaggggggtaacccgggtaccggttgggggtaaacgggttcggggtttaaacggtttaccgggggttaaccaaacgttttccggtttaaaccgggttttaacccgggacgggggttaaccgaccccgtttaacccctttaaccctaaccccggtaaaccccccggtttccctaacgttaaagtttcccggaacggttacttacccgaaccttcttacccgtaacttagttaaccggaaccttacgttaaaccttaacgacccttacgtttcccaaccggtttagtaacgtttaaccgaactttcggtcgttacgaaccgttcccgggacgtacccgggtaacggtcccggttacgttacgtttaacgtccggttggttacggcccggtaacttaacgtaacccgttaaacggtccgttaaacggtcggttaaccggacccgtaacttacccgtaccaacgtacctaaccgtagttacgtttaccgg

SEQ ID NO: 289451 - DNA, 935 bp, Homo sapiens
  misc_feature: GYAE6OF01A8J0B.25.53.E09.1.454.CMB.1.raw
tcagactgtacagtcacgaccggtgctcgatttagagagagtgtgttgggtttgggggaactgctcagttaggacccagaggaaccatggaagccccagctcagcttctcttcctcctgctactctggctcccagacttccagcggacgaaactgtgttgacacagtctccacgccaccttgttcttggtccgtaccgggggaacgtcgacctaccctctccgtacgcgacgggccgacgacgtacgttgtacgaaccgaaaccgtacgttacgaccgttacggtaaacccaaacgaacgaacgtcccgtcggaccaacgggtcccttaccccgaggtccccttccgtaccttaacgttaccgttagttaccggtaaacttttaaccccggtttaacccggaaacggggtttacccgggaaccccgtaccggtttacgggaacccctaaccctacccccggtaaccgtcccccgtttaacgttaccggtaaggtacggggtaccgtagggttcgggggtacggttacgggtaacgtaacggtttaacgttttcccgacgttaaccgtaacccgttaacttacccgtaccgtaaccggttcctaaaagggaccccttaacgggttaagttaaacggttttaacgttttacgtaccgtttaacgtttttaacgttaacgttacgttaaccggtccgttaaccgtaaccgtaacggtaaaacggtaaccggttccgtaaccccttaacgtaaccttttaacgtaccgtttacccggtttaccgggtacccgtaaacggttaaacccgtaaagttcggtaacttaaaccgtaaacccgtaaaccggttaggtaacccgtacggtaccgttaccgaccgtacgtaactttcggtacgtttacccttacggtacccttccccttaacccggtcttaaaccg

SEQ ID NO: 289452 - DNA, 1008 bp, Homo sapiens
  misc_feature: GYAE6OF01C2CF4.25.53.E09.1.454.CMB.1.raw
tcagactgtacagtcacgaccggtgctcgatttagagagagtgtgttgggtttgggaggtccaactcataagggaaatgctttctgagagtcatggacctcctgtgcaagaacatgaagcacctgtgttcttccctcctgctggtggccggcgcccgagagtcgggtcctcgtcccagctcgcgtctcgcgtaggacgtaccgacggccccgaggggcgagggtagtaacggtcccgttaccggaaccgtccctccgttcccctacctccctggtcctcgtacgttccgttcgtcgggtactaaccttcccgacttaacccaaccgtaacgttaaactcgtaccttaacgttaacgttacgggtcgggcccgttcggtccccgaccccggtccgaccccggaccccggaacgggggtaaccggtccggttagggacggttacgtacggttacggtacgtctttaccgggtttctttactaggtttaacgggtacggttacgtaccgttaccctaacgttacccgtcccggtttaccccacccgttaacgaaacggttctaaacccgggactacccgttaaccgtttaaccgttttcgggtaaaccgtacccgttacgtaccccgagttaacccgacgttccggttacgtttcgccgttaccgacggttaacccgtaccgttcggttaacccggttcgtaacccgggtaccggttaaccccccgggtaacccggtacccggtacccgggtaacccccgggtttaacgtttacccgttaaacggttttaccccggggttgtaaaccccgggttaagggtaacggttaccccggttaaaccgggttaaaccccgggttaaaaccccccggggtttaaaaccccccgggttaaaaccccccctaaaccccccggttttttaaacccccggggtaaacccccgtttttaaaccccgggaccccgggggtttaaaccccccggggtacccgggggggtttaaaaacccccgggg

SEQ ID NO: 289453 - DNA, 910 bp, Homo sapiens
  misc_feature: GYAE6OF01BY9EZ.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtccgacgcccgagggcagggtgaacgtccgttcggaacgtaccccgttcgtcccctcacctcgtccttcgtgttcctcgttggtacgaacccttccgaacttaccaacccgtaagttaacgtcgtaccgttacctaagtttaccgggtcgggggtcctcgggtcccgttacccccggaccccgtacccgggacccccccggaaggggggtaaccggggtccccgtaggggtaaccggttagggtactttacgggaccggttaagtttttccggtttaccgttttaccgtaaggtttaggggttacgggggttaaaccggttccggttaacccccgtttaaaccgttaaccccggttaacccggtttcccccccgttaaccccgttaaccggtaaaacggttacgggttaacccgttaaccggttacccgttaacccgtttacggttttacccgggttacgaacccgttaacccgtaccccgtaaccggtaccgtaaagtcccggttaacggtttccgttacttaccgtaccgaacgtacgttcggtaacgttccgtcgttaccggacccggtcccgaccgtaccgtacccggtccttactacgttacgtcgtacggaccgtaggtccgtaccggacggtaccccggtaaacccgtaaacccccgttacccgtaaaccccgtttacgttacccggaacccgccggggttaccgggaacccgg

SEQ ID NO: 289454 - DNA, 754 bp, Homo sapiens
  misc_feature: GYAE6OF01AP69B.25.53.E09.1.454.CMB.1.raw
  modified_base (161)..(161): a, c, t, g, unknown or other
  misc_feature (161)..(161): n is a, c, g, or t
  modified_base (253)..(253): a, c, t, g, unknown or other
  misc_feature (253)..(253): n is a, c, g, or t
  modified_base (605)..(605): a, c, t, g, unknown or other
  misc_feature (605)..(605): n is a, c, g, or t
  modified_base (678)..(678): a, c, t, g, unknown or other
  misc_feature (678)..(678): n is a, c, g, or t
tcagactgtacagtcacgaccggtgctcgatttagagagagtgtgttgggtttggggaggtccaactcataagggaaatgctttctgagagtcatggacctcctgtgacaagaacatgaagcacctgtggttcttcctcctgcgtggtcggcggcgccagngtcgggtcctcgtcccagctgcgtctgcgaggtagtcgacgcccgagggcgagggtcgaacgtccgttacggactccccttcgtccctaccnccgtgccttctcggtcctcgtggtaccacctcctatccaacgtagttactcgtcttacgtacgttccggtcgggtccgtccggtaccgtccccgacccgacccgggacccccggggtaaggggaccgggtccggttagggtacgggtttcggttaacgttcggtacggtttaacgttccgtttcgttaagttacggtaaggggttacgggtacgttaccgttaaccctaacccgttaccggtacccgtttccccctaccgtacgtaacggtacggttaccacggtacccttacgttacggtttaccgtcgaacccgttaccgtaccgacgtaacgacgtcgttacggtttcncccttagacgtactcgtcggtacgttccgcggtaacccgccggtccgacgtccggtcgtacgttactcgtagngtcgtaggacgtcgacgacgggtaacctacccgtaaccctactacccgttacgtacgacccgtgggtaccgaacgg

SEQ ID NO: 289455 - DNA, 996 bp, Homo sapiens
  misc_feature: GYAE6OF01EXXHN.25.53.E09.1.454.CMB.1.raw
  modified_base (155)..(155): a, c, t, g, unknown or other
  misc_feature (155)..(155): n is a, c, g, or t
  modified_base (210)..(210): a, c, t, g, unknown or other
  misc_feature (210)..(210): n is a, c, g, or t
tcagactgtacagtcacgaccggtgctcgatttagagagagtgtgttgggtttggggaggtccaactcataagggaaatgcttttctgagagtcatggacctcctgtgcaagaacatgaagccacctgtggttcttcctcctgctggtggcggcncccagatgggtcctgtcccagctgcgtctgcaggagtcgagcccagggcagggtnaacgtccttcggactaccctgtcccctcacctgctctcgtctcgtggtcgactccatccaaccgtaagttaaagtcgacctactaacgtttaccggtgggggtaccttcgggccctttccccggacccgtaaccccgggacccccccggaaaggggggaaaccggggtcccgttaggggtaaggttggggtaactttcggggacgttaacgtttttcggttcccgttttacgaaggtttaaaggggttcggggtaacggtttaccgtaccccgtttaaaccgttaacccggttaacccggtttccccccccttaaacccccggttacgaaaacgggttaccggttaaccggtaaccggttcccttaaacccgtttccgggtttttacccgggtttacgaaaccccggttacccccgttaacccgaacccgggtacctaacgggttaacccgttacggggtttttacccgtcccgtttacccggtaacgggtaacccttaccgggttaaccggtttccgtttaaccggttccggtaacccccggggtaaacccccgggtccccggtaacccccgggtaaaccgggttacccccgggttaaccgtttacccgttttaacccgttaaccgggtttcggttacgtaacccggggtagttaccccgggttacggaaccggggttaaccccggggtaaccccgttaaaaaccccccccgtaacccgtttaaacccccgttacggtttaacccggaccccggttaaccggggcccgggggtaaaaccccgggg

SEQ ID NO: 289456 - DNA, 778 bp, Homo sapiens
  misc_feature: GYAE6OF01BRA21.25.53.E09.1.454.CMB.1.raw
  modified_base (104)..(104): a, c, t, g, unknown or other
  misc_feature (104)..(104): n is a, c, g, or t
  modified_base (162)..(162): a, c, t, g, unknown or other
  misc_feature (162)..(162): n is a, c, g, or t
  modified_base (183)..(183): a, c, t, g, unknown or other
  misc_feature (183)..(183): n is a, c, g, or t
  modified_base (264)..(264): a, c, t, g, unknown or other
  misc_feature (264)..(264): n is a, c, g, or t
  modified_base (275)..(275): a, c, t, g, unknown or other
  misc_feature (275)..(275): n is a, c, g, or t
  modified_base (317)..(317): a, c, t, g, unknown or other
  misc_feature (317)..(317): n is a, c, g, or t
  modified_base (342)..(342): a, c, t, g, unknown or other
  misc_feature (342)..(342): n is a, c, g, or t
  modified_base (653)..(653): a, c, t, g, unknown or other
  misc_feature (653)..(653): n is a, c, g, or t
tcagactgtacagtcacgaccggtgctcgatttagagagagtgtgttggggtttgggggggagaggagcccagcactagaagtcggcggtgtttccattcggtnatcagcactgaacacagaggactcaccagtggagttgggctgagcgttgggttttccngttgtcctacgtttttaaggngtcgtcctacgtggtcgaggtcgcctaccgtgggtaggcgtacggtagggggagcggtcggtcacgccgtgggacgtcccngtacgcttccncgtgtcgagccttgtgttatttcgttcgagttcgtctacggncgtcgacgtccggtcgggtaccccncccgtaacggtcctaccggaacgggtaccggacggggggtaccgtaggttccgggtagtacgtagttagaccgtacagacgtaggataacgggtttacgttattaacggttaaaactttacggtttaaactacgggaactaaaccgggttcgggtttacccgaaagggggacccgttaaccgttaccttacgtaacccgtcgtcccgttaaacgacggttaaacgaaacccgtttaaaccgttacccgaaacgttgtttcggtaggtaaccgtttaagttaacggtcgtaccgacgtcgaaggtaaccggnggtccggtaacgtcgtacgcgtttacacgttaggttactagtcggtaacggtggaggttacggggtaggttgttaacggtttacgtacccgggttcgtaccgtcggttaaagtccgggtaacggg

SEQ ID NO: 289457 - DNA, 778 bp, Homo sapiens
  misc_feature: GYAE6OF01DRSYT.25.53.E09.1.454.CMB.1.raw
  modified_base (761)..(761): a, c, t, g, unknown or other
  misc_feature (761)..(761): n is a, c, g, or t
tcagactgtacagtcacgaccggtgctcgatttagagagagtgtgttgggttggggggagaggagcccagcactagaagtcggcggtgtttccagttcggtgatcagcactagaacacagaggactcaccagtggtagtttggctgagtcgttgggttttctcgttgtctttacgttttaagaggttcgtccacgttgtcgagggtcgacctaccgttgggtggtaggtccggtaggggggtacgtccggttcggtcccgaacggtcccgggtaggggttaccggtcccccgttaggaaccgttcctccgttaccgtaggtaacgtaaccgtcccgttcttaggtttaacgtttttaggttccgttaggttccgttcgtgtacgtagtcgtccgtaggtccggtcccgaccgaggtccacggtaacggacgggtacggggtccgggtggttcgggtagtacgtagttagaccgcaagtgtgtcgtaaggtacttacgttaataagttacttagtcgactacggtacgtacggtaggaaccggtactacgtccgaactccgtaaccgcgaaggaccgaccgaacgaaccttaccgtaaacgttaacctttaccgttttacacgttaactaacggtaacgttaaccgtaacggtaacgtaccgaacccgttacggacccgtaaccgtcgttacctcggtattaccggagtccggtgggtaccgtgtaaaggacggttcgaaccggggttcgacgttcgacggngtacgcggtcgtaccgg

SEQ ID NO: 289458 - DNA, 509 bp, Homo sapiens
  misc_feature: GYAE6OF02IWR9U.25.53.E09.1.454.CMB.1.raw
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtctccgggggaacgagccaccctctcctgcagggccggccagactgttgacaacgacttagcctggtaccaacagaagcctggccaggctcccaggctcctcatctatgatacttccagtagggccactggcatcccagcccgcttcagtggcagtgggtctggggacagagtttactctcaccatctccagcctagagcctgaagattttgctagtttattactgtcagctcgcaagaagtggcctccaatattcactttcgccctggaccaaagtggatatcaacgactgtggctgcacatctgtcttcatcttccgctac

SEQ ID NO: 289459 - DNA, 548 bp, Homo sapiens
  misc_feature: GYAE6OF02I3F5A.25.53.E09.1.454.CMB.1.raw
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccggccagactgttgacaacgacttagcctggtaccaacagaagcctggccaggctcccaggctcctcatctatgatacttccagtaggccactggcatcccagcccgcttcagtggcaggtgggtctggggacaggtagtttactctcaccatctccagccctagacgcctgaagtattttgctagtttattactgtcagtctccgacaagagtcggcctaccaattacttctacttttccggcccttacgggacctaaaggtggaactaatacaaacgtactggtcggctgacacctatcttcgttcttctacttccttcccgctac

SEQ ID NO: 289460 - DNA, 522 bp, Homo sapiens
  misc_feature: GYAE6OF02FQNTR.25.53.E09.1.454.CMB.1.raw
  modified_base (471)..(471): a, c, t, g, unknown or other
  misc_feature (471)..(471): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtgactccatcaccagtaatgctcattactgggctggctccgccacgcccccagggaacgggcctggagtggattgcgattgtctttcatagtgggagtgcctactacagtccctcctcaagacgtcgagtcacctagtttcggttgacacgtccacgcagcagttgtctctgacactgacgtctgtcacggccgccgacacggcctctattactgtgcgagngtcaggcggtacgaacccctacaacccctatttcgactaccgtgggacccg

SEQ ID NO: 289461 - DNA, 549 bp, Homo sapiens
  misc_feature: GYAE6OF02IR2KI.25.53.E09.1.454.CMB.1.raw
  modified_base (392)..(392): a, c, t, g, unknown or other
  misc_feature (392)..(392): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggtaggtgaagccttcggagaccctgtccctcacctgctctgtctctggtgactccatcaccagtaatgctcattactggggctggctccgccacgcccccagggaacggcctggagtggaattggcgattgtctttcatagtgggatcgcttactacagtccctcctcaagagtcgagtcacatttcggttnacacgtcacgcagcagttgtctctgacactgacgtctgtcacggccgaccgacaccgggccgtactacttacgtcgtgcgagtacgtcacgcgggtcggaaaacccccttcgaacccccttagtttacgaacctacccgttaggggccctaacgggg

SEQ ID NO: 289462 - DNA, 579 bp, Homo sapiens
  misc_feature: GYAE6OF02HS87H.25.53.E09.1.454.CMB.1.raw
  modified_base (376)..(376): a, c, t, g, unknown or other
  misc_feature (376)..(376): n is a, c, g, or t
  modified_base (398)..(398): a, c, t, g, unknown or other
  misc_feature (398)..(398): n is a, c, g, or t
  modified_base (505)..(505): a, c, t, g, unknown or other
  misc_feature (505)..(505): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccacgcccccgagggaacgggccgtggagtggattgcgtattgtctttcataggtgggagtgcctactacacgtccctcctcaagngtcgagtcacctattttcggtnacacgtccacgcagctagttgtcctcgtcgaccacgtgaccgttctcggttaccacgggcccgcccgacgaccgggcccgttactattaccgtgtacggcgtaaggnggttcagggtcccgggtacggaaaccccctactaaccccctttacgtttcgaaccctcccggtggggaacccgg

SEQ ID NO: 289463 - DNA, 508 bp, Homo sapiens
  misc_feature: GYAE6OF02FTAH1.25.53.E09.1.454.CMB.1.raw
  modified_base (329)..(329): a, c, t, g, unknown or other
  misc_feature (329)..(329): n is a, c, g, or t
  modified_base (362)..(362): a, c, t, g, unknown or other
  misc_feature (362)..(362): n is a, c, g, or t
  modified_base (383)..(383): a, c, t, g, unknown or other
  misc_feature (383)..(383): n is a, c, g, or t
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtctccgggggaacgagccaccctctcctgcagggccggccagactgttgacaacgacttagcctggtaccaacagaagcctggccaggctcccaggctcctcatctatgatacttccagtaggccactggcatcccagcccgnttcagtggcagtgggtctgggacagagtttacnctcaccatctccagcctagancctgaagtattttgctagtttattactgtcagctcgcaagaagtgctccaatattcactttcgcctggacctaaagtgatatacaaacgactgtgctgcacatctgttcttcatcttcccgctac

SEQ ID NO: 289464 - DNA, 613 bp, Homo sapiens
  misc_feature: GYAE6OF02I84N6.25.53.E09.1.454.CMB.1.raw
tcagactgtacagtcacgaccggtgctcgatttagagagagtgtgttgggtttggggggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggaggcgtggtccagcctgggaggtccctgagactctcctgtgaagcctctggatttagttcagtggttctggcatgcactgggtcccgccaggcctccgaggcaagggggccggagtggttggcagttatagcacatgatggaagtttctgaattattatgacagactccggtaggaacgggtccgattccaccctagtcctcccgaagtacgaactaacgttacccgggaactagtttcgtacgttactttagggaaacttcggtacaggtccctaggagaggtcggagtaccgtcggcttcgtagttacttacgtggtgcggtaggtacgtcgggggtaaggttcgggttaaggttacggtttacggttacccggggcggtaccgtaggtggtaaccggg

SEQ ID NO: 289465 - DNA, 569 bp, Homo sapiens
  misc_feature: GYAE6OF02IIU6S.25.53.E09.1.454.CMB.1.raw
  modified_base (377)..(377): a, c, t, g, unknown or other
  misc_feature (377)..(377): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtgactccatcaccagtaatgctcattacgtggggctggctccgccacgccccgagggacggcctggagtggattgcgtattgtcttcagtaggtgggagtgcctactacacgtccctccctacaacgngtcgagtcacctagtttcggtgacacgtccacgcagctagttcgtctctgaccacgtgaccgttctcgtccgaccggcccgcccgaaccgccggtccgtactacttacgtgtcgcgaggtacgtcgacggtcggtaccgaaacccctaccgaaccccttacgtttaccggaacctcccggtacgggacccgg

SEQ ID NO: 289466 - DNA, 589 bp, Homo sapiens
  misc_feature: GYAE6OF02HYSJH.25.53.E09.1.454.CMB.1.raw
tcagactgtacagtcacgaccggtgctcgatttagagagagtgtgttgggtttggggggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccgccagactgtgacaacgacttagcctggtaaccaacagaagcctggccaggctcccgaggcctcctcatctatgtatacttccagtacgggccacgtggcactccccagccccgcttcgaggtggcgaggtgggtctggggacagtagtttactctcaccatcctccagtcctagcgcctagaagtattttgcttagtttacttactgtcagtcctccgacaaggtaagtcggtcctacctaattacttcctacgtttccggcccgtacgggaacctaaaggtggaacttaagtaaccgaaacgtacttaggtacggcttacggacctacctatcgttcgttcttcctacttcccttcccgacctac

SEQ ID NO: 289467 - DNA, 527 bp, Homo sapiens
  misc_feature: GYAE6OF02JG4GT.25.53.E09.1.454.CMB.1.raw
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccacgcccccagggaggcctggagtggattgcgattgtctttcatagtgggagtgcctactacagtccctcctcaacgagtcgagtcaccatttcggtnacncgtccacgcagcagttgtctctgacactgacgtctgtcgacggccgccgaccacggcctctattactgtcgcgagtagtcagccggtacgaacccctacgtaaccccttacgttcgaccgtaccgtcgggacccg

SEQ ID NO: 289468 - DNA, 556 bp, Homo sapiens
  misc_feature: GYAE6OF02H00BB.25.53.E09.1.454.CMB.1.raw
  modified_base (379)..(379): a, c, t, g, unknown or other
  misc_feature (379)..(379): n is a, c, g, or t
  modified_base (427)..(427): a, c, t, g, unknown or other
  misc_feature (427)..(427): n is a, c, g, or t
  modified_base (430)..(430): a, c, t, g, unknown or other
  misc_feature (430)..(430): n is a, c, g, or t
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagacccctgtccctcacctgctctgtctctggtgactccatcaccagtaatgctcattactggggctggctccgccagcccccgagggaacgggcctggagtggattgcgattgtctttcagtaggtgggagtgccttactacacgtcccctccctacaagngtcgagtcaccatttcggtgacacgtccacgcagccagttcgctcgtnacnctgacgtntgtcncggccgccgacgacggtccgtactacttacgtcgtgcgagtacgtccgagccggttacggaaacccccttaccgaaccccttctttacggaaccgtaccgtggggtaacccgg

SEQ ID NO: 289469 - DNA, 520 bp, Homo sapiens
  misc_feature: GYAE6OF02HTHEL.25.53.E09.1.454.CMB.1.raw
  modified_base (257)..(257): a, c, t, g, unknown or other
  misc_feature (257)..(257): n is a, c, g, or t
  modified_base (324)..(324): a, c, t, g, unknown or other
  misc_feature (324)..(324): n is a, c, g, or t
  modified_base (357)..(357): a, c, t, g, unknown or other
  misc_feature (357)..(357): n is a, c, g, or t
  modified_base (418)..(418): a, c, t, g, unknown or other
  misc_feature (418)..(418): n is a, c, g, or t
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccgccagactgttgacaacgacttagcctggtaccaanagaagcctggccaggcctcccaggctcctcatctatgatacttcagtaggccatgcatccagcccgnttcagtgcagtgggtctgggacagtagtttacntcaccatctccagcctagagtcctgaagtattttgctagtttattactgtacagtctccgnaagagtgctcaatattctactttcgcctcggactaaagtgatatacaaacgactgtcgcttacgctaaccgatactcgtaccttcgacttcttccccgctac

SEQ ID NO: 289470 - DNA, 638 bp, Homo sapiens
  misc_feature: GYAE6OF02G3N4N.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcgggagaccctgtcccctcacctgctctgtctctggtgactccatcaccagtaatgctcattactggggctggctccgccacgcccccagggaacggcctggagtggattgcgattgtctttcatagtggggagtcgcctactacacgtccctcctcaacgagtcgacgtcacctagtttcggtgactacgtccacgcacgctagttcgtactctacgacctcgtagtaccgtcgttgtaccgtaccgggcccgacccggaaccgaacccgggtcccgtttactaacgtttaaccgtggttccggacggtacggtacggtaccgtacgggtaccgggttaacccgggtaaaacccccttaacccgtaaacccccgttaacgttttaccgggaacccgttacccgggtacggggtaaccccgggg

SEQ ID NO: 289471 - DNA, 549 bp, Homo sapiens
  misc_feature: GYAE6OF02GQ7V8.25.53.E09.1.454.CMB.1.raw
  modified_base (537)..(537): a, c, t, g, unknown or other
  misc_feature (537)..(537): n is a, c, g, or t
tcagactgtacagtcacgaccggtgctcgatttagagagagtgtgttgggtttgggggggagaggagcccagcactagaagtcggcggtgtttccattcggtgatcagcactgaacacagaggactcaccatggagttttgggctgagctggggtttttcctcgttgctctttttaagaggtgtccactgtcaggtgcacctggtggagtctggggggaggcgtggtcccagccctggggaggtcccctgagactctcctgtgaagcctctggattttagttttcagtggttctggcatgcactggggtcccgccaggctccaggcaagggggccggagtggttggcagttatagcacatgatggaagtttctgaatattactgcagactccgtgaacggggcctagttcaccatctccagagacaattccccggaatatttgtgtacttgaaacttgtacagcctgagtgtcgacggactcggctcgtgtattactgtgcgtagatcggggagtggtagtagttacgttaccgggncgtagtgtacgg

SEQ ID NO: 289472 - DNA, 532 bp, Homo sapiens
  misc_feature: GYAE6OF02FXEKH.25.53.E09.1.454.CMB.1.raw
  modified_base (394)..(394): a, c, t, g, unknown or other
  misc_feature (394)..(394): n is a, c, g, or t
  modified_base (481)..(481): a, c, t, g, unknown or other
  misc_feature (481)..(481): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccacgcccccgagggacggcctggagtggattgcgattgtctttcatagtgggagtgcctactacacgtcccctccctcaagagtcgagtcacctatttcggtnacacgtccacgcagcagttcgtctctgaccactgaccgttcgtcgtcgaccggccgaccgaccgacggcctctattactgtgcgagngtcaggcgtacggaacccctacaaccccttattcgactaccgtgggacccg

SEQ ID NO: 289473 - DNA, 596 bp, Homo sapiens
  misc_feature: GYAE6OF02ICHI0.25.53.E09.1.454.CMB.1.raw
  modified_base (202)..(202): a, c, t, g, unknown or other
  misc_feature (202)..(202): n is a, c, g, or t
  modified_base (388)..(388): a, c, t, g, unknown or other
  misc_feature (388)..(388): n is a, c, g, or t
tcagactgtacagtcacgaccggtgctcgatttagagagagtgtgttgggtttggggggaactgctcagttaggacccagagggaaccatggaagccccagctcagcttctcttcctcctgctactctggctcccagattccagcggcgaaactgtgttgacacagtctccagccaccctgtctttgtcgtccgggggaacngccaccctctcctgcagggccggccagactgttgacaacgacttagcctggtaccaacagaagcctggccaggctcccaggcctcctcatctatgacttacttcccaaggtagggccacgtggcactccccgacgccccgtcttcgagtcggctaggtggggtctggggacaggtacgttttaccnctcaacctatcctaccagtcctagacgccgtagaacgtattttcggactaagttttattaacgtcgtacacgtctcccgacaagtagtcgcctacaattattcctaccgtttcgacccgtaggacctaaagtcggtaataacgtacaaacgtacgtgtacggctcgactacctatccgttcgtaccttcacttcccttacccgctacg

SEQ ID NO: 289474 - DNA, 685 bp, Homo sapiens
  misc_feature: GYAE6OF02I9HBV.25.53.E09.1.454.CMB.1.raw
tcagactgtacagtcacgaccggtgctcgatttagagagagtgtgttgggtctgggggaggcgtggtccagcctgggaggtccctgagactctcctgtgaagcctctgggttcagcgttagtcacagctacttgatctgggtccgccaggctccagggaaggggctggagtgcgtctcagttatttatagcgataataccacctactacgcagactccgtgaagggccgattccttatctccagagacaattccaggaacaccctctatcttcaaatgaacgccctgaggcgacggacgacgaccggtcgtagttactgtgcggcgggaggatactacgtggttagtttacgttacgttaactttacctttaccctttacccgtacggggtccgggtacgggttaccccggtttccggtcggtacccgtaccgttcccttccctacgcctccctacccaaccgggacccgacctacggttcccgtttccccccttcccggtcggccccgttccgccgtcccgtaccggacggtccacccgtccgaccggagaccgaccaacggccggcccgtccgggcgtccgccgtcggtacgaacgtaacgtaaccttcccgtacctacgttacgtacgtccgttcgacggaccgggccggtacgacggaacggtacggccgaactacggagc

SEQ ID NO: 289475 - DNA, 600 bp, Homo sapiens
  misc_feature: GYAE6OF02H2A1M.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattacgtggggctggctccgccacgcccccgaggggaacggcctgggagtggattgcgtattcggttactttcgagttaggtgggtagtcgccttaactacgacgttcccctccctacaacgtacgtcgacgtccacctagttttcggtacgactacgtccacgcaacgctagttcgtctctagactctgaccgttctacgtccgacgggcccgaccgacgaccggtccgtacttagttactggtagcggtagtacgtcgaggtccggttaaccgaaacccccttacgaaccccctttagttacgaacccgtaccggtcgggaacccgg

SEQ ID NO: 289476 - DNA, 534 bp, Homo sapiens
  misc_feature: GYAE6OF02FLRRR.25.53.E09.1.454.CMB.1.raw
  modified_base (375)..(375): a, c, t, g, unknown or other
  misc_feature (375)..(375): n is a, c, g, or t
  modified_base (457)..(457): a, c, t, g, unknown or other
  misc_feature (457)..(457): n is a, c, g, or t
  modified_base (525)..(525): a, c, t, g, unknown or other
  misc_feature (525)..(525): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccacgcccccgagggaacgggcctgggagtggattgcgattgtctttcatagtgggagtgcctactacacgtccctccctcaagngtcgagtccacctatttcggtcgactacgtccacgcagcagttgtctctgacacgtgacgtctcgtcacggcccgccgaccncggcctctacttacgtgtgcgaggcgtcaggcggtacggaacccctacacccctagttcgactaccgngggtacccg

SEQ ID NO: 289477 - DNA, 719 bp, Homo sapiens
  misc_feature: GYAE6OF02IEIHV.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggcctccgccacgcccccgaagggacgggcctggacgtggattgcgtattgttcttcataggtgggagtcgcctaacgtacacgttcccctccctacgaacgtacgtaccgtacgtacctaaccgtaacgttttttccgggtacgtaaccgtacccggttccctaaccggcctaacggtcctaacggttttcggttccttaccgtcggtaaccctaacgttcggtaaccgttcgttcgttaccggaccgggccccgggtacccgaccgtaacccgggtcccgttacgttaactttaaccgttggttcggaccggtaaggtaccgttaccggaacgggttcccggggttaacccggtaaaaccccccctttaccgtaaaccccccgtttacgttttacccggaacccgttaccccgggtcgggggtaaacccccggg

SEQ ID NO: 289478 - DNA, 538 bp, Homo sapiens
  misc_feature: GYAE6OF02GTWK0.25.53.E09.1.454.CMB.1.raw
  modified_base (486)..(486): a, c, t, g, unknown or other
  misc_feature (486)..(486): n is a, c, g, or t
  modified_base (529)..(529): a, c, t, g, unknown or other
  misc_feature (529)..(529): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccacgcccccgagggacgggcctgggagtggattgcgattgtctttcataggtgggagtgcctactacacgtccctccctcaagagtcgagtcacctagtttcggtgacacgtccacgcagcagttcgtctctgacctactgaccgttctcgtaccacggcccgaccgacgaccggccgtctattactgtgcgagngtcaggtcggtacgaaccctacaccccttagttcgactaccgngggtacccg

SEQ ID NO: 289479 - DNA, 586 bp, Homo sapiens
  misc_feature: GYAE6OF02GI76S.25.53.E09.1.454.CMB.1.raw
  modified_base (434)..(434): a, c, t, g, unknown or other
  misc_feature (434)..(434): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtgactccatcaccagtaatgctcattacgtgggctggctccgccacgcccccgagggaacggcctgggagtggagttgcgtattcgtctttcagtaggtgggagtcgcctactactacgtccctcctacaagtacgtcgagtccacctagtttccggtagacctacgtccacgcacgtctagttntctctcgacactgactctcgtaccgacggccgaccgacgaccggtccgtactacgttcgtgttcgacgtacggtcgtaccgacggtccggtaaccgtaaacccctacgtaaccccttacgtttacgacccgtacccggtcgggtaaccccgg

SEQ ID NO: 289480 - DNA, 594 bp, Homo sapiens
  misc_feature: GYAE6OF02FPS26.25.53.E09.1.454.CMB.1.raw
tcagactgtacagtcacgaccggtgctcgatttagagagagtgtgttgggtctgggggaggcgtggtccagcctgggaggtccctgagactctcctgtgaagcctctggatttagtttcagtggttctggcatgcactgggtccgccaggctccaggcaaggggccggagtggttggcagttatagcacatgatggaagttctgaatattatgcagactccgtgaagggccattcaccatctccagagacaattcccggaacattgtgtacttggaaatggtcagcctgagagtcgaggactcggctctgtattactgtgcgagagtcgggaggtggtagtagttagttaccgggcgcatgacgtggggccaggggaccctggtccaccgtctccgtcacgcctaccaccgaacgggcccagtccggtcccttccccgtggccgcccctgtccctaccgaggacgccaccgtccgagacgcacgacggccggcccgtgggcctcggtaccgtcggtaccgtaacggtaccttacccgttccctaccgttacgtaaccgtacggttcccgtagggacggccggggtctaccgggg

SEQ ID NO: 289481 - DNA, 834 bp, Homo sapiens
  misc_feature: GYAE6OF02JRYAZ.25.53.E09.1.454.CMB.1.raw
  modified_base (194)..(194): a, c, t, g, unknown or other
  misc_feature (194)..(194): n is a, c, g, or t
tcagactgtacagtcacgaccggtgctcgatttagagagagtgtgttgggtttggggtaggtccgaacgtcataagggaaatgctttctgagagtcatggacctcctgtgcaagaacatgaagcacctgtggttcttcctcctgctggtggcggcgcccagatcgggtcctgtcccagccgtgcgtctgcaggngtcgagcccgagggccaggtcgaagcccgttagggacgacccttgtacccgtcacccgttgcctacgttgtccttctaggttcgaacctcctaatcctacctaaggttaactcgtacctctaacgtttacgtcggggtctacgggtcccgttcccgcctaaccggtccccccgaaaggggtaccggtaccgtcgggtaacgttgggaacgttcggaccggtagtttcggtactttttacgaacgtttgggtacgggtaacggttcgtacccgttaaagtaccgtacgtacccccttccgtacgaaaccggtcgtaccgtacgttaccgacctacgttttcccggtagtaccgtacccgttaccgtaaccgtaccgtacgtaccgttacgtttacggtaccgttaccttcggtaacctaccgttacgtaaccggttcccgttaaggtcccgtacccggtacccggtacccggtaaccgacccgggtacccgttaccgttaacgttaaccttccgggtaccgtaccgggtaacgtaccggttacgaccgggttaccggttaacccgggaaaccccttaccccggtaacccgttaccgttttaccccggaaccgttaccccgggtaacccggggtaacccggg

SEQ ID NO: 289482 - DNA, 643 bp, Homo sapiens
  misc_feature: GYAE6OF02JPIQC.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtgactccatcaccagtaatgctcattacgtgggctggcctccgccacgcccccgagggaacggccgtggacgtggattgcgtattcgtcttttcagttaggtgggagtcggacctacgtacacgttccctccctacaagacgtcgagtcacctagtttcggtacgactaccgtccacgtcagcctagttcgtccgtatcgacctactcgtaccgttctcggtccaaccgggtcccgacccggaccgtccgggtacccttacgtaaccgtttaccgtacggttcggacgtacggtacgtccgtaacgggtcccgggttaaccgaaaccccccgttaaccgaaccccccgtttagtttaccggaaccccgtaacccgggttccgggggaaacccgg

SEQ ID NO: 289483 - DNA, 654 bp, Homo sapiens
  misc_feature: GYAE6OF02IU76A.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcgaccagtaatgctcattacgtgggctggcctccgccacgccccgagggacggcctacggagtggacttgcgtattgtctttcaagttaggtgggagtcgtaccgttactaacgacgttcccctcccttacgaaacggtacgtcgaacgttacctaacctagttttccggttgaacccgtacgttcccgaacgctacggcgtaagtttcggtcttcctacgtacctactggaccgttcgtcggtaccgacccgggcccgacccgaaccgaccggtcccgttacgtacgtttacgtgtacgcgaggtacgtaccgacgggtaccggttacccggaaaacccctaccgtaaacccccgttacgtttaccggaaccttacccggttacggggaaccccgg

SEQ ID NO: 289484 - DNA, 575 bp, Homo sapiens
  misc_feature: GYAE6OF02JH9FX.25.53.E09.1.454.CMB.1.raw
  modified_base (404)..(404): a, c, t, g, unknown or other
  misc_feature (404)..(404): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattacgtgggctggctccgccacgcccccagggaacggccgtggacgtggattgcgtattcgtctttcagtaggtgggagtcgcctactacacgtccctccctcaagacgtcgacgtcacctagtttcggttnaccgtaccgtccacgcagctacgttcgtactctgactactcgacgtctgtccacgggccgccgacgaccggccgtcttacgttacgtgtcgcgaggtcgtacgacggcggttaccggtaaacccctaccgtaccccgttactttacggaccctaccggttcggggacccgg

SEQ ID NO: 289485 - DNA, 533 bp, Homo sapiens
  misc_feature: GYAE6OF02JCEST.25.53.E09.1.454.CMB.1.raw
  modified_base (203)..(203): a, c, t, g, unknown or other
  misc_feature (203)..(203): n is a, c, g, or t
  modified_base (472)..(472): a, c, t, g, unknown or other
  misc_feature (472)..(472): n is a, c, g, or t
  modified_base (516)..(516): a, c, t, g, unknown or other
  misc_feature (516)..(516): n is a, c, g, or t
tcagactgtacagtcacgaccggtgctcgatttagagagagtgtgttgggtctgggggaggcgtggtccagcctgggaggtccctgagactctcctgtgaagcctctggatttagtttcagtggttctggcatgcactgggtccgccaggctccaggcaaggggccggagtggttggcagttatagcacatgatggaagttcngaatattatgcagactccgtgaagggccattcaccatctccagagacaattcccggaacattgtgtacttggaaatggtcagcctgagagtcgagactcggctctgtattctgtgcgagatcgggaggtggtagtagttagttaccgggcgcagtgacgtggggccaggggaccctggtccaccgtctcctcacgcctccaccacggcccatccggtccttcccccgtggccgccctgcctccgaggacgccaccgtccgagacgcacncgccggcctgggctgcctggtcgaaggactacttccactgtacngtctgacggcggctcgg

SEQ ID NO: 289486 - DNA, 618 bp, Homo sapiens
  misc_feature: GYAE6OF02IHLLZ.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagccccaggggcaggtgaagccttcggagaccctgtccctcacctgctctgtctctggtgactccatcaccagtaatgctcattacgtggggctggcctccgccacgcccccgagggacgggcctggagtggattgcgtattgtcttcagtagtgggtagtcgtcctactacacgttcccctccctacaagacgtcgacgtcactagttttcggtagaccgtacgtccagcagctagttcgtctctcgacactgacgttctcgtccgaccggcccgcccggacgacccggtcccgttaccttaacgtttacgtcggttcgaccggtagaacggtccgaacgggtcccgggtaccggtaaaaaccccccgttaccgaaaccccccgtttacgtttaccggaacccgtaccccggtaggggaccccgg

SEQ ID NO: 289487 - DNA, 723 bp, Homo sapiens
  misc_feature: GYAE6OF02IXE4S.25.53.E09.1.454.CMB.1.raw
  modified_base (262)..(262): a, c, t, g, unknown or other
  misc_feature (262)..(262): n is a, c, g, or t
  modified_base (302)..(302): a, c, t, g, unknown or other
  misc_feature (302)..(302): n is a, c, g, or t
tcagactgtacagtcacgaccggtgctcgatttagagagagtgtgttgggtttggggggagaggagcccagcactagaagtcggcggtgtttccattcggtgatcagcactgaacacagaggactcaccatggagtttgggctgagctgggtttcctcgttgctcttttaagaggtgtccactgtcaggtgcacctggtgagtcgtgggggagcgtggtccagccgtgggacggtccctgagactcgtcctggtgaagcctntaggatttagttcagtgttctagcatgcacgtgggtcccnccgaggctccagggacctaaggggcccggtagtcgggtttcggacgtaggtttaagtacggccaagtgtaggtaactggggtaaaacggttttccaaggaaaatttacgttttaaaggcgaccgtaacgtacccgtccggtagggaacgggtacctactaccgaactacgtcctacgaagacgtaacgtaacgtaccgtaatcgttagttacgttaacgtagaagtcgtacgacgaccgtaggtaacgtacggtaccggtaacggtccgttaccgtacgttacggttaagttaacgtttaccggttgtacggtaacgggtaacggttaccgggttaacggggggtaaggtttaacgggttaacggtttaacggttttaaccggggtacccggttccggaacgttacggttacgggaccggg

SEQ ID NO: 289488 - DNA, 665 bp, Homo sapiens
  misc_feature: GYAE6OF02FVQ2I.25.53.E09.1.454.CMB.1.raw
  modified_base (159)..(159): a, c, t, g, unknown or other
  misc_feature (159)..(159): n is a, c, g, or t
tcagactgtacagtcacgaccggtgctcgatttagagagagtgtgtttggggttttgggggaggtccaactcataagggaaatgctttctgagagtcatggacctcctgtgccaagaaccatgaagcaccctgtggttcttcctcctgctggtggcggnggcccagactggtctgtcccagctgcgtctgcaggagtcgacgccaggcagtgagccttcggagacctgtcctcacctgctctgtctctggtgactccatcaccgataatgctccattaccgtcgggactcggctccgccacggaccccagggaacgggcctggaggtcggacttcggcgtacttgtcgtttctagtaggttggggacgtcgaccttaccgtacgaccgtccccttccctaccgtaaccgacggttccggaacgtacctacccttaaggttttccgggtttacgaacccgccggttacccgacgtcgagtctacgtttgttccttctaggtacctacgtggaccgttcgtcggtccgaccgggtccgacccggtacgaccggtcccgttcttaacgttcgtggtcgccggtaggtaccggtccgacggtacccgggtacgaaacccccgtccaaccccgttacgtttcccgaacgttacccggttagggaccccgg

SEQ ID NO: 289489 - DNA, 652 bp, Homo sapiens
  misc_feature: GYAE6OF02HYTRQ.25.53.E09.1.454.CMB.1.raw
tcagactgtacagtcacgaccggtgctcgatttagagagagtgtgttgggtttggggggaactgctcagttaggacccagagggaaccatggaagccccagctcagcttctcttcctcctgctactctggctcccagattccagcggcgaaactgtgttgacacagtctccagccaccctgttctttgtcgtccgggggaacgagccaccctctcctgcagggccgccagactgttgacaacgacttagcctggtaccaacagaacgcctggccaggcctcccgaggctcctcatctatgattactccagtacggccacgtggcactcccagcccgtcttcgagtcggcaggtcgggtcgtggggacaggtacgtttactctacacctatccctacacgtcctaaggtacgacctaggaaacgtttcttttacgacttaagttttacttacgtcgttacacggtcctccgaacgtaaggtaacggttcgaccctactaattacgtttcctaccgtttccggacccgttacgggaaccttaaaggtacggtacttaaacgtaaccgtaaacggtacgttcggtacggtcttacgacctaaccgtattccgttcgttacctttacctaacgtttccccgttaccccgcttaacg

SEQ ID NO: 289490 - DNA, 712 bp, Homo sapiens
  misc_feature: GYAE6OF02J2PGC.25.53.E09.1.454.CMB.1.raw
tcagactgtacagtcacgaccggtgctcgatttagagagagtgtgttgggtttgggacggtccaacgtcataagggaaatgctttctgagagtcatggacctcctgtgcaagaacatgaagcacctgtggttcttcctctcgctggtgcggcgcccagactgggtcctgtcccagctgcgtctgcaggatcgagcccgagggccaggtgaacgtccttacgggacgacccctcgtcccctcaacccgtgccttctgtacctcgtggttcgaccttccgattccaccgtagtaactcgctcctagttacgtggggctcggtccttccggaccacggcccccgaaggggaaccggccgttgggacgtacggtaagtttcggaccgttagttcgttccgttttacaagttacggtcgggtaacgtcggtaccctacgtacgaccgttccctcgtacgaacggtacgtcgacgtacaccgttacgtttcggtacgtacgaaccgttcgacgcgtacgcgtaagttcgcttccgacgtaccacgtcgaccgttcgtccggttccgaccggtcccgaccggtaccgtaaccggtcccgttacgtaacgttcgtaacggtcgtacggtacgtaaccggtttcacggtcccggtaaccgtaaaccccgtacgtaacccccgttagtttacgaacccggttaccggtacgggtaaccccgg

SEQ ID NO: 289491 - DNA, 692 bp, Homo sapiens
  misc_feature: GYAE6OF02HP2DJ.25.53.E09.1.454.CMB.1.raw
  modified_base (318)..(318): a, c, t, g, unknown or other
  misc_feature (318)..(318): n is a, c, g, or t
tcagactgtacagtcacgaccggtgctcgatttagagagagtgtgttgggtttgggggctctgggagaggagcccagcactagaagtcggcggtgtttccattcggtgatcagcactgaacacagaggactcaccatggagtttgggctgagcttgggttttcctcgttgcttcttttaagaggtgtccactgtcaggtgcaccgtggtggagtcgtgggggaggcgtggtccagccgtgggacggtccctgacgactctcctgtgaagcctcgtggtattttagttcagttggttctggcatgcacgtcggggtccnccgaggcctaccgaggacgaagggggccggaggttggttcggctagtttagtacgcactagtaggagtaggtaagtttctagtaaattattagtcgtacgacgtacgtccggtaggtaacggccgtacttaccaacctactcctaccgacgtacgtaacctaacgttacccggaaattacgttgttacgttaacgttaggaaacgttcggtacacgtccgtaggaacggtagtaccggaacggtacgttccgggactttacgtacgtttaacgttacggtggtacggtaccggtaaggttacgggttaccgggggtagggtttacgggttaacgggtttaacggtttaaccgggttacccggggacttaacggg

SEQ ID NO: 289492 - DNA, 651 bp, Homo sapiens
  misc_feature: GYAE6OF02ITZJ6.25.53.E09.1.454.CMB.1.raw
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
tcagactgtacagtcacgaccggtgctcgatttagagagagtgtgttgggtttgggggggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtctgggggaggcgtggtccagcctgggaggtccctgagactctcctgtgaagcctctggatttagtttcagtggttctggcatgcactgtcgtcccgaccagggcctaccgaaggccgaaaggggccggtagtggttggcagtttanagccanatcgaatggtaagttctaaggaattagttatgcagtacctccggtaggaacgggcccgtattccgaacctatcctaccgacgtaacgaaccaacgttaccccggtaaatacgtttgtagttaaccgttagggaaacgttacggtcaagtccctaggaaggtagttaccgggaaggtaccgtcgggtccttacgttagttactttacgtggtcggtaaccgggtaagtacggtacggggtacgggttagggttaaggttaaggtttacggttaacccggggctacgtagtacgg

SEQ ID NO: 289493 - DNA, 567 bp, Homo sapiens
  misc_feature: GYAE6OF02F645L.25.53.E09.1.454.CMB.1.raw
  modified_base (279)..(279): a, c, t, g, unknown or other
  misc_feature (279)..(279): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtgactccatcaccagtaatgctcattacgnggggctggctccgccacgcccccgagggaacggccgtggagtggattgcgtattgtctttcattaggtgggagtcgcctactacacgtcccctcctcaagacgtcgagtcactatttcggttgacacgtccacgcacgcagttcgtctctgactctgtcgtctcgtcaccggcccgaccgaccgtaccggcccttacttacttacgtgtcgcgagtcgtcgacggtaccggtaccgtaaacccctaccgtaaccccgttacgttacgacctaccggtcgggtacccgg

SEQ ID NO: 289494 - DNA, 725 bp, Homo sapiens
  misc_feature: GYAE6OF02FWZ8I.25.53.E09.1.454.CMB.1.raw
tcagactgtacagtcacgaccggtgctcgatttagagagagtgtgttgggtttgggggggagaggagcccagcactagaagtcggcggtgtttccattcggtgatcagcactgaacacagaggactcaccatgggagtttgggctgagctgggttttcctcgttgctcttttaagaggtgtccactgtcaggtgcacctggtggagtcgtgggggaggcgtggtccagccgtgggaggtccctgagactctcctgtgaacgcctctggtatttagttcaggtggttctggcagtgccacgttcggggtcccgccgagggccttacccgagggccggaaacggggggcccggaggttcgggtttggccgtaaggtttaagtaggccaacgataggagtaggggtaaagtttcctaggaaaatttagtttatcggactaagaccgttccggtaagggaacggggcccgtatttccaaccctataccgtacccgaagacgtaacctaacgttaccccgggaactagtttagtcgttaacgttaggaaaacgttgggtactaacggcccttagggacggtacggtacgggaacggtaccgttcgggtacctcgttaggtaactttcgtagggttcggacggtaaggtacggttaccggggggtaaggttacgggttaaggttaggtttaaccggttaaccggggccgtacgtacgtcgggtaacccggg

SEQ ID NO: 289495 - DNA, 740 bp, Homo sapiens
  misc_feature: GYAE6OF02HYXDW.25.53.E09.1.454.CMB.1.raw
  modified_base (260)..(260): a, c, t, g, unknown or other
  misc_feature (260)..(260): n is a, c, g, or t
  modified_base (296)..(296): a, c, t, g, unknown or other
  misc_feature (296)..(296): n is a, c, g, or t
tcagactgtacagtcacgaccggtgctcgatttagagagagtgtgttgggtttggggggaactgctcagttaggacccagagggaaccatggaagccccagctcagcttctcttcctcctgctactctggctcccagattccagcggcgaaactgtgttgacacagtctccagccaccctgtctttgtcgtccgggggaacagcctaccctctcctgcgagggccgcagactgttgacaacgacttagcctggtaccaanagaagcctggccaggcctccaggctcctacatctangactacttccaaggtacggcctaacgtggacctactccccgaacggccccgtacgtttaccgaggttcggacgtaacgggttcgggtccgttagggggaactaacggttacgttttacctccgttaccaaacctcttccgtacccgacggtaccctaagggaccgtcccgttaggaaacgtttaccgtttttgaccgttaagtttttaacgttaccgttacggtaccgtacggtaccttacccggaagttaaaggacggttccgtaccgtacctaaaggtttacttaccgttaacgttttcccggaccgttaacgggaaccctaaagggttcgtaactaaacgtaaccgtaaaacggtacgttagggtcggtacttaccggacctaaccgtaagtttccgtacgtttaccttaccgtaacgtttcccttaccccggcttaaccg

SEQ ID NO: 289496 - DNA, 576 bp, Homo sapiens
  misc_feature: GYAE6OF02H1X6S.25.53.E09.1.454.CMB.1.raw
  modified_base (252)..(252): a, c, t, g, unknown or other
  misc_feature (252)..(252): n is a, c, g, or t
  modified_base (361)..(361): a, c, t, g, unknown or other
  misc_feature (361)..(361): n is a, c, g, or t
  modified_base (373)..(373): a, c, t, g, unknown or other
  misc_feature (373)..(373): n is a, c, g, or t
  modified_base (527)..(527): a, c, t, g, unknown or other
  misc_feature (527)..(527): n is a, c, g, or t
tcagactgtacagtcacgaccggtgctcgatttagagagagtgtgttgggtttgggggaactgctcagttaggacccagagggaaccatggaagccccagctcagcttctcttcctcctgctactctggctcccagattccagcggcgaaactgtgttgacacagtctccagccaccctgtcttgctccgggggaacagccaccctctcctgcagggccgcagactgtgacaacgcttagcctggtaccaanagaagcctggcccaggcctcccaggcctcctcatctatgatacttcagtagggccatggcatcccagcccgcttcgagtggcaggtgggtctggggacagtagtttacnctcaccattccncagtcctaggctaccgtagaagtattttgctaagtttattactgtactagtcgtccgacgaaagacgtcggtacctccgaaattacttccgtaacctttccggaccccttagggaacctaaaggtggaataactacgaaacgtacgtgtcggtntacggacacctagtaccttgtccttctacttccctttacccgccttacg

SEQ ID NO: 289497 - DNA, 602 bp, Homo sapiens
  misc_feature: GYAE6OF02I900X.25.53.E09.1.454.CMB.1.raw
  modified_base (410)..(410): a, c, t, g, unknown or other
  misc_feature (410)..(410): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtgactccatcaccagtaatgctcattacgtgggctcggctccgccacgccccgagggaacggctggagtggattgcgtattgtctttcgagtagtgggtagtcgaccttacgtactacgttcccctcctacaacgagtcgaacgtcacgtagttttcggtnaccgtacgtccacgacacgctagttgtcttcgtacaacctcgtagaccgttcgtcggtaccgaccgggcccgaccgaaccgccgggtacccttctaacttacgtgtcgacgtaggcgtacgacggtaccggtaccgtaaaccccttaccgtaaccccttacgttaccggaccgtacccggtcgggaacccgg

SEQ ID NO: 289498 - DNA, 663 bp, Homo sapiens
  misc_feature: GYAE6OF02JT2H7.25.53.E09.1.454.CMB.1.raw
  modified_base (183)..(183): a, c, t, g, unknown or other
  misc_feature (183)..(183): n is a, c, g, or t
  modified_base (203)..(203): a, c, t, g, unknown or other
  misc_feature (203)..(203): n is a, c, g, or t
  modified_base (520)..(520): a, c, t, g, unknown or other
  misc_feature (520)..(520): n is a, c, g, or t
  modified_base (532)..(532): a, c, t, g, unknown or other
  misc_feature (532)..(532): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtgttctcctctgctggtgcggcgccagatgggtcctgtcccagctgcgtctgcaggngtcgagcccgagggcaggtnaaaggcccttcgggacgaccccttgtcccctcgaccttgcctcgtcgtcctcgtggtacgtacctccactctacctagtaatcgtctctattacgtggggctcgggcctaccgcccacggccccgagggtccggggcctagggcgtcggactaggtcgtagtttcgccgttttcaaggtaggttgggacgttacgcctaacgtacctcgtccccgtcccgacgtaacggcggtaccgtacgtccctacgtagtttcccggttaggaccctacggtacccaacgctaacggccttacgttacgtctaccgtgtaaccncgtaggtccgtnttaccggcctacggggccctacggaccttccggaccgtactacgttaccttggctacggaccgtagttcccgaaggtcccgtaacgtaccccacgaacccgttgttaaccggccgtaccggtcggaaccgg

SEQ ID NO: 289499 - DNA, 696 bp, Homo sapiens
  misc_feature: GYAE6OF02FET34.25.53.E09.1.454.CMB.1.raw
  modified_base (247)..(247): a, c, t, g, unknown or other
  misc_feature (247)..(247): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaacgccttcggacaccctgtcccctcacctgctctgtctntggtgactccatcaccagtaatgctctattacgtgggctcggctccgccgacgccccgaggaacgggccgtggagtgattcgcgtagtttgtctttcgagttaggtggggacgtcgtacctaacgtaccgtacgtcccctacccgtacgaaacgtcgtaccgacgttacctacccgttagtttcccggtttagaaccccgtaccggttacccgaaccgtccgtaacggtccgtacggttttcgttacctccgttacgacctacgttcgtaacccgttcgttcggaccgtacccgggacccgtacccgaaccggtacccgggtacccgtttaccttaacgtttaccgtggttcgacggtacggtacgttaccggacggtaacccgggtaccgtaaacccctacccgtaaccccttacgttaccgaaccgtaccggttaccgggaacccgg

SEQ ID NO: 289500 - DNA, 678 bp, Homo sapiens
  misc_feature: GYAE6OF02IAT58.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagccccagggcaggtgaagtcccttcggacgaccctgtccctcacctgctctgtctcgtggtgacctccactccaccagtaactgctcattacgtggggctggcctccgccacgcccccgagggaacggcctggagtggattgcgtattggttctttacagttaggtggggtagtcggacctttaacgtaacctacgttccccctccctacgaacgacgttacgaccgttccaaccgtacgttttcgggttacgtaaccgtacgtacccacgcgaagtccgtaggtttcggtccttcgtacgtacctacgttcgtaaccgttcgttcggtccgaccggtccccgacccgaccggtaccggtcccggttactttaaccgttaaccgttgtacggtccgaaggtcgtaccgacggtaccgggttaaccgaaacccccgttacccaaccccgtttacgtttccgaacgtacccggtcgggtaaccccgg

SEQ ID NO: 289501 - DNA, 769 bp, Homo sapiens
  misc_feature: GYAE6OF02HH6G1.25.53.E09.1.454.CMB.1.raw
  modified_base (292)..(292): a, c, t, g, unknown or other
  misc_feature (292)..(292): n is a, c, g, or t
tcagactgtacagtcacgaccggtgctcgatttagagagagtgtgttgggtttgggggggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtggggggagcttcgtcaagcctgggagggtccctgagactcctcctgtgaagtctcgtggattcaccatcaatgactactttanggcctggatccgccaggctaccgaggggaagggctagggagtgggtatttcgaattttacgtcaaggttaagtgggaaggttaagtcgggtactaattttaacgaaattcccgaagtacctccgtaccggtacgggggccctacgttaccaccgtactcctaccgaacgggaaccgaacgggtacccaaacgtaaactacctaaaccgtttcctttaccgtacgtaacgtaaacggtacggaaaccggtacccggtacccggaacggtacccgggaacgggacccgtaaccggggtacccggttaccgttaaccgtttccggtacggttacgggacggttaacggggtaggggttttacggggggtttaactttagggttacggtaacgttcgggtacccggttaggttacgggtttaacccttaaaccccgttacccccgttaacgtttaaacccgttttacggttaaacccgggg

SEQ ID NO: 289502 - DNA, 718 bp, Homo sapiens
  misc_feature: GYAE6OF02JGZA0.25.53.E09.1.454.CMB.1.raw
  modified_base (201)..(201): a, c, t, g, unknown or other
  misc_feature (201)..(201): n is a, c, g, or t
  modified_base (296)..(296): a, c, t, g, unknown or other
  misc_feature (296)..(296): n is a, c, g, or t
  modified_base (346)..(346): a, c, t, g, unknown or other
  misc_feature (346)..(346): n is a, c, g, or t
tcagactgtacagtcacgaccggtgctcgatttagagagagtgtgttgggtttggggggaacgtgctcagttaggacccagagggaaccatggaagccccagctcagcttctcttcctcctgctactctggctccagattccagcggcgaaactgtgttgacacagtctccagccaccctgtctttgtctccgggggaacngtccacctctcctgcagggccggcaggacctgttcgacaacgactttacgcctggtaccaaacgagtaacgcctggccaggctcccgaggctccncacgtctatgactacttccagtacggctactcggcactcccacgcccgtnttcagttcggcctagtgggtccgtagggtactacgtacggtttactactaccgacctactccgttccacgacccttagaccgtacctcgaacgtacgtttcgacgttacgtttattaacttcgttactaacggtcccttaccggtacgtaaacggttaacggtaccggtacccttaccgtaaactttaacttaccgttaaccgtttcccgggtaacccgttacgggtaaccgtaaacggtttacgggaacttaacgtaacgtaaaccggttaacgttacggtacggttaccgttacgtacgtaacccgtacgttaacccgttcggtttacctttacctaaccgttttcccgtacccggttaccccttaaccg

SEQ ID NO: 289503 - DNA, 670 bp, Homo sapiens
  misc_feature: GYAE6OF02GOYO9.25.53.E09.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
  modified_base (367)..(367): a, c, t, g, unknown or other
  misc_feature (367)..(367): n is a, c, g, or t
tcagactgtacagtcacgaccggtgctcgatttagagagagtgtgttgggtttggggggaactgctcagttaggacccagagggaaccatggaagccccagctcagcttctcttcctcctgctactctggctcccagattccagcggcgaaactgtgttgacacagtcctccagccaccctgtctttgtcgtccgggggaacngcccaccctctcctgcgagggcccggcaggacttgttacgacaacgtacttagccctaggtaccaacagaacgcctcggaccaggcctccaggcctccncatctatcgacttacttcccgaggttacggggccacgttgggacctactccccgacgaccccgtnttcgaacggttggactagggttcggggtcgtaggggaccaaggtttacgtttacctctaccgaacctatccctaccgacgtcccgttaaacgcgtacccgttaggtaaacgtttactttacggtactttagttttactacgtttcgtcacgtcctaccgagtaacggtacgcgtcccataatcttctaccgtttccggccttacggaacctaaaggtcgtaatacgtaacgtaaacgtgttcggtacggtctacgacctactaacgtccgtacgttacctcttaccgtaccttcccgactacg

SEQ ID NO: 289504 - DNA, 570 bp, Homo sapiens
  misc_feature: GYAE6OF02G86V3.25.53.E09.1.454.CMB.1.raw
  modified_base (457)..(457): a, c, t, g, unknown or other
  misc_feature (457)..(457): n is a, c, g, or t
  modified_base (493)..(493): a, c, t, g, unknown or other
  misc_feature (493)..(493): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
tcagactgtacagtcacgaccggtgctcgatttagagagagtgtgttgggtttggggggggagaggagcccagcactagaagtcggcggtgtttccattcggtgatcagcactgaacacagaggactcaccatggagtttgggctgagctgggttttcctcgttgctgttttaaaaggtgtccagtgtgaggtgcagctggcggagtctggaggaggcctgatccagcctggggggtccctgagactctcctgtgcagcctctgggttcagcgttagtcacagctacttgatctgggtcccgccaggtctccgaggggaaggggctggagtgcgtctctagttatttatgacgataactaccacctactacgcagaccttccgtgaacgggccgtatttccttatcctaccagacgactaattccaaggaacccacctctatcttacaatcgaaccnccctagagcgccgaggaccacggccgtgtattacgngtgcggnggganactcgtaggtgtttacttcgtatttaccttactttcccgtacgtcgggccctagggttccctcgg

SEQ ID NO: 289505 - DNA, 599 bp, Homo sapiens
  misc_feature: GYAE6OF02JK56I.25.53.E09.1.454.CMB.1.raw
  modified_base (220)..(220): a, c, t, g, unknown or other
  misc_feature (220)..(220): n is a, c, g, or t
  modified_base (479)..(479): a, c, t, g, unknown or other
  misc_feature (479)..(479): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggganaccctgtcccctcacctgctctgtctctggtgacctccatcaccagtaatgctcattacgtgggctggcctccgccacgcccccgagggaacggccgtgggacgtggattgacgtagtttgtcctttcgagtaggtggggagtcgaccctacgtacgtacgttcccctccctacaagcgttacgacgtcacctgtttcggtgacaccgtcacgcacgctagttgtctactgactactgaccgtctcgtcgaccggtccnccggaaccgccggtccgtacgttaacgttacgtggtcgacggacgtacggtaccgaggtcccggtaccgtaaacccctaccgtaaccccttcgttacgacctaccggtcgggtaacccgg

SEQ ID NO: 289506 - DNA, 898 bp, Homo sapiens
  misc_feature: GYAE6OF02FQSAC.25.53.E09.1.454.CMB.1.raw
tcagactgtacagtcacgaccggtgctcgatttagagagagtgtgttgggtttgggggctctgggagaggagcccagcactagaagtcggcggtgtttccattcggtgatcagcactgaacacagaggactcaccatggagtttgggctgagctgggtttcctcgttgctcttttaagaggtgtccactgtcaggtgcacctggtggagtcgtgggggaggcgtggtccagccgtggggacggtccctggacgaccttctccgtgtcgaacgcctcgtggtattttacggttcaggttcggttctcgggtactagttcggccctaaccgttgggggtcccccggtaccgacgggtcctacccggaaggggtaccccggaaaagggggggtccccgggtaagggtttacggggtttcgggtaccgtaaggttttacgaacggtccaaacgtagttacggaagttgggtaaaagttttccgtaaggtaaacttaagtttaagtacggtaccgaaacgtacccgtaccggttaacgggaaccgggtacccggtacgtttaacccgaacccgtacgttacccgtacccgtaaaggtaaaccgtaacccgtaaaccggttaccccgaaaactttcggtttacggttaacgtttaacggttaacggggtaaaactttcgggttaaccggtaacgtaccggttacggggaaacggtacgggttacccggggtaacgggtaccccggtttacgggtccgtttacccgtttaggtttaaccgtttaacggtttcgggtcgggttaaccggtaacggtttaccggggttaccggggttaaggggtttagggttttaaaccggggttaagggttttttacccgggtacccgggggttagtaaccccggg

SEQ ID NO: 289507 - DNA, 629 bp, Homo sapiens
  misc_feature: GYAE6OF02JG09M.25.53.E09.1.454.CMB.1.raw
  modified_base (413)..(413): a, c, t, g, unknown or other
  misc_feature (413)..(413): n is a, c, g, or t
  modified_base (608)..(608): a, c, t, g, unknown or other
  misc_feature (608)..(608): n is a, c, g, or t
tcagactgtacagtcacgaccggtgctcgatttagagagagtgtgttgggtttggggggaactgctcagttaggacccagagggaaccatggaagccccagctcagcttctcttcctcctgctactctggctcccagattccagcggcgaaactgtgttgacacagtctccagccaccctgtctttgtcgtccgggggaacgacgccaccctctcctgcgacgggccggccagactggttgaaccaacgtacttagcctggtaaccaacagaacgcctggccaggcctcccgaggcctcctcatctatgactacttcgaagtcggaccacgtcggcacgtcccacgcccgtcttacgagtggcgtaggtcggtacgtacggggacaaggtacgtttacctctacaccattccnccgagtcctaaggactcgtagtaagttagtttgactagtttattactcgttcacggtctccggactaaagtacggtcgtcctacaattctacctacgtttccggccgtacggtaacgtaacgtcggtaatacgtacgaaacgtacgttcggacggtcacggtactaacccgtattccgtttacgttcttaccgtntttaccccgtcccgacttaac

SEQ ID NO: 289508 - DNA, 861 bp, Homo sapiens
  misc_feature: GYAE6OF02IEUJN.25.53.E09.1.454.CMB.1.raw
  modified_base (179)..(179): a, c, t, g, unknown or other
  misc_feature (179)..(179): n is a, c, g, or t
  modified_base (784)..(784): a, c, t, g, unknown or other
  misc_feature (784)..(784): n is a, c, g, or t
tcagactgtacagtcacgaccggtgctcgatttagagagagtgtgttgggtttgggggggagaggagcccagcactagaagtcggcggtgtttccattcggtgatcagcaactgaacacagaggactcaccatggagtttggctgagcttgggttttcctcgttgccttacttttaagnggtctccactgtcgaggtgcctacgttggtggtagttcggtgggggaggtcggtcggtccaggccgtgggggcgttcccgtaggacgtacctccttccgtggtacgaacgtcccttgttaggttatttttacggtttcaggtttcggttcgtggtacctagttcggccgttacggttccggggtacccgaccgacgggtccctaccggacggggaccggtaacggggggtcccggtggttgggttacggtacgttaaggtttagaaccggcctaaagtaggtaggtaaggttagggttaaaccgttttagtaaaggtaaattttaacggtttagacggtactaacggtaaccggttccggtaaggggtaaaccgggtccttaacttacccgaaccttaccgtacccgttaacgaacggtaaacgtaaccgttaaacccggtttacccggaaagtttcttacgggtttaacgtttaaacggttaagggtaaagtttccggactaacggtccggtttaacggaacgggttcgaacccggggtacggtccgtaaccgggttccttaaagttgtttaaccgttacggttggaccggagttaaaccgggnggtttaacgggggtaggttttagggtaaccgttttaggtaaccgggttcccgggataccgtaggtccgggtaacggg

SEQ ID NO: 289509 - DNA, 753 bp, Homo sapiens
  misc_feature: GYAE6OF02F174K.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccgagggcagggtgaacgtccgttcgggacgaccccttcggtccccttaccgaccctgccttctgtccttcgtgggtcgtacctccatccaacctagtaatgcctactaacttacgtcggggtctcggcctcccgaccgaccgacccccggaagggaccgggccgtagggtacggtggtagttcggcggtagtttcgttctttacgtagttagggtggggtacggtcgtacccttaacgtacgtacccgttcccccgttacccgtaacgtaaacggtacggtaccgtacgtacctaaccgttacggttttccggttacgaaccgtaccgtacccacgctaacgctacggttctctacgtacgacctaacgtcgtacccggtcttacggtccgtacccgggcccgtacccggaccgtaccgggtcccttacgttaacgtttcgtcggtacgaccggtaagtaccggttacgaccgggttaccggtaaccggtaaacccccttaccctaaaccccggtttacgttacccggaacccgttaccggtaccggggtaacccgg

SEQ ID NO: 289510 - DNA, 727 bp, Homo sapiens
  misc_feature: GYAE6OF02ID9SN.25.53.E09.1.454.CMB.1.raw
  modified_base (221)..(221): a, c, t, g, unknown or other
  misc_feature (221)..(221): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccgagggcaggtgaacgccttcgganaccctgtcccctcacctgccttctgtctcgtggtcgactccactcaccagtaatgctcattacgtgggctggcctccgccacgccccgagggacggccgtggagtggtagtcgcgtattgttcttcagttaggtggtacgtgtaccctacgtacacgtccctcccacgtaagtacgtcgtaacgtcctaacgttacgttttacgggtacgaccgttaccgtcccgtaaccgacgacgtaccgtacgtttcgttccttacgtacgtaccgtaccgtcggtacccgttacgtcggttacccgaccgggtaccccggtacccgaaccggtaacccgggttcccgttaaccgtttaaccgtttacgttccgggttaccgaacggtacggtacggtaccggtaacgggtacccgggttaaacccgggttaaaccccccttaaccccggttaaccccgtttaaccggtttaccggtaacccgttaccccggggtacggggtaacccccgggg

SEQ ID NO: 289511 - DNA, 757 bp, Homo sapiens
  misc_feature: GYAE6OF02HU6H3.25.53.E09.1.454.CMB.1.raw
  modified_base (200)..(200): a, c, t, g, unknown or other
  misc_feature (200)..(200): n is a, c, g, or t
  modified_base (258)..(258): a, c, t, g, unknown or other
  misc_feature (258)..(258): n is a, c, g, or t
tcagactgtacagtcacgaccggtgctcgatttagagagagtgtgttgggtttgggggaactgctcagttaggacccagagggaaccatggaagccccagctcagcttctcttcctctgctactctggctcccagattccagcggcgtaaactggtgttgacacagtctccagccacctgtctttgcgtccggggaacanccaccctctcctgcgagggccgcagtactgtgacaacgtacttacgcctaggaaccanagaacgccgtggccaggcctcccgaggcctcctcatcgtatgaacttaccttaccgaggtcgggacctacggtggccacgtccccgagtccccgtattaccgaggttcggacgtaggtcgggggttacctaggggtacctagggttaacgtttacctaccgtacctaaaccgtcttcccgtaccgaacggtcccgtaaggaccgtccgttaacggtaacgttaacgttttacgacgtttaagttttacgttaacgttacggtaactacgtacccgtaaccggtaacgtaaacggtaacgttacggtaaccttacgtaaacgtttaccttaccgttaccgtttccccggaccggttaaccggtaaccgtaaacgggtaacgtaacttaacgtaaccgaaaccgtacggttacggtacggtaccgtaccggtaccgtaacccgttacgttaccgtttacgttccgtttaccgtaaccgttcccggtttcccgacttacccg

SEQ ID NO: 289512 - DNA, 664 bp, Homo sapiens
  misc_feature: GYAE6OF02IBJP0.25.53.E09.1.454.CMB.1.raw
tcagactgtacagtcacgaccggtgctcgatttagagagagtgtgttgggtttggggaggtccaactcataagggaaatgctttctgagagtcatggacctctgtgcaagaacatgaagcacctgtggttcttcctcctgctggtggcggcgcccagatgggtcctgtcccagctgcgtctgcaggagtcgacgccccagggcagggtgaagccttcggacaccctgtcccctcacctgcttctgtctcgtggtcgactccatccaaccagtaatgctcattacgtgggctggcctccgccacgccccgagggaggcctggagtggatgacgtgttgttcttcagtacggtgggtagtcggtaccttaacgtactaccgttcccctaccctacgaaggtacgtcgacgtaccaccttacggttttacggtcgtaacctaccgtccctaccgtcaacgcgtaagttcggttctcgtcgaacctacgtcgtaccgttcgtacgtccgaccggcccgacccggtacacccgggtccgttaccttaactttcgtacgtcggacggtaacgtacgtccgaacggtaccgggttaacccgtaaaccccgttaacccgtaaacccctttacgtttacggaccccgttacccgggtacggggtaaccccggg

SEQ ID NO: 289513 - DNA, 567 bp, Homo sapiens
  misc_feature: GYAE6OF02GHU1S.25.53.E09.1.454.CMB.1.raw
  modified_base (268)..(268): a, c, t, g, unknown or other
  misc_feature (268)..(268): n is a, c, g, or t
  modified_base (438)..(438): a, c, t, g, unknown or other
  misc_feature (438)..(438): n is a, c, g, or t
  modified_base (461)..(461): a, c, t, g, unknown or other
  misc_feature (461)..(461): n is a, c, g, or t
tcagactgtacagtcacgaccggtgctcgatttagagagagtgtgttgggtctgggggaggcgtggtccagcctgggaggtccctgagactctcctgtgaagcctctggatttagtttcagtggttctggcatgcactgggtccgccaggctccaggcaaggggccggagtggttggcagttatagcacatgatggaagttctgaatattatgcagactccgtgaaggccgattcaccatctccagagacaattcccggaacattgtntacttggaaatggtcagcctgagagtcgaggactcggctctgtattactgtgcgagagtcgggaggttggtaagttagttagttaccgggcgacgatgactgggggccagggggccctggtccacgtctcctcagccctcaccgaaggcccagtccggtccttcccccgnggcccgcccttgcctccgaggcnccgacctccgagcgcacgagccggcccgtgggcctgcccgtggtaccaacgggtacctacgttcccaacgttcgaccttaggtcctaggacggtccgggctccggg

SEQ ID NO: 289514 - DNA, 758 bp, Homo sapiens
  misc_feature: GYAE6OF02HY1SX.25.53.E09.1.454.CMB.1.raw
tcagactgtacagtcacgaccggtgctcgatttagagagagtgtgttgggtttgggggggaactgctcagttaggacccagagggaaccatggaagccccagctcagcttctcttcctcctgctactctggctcccagattccagcgcgaaactgtgttgacacagtctccagccaccctgtctttgtccgtccgggggaacgacgccacccctctcctgcgaggccggcagactgttagacaacgacttacgcctaggtaccaacagaacgcctggccaggcctacccaggcctcctcatacttatgaacttaccttccaaggtacgggccctaacgtggacctactccccgagccccgtctttcgaggtcggctaggtcggggtctcggggaactaggttagtttacctacgttaccaaccgtacttcctacccacggtaccctaaggccgtacctagtaaagtttattttacggtacgttacgttttaagtttaccgtgtaccgtaacgtaccgttacccgaacgtaaagggtaccgggttcggtacccgggttacccggggtaactttacggggtttaccggtaacccgggtacgggggaaaccgtaacggtacgggtaacggaaacggtaccgtaaaccgtaaacggttaccgttcggtacggtaccgtccgtaacccgtaccgtaacggttcccgttagttacccgtttaccgtacccgtttaacccggttcccctaccgttaccgtaccgg

SEQ ID NO: 289515 - DNA, 684 bp, Homo sapiens
  misc_feature: GYAE6OF02HBT55.25.53.E09.1.454.CMB.1.raw
  modified_base (189)..(189): a, c, t, g, unknown or other
  misc_feature (189)..(189): n is a, c, g, or t
  modified_base (277)..(277): a, c, t, g, unknown or other
  misc_feature (277)..(277): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcgaggngtcgagcccgagggcagggtgaagccgttggacaccctgtccctcacctgctctcgtactcgtggtcgactccactcaaccgagtaancgtctatacgttacgtgggctcggctccgaccgaccgaccccggaaggggacggccgtggtaggtgtagttggacgtagttcgttcgttctagtaggtcggtagtcgtactacgtacgtcgtaccctccctacgaacgtcgtacgacgtacctaccgtagtttacgtacgtacgtaccgtcaccgacgtacgtcgtaggttcgttactacgttagacctacggtacgtaccgtcgtcggtaccgaccggcccgacccgacggtacccgtacgttacgttaacttcggtcggtacggacggacgttacggaccgtacggggtaacccggttaaccccgtaaaacccgttacccgttaaccccgttaccggtttaacggccccggtacgggttacccgggaaccccggg

SEQ ID NO: 289516 - DNA, 713 bp, Homo sapiens
  misc_feature: GYAE6OF02HBZVV.25.53.E09.1.454.CMB.1.raw
  modified_base (202)..(202): a, c, t, g, unknown or other
  misc_feature (202)..(202): n is a, c, g, or t
  modified_base (350)..(350): a, c, t, g, unknown or other
  misc_feature (350)..(350): n is a, c, g, or t
tcagactgtacagtcacgaccggtgctcgatttagagagagtgtgttgggtttggggggaactgctcagttaggacccagagggaaccatggaagccccagctcagcttctcttcctcctgctactctggctcccagattccagcggcgaaactgtgttgacacagtctccagccaccctgtctttgtcgtccgggggaacngccaccctctcctgcgacgggccgcagactgttcgacaacgacttagcctacggtaccaacagaagccgtggccaggcctcccgaggcctcctcactctagtgtactaccttccaggtacggccacgtcggcactcccagtccccgtnttacacggtggacagggtcgggtctcggggaactaggtacgtttactctactacctatcctacacgtcctacgacgtaccgtagtaacgttgttttagtacgtttagttttaactttacgttacggttactacgtcccgttaccgtaacgtaaacggttaacggttcggtaccctaacctaacttacgtttaccgttaccgttttcccgggtacccgttacgggtaacccgtaaaggttacggtaacgtaacgttaacgtaaaccgtacgttcgggttacggtcctacggtacctaacccgttacgttaccttacggtttacctttaccgttaccgtttacccctttcccggtaccttaaccg

SEQ ID NO: 289517 - DNA, 783 bp, Homo sapiens
  misc_feature: GYAE6OF02F9OEK.25.53.E09.1.454.CMB.1.raw
  modified_base (234)..(234): a, c, t, g, unknown or other
  misc_feature (234)..(234): n is a, c, g, or t
  modified_base (299)..(299): a, c, t, g, unknown or other
  misc_feature (299)..(299): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtcgaagccttcggagccctagtcccctanacctgctactgtcctctggtcgacttccatccaccaagtaactgcctactattacgtcggggacncggtcctacccggccgaaccgccccccgaaggggtaacggtccgtagggtagtacggggtattggacgttaagttcgttacttttacgagttacggtaggggacgttcgtaccgttaacgtacgtaaccggtccccttacccgttagaaaccggtagtaccggaacgttaccctaaccgttaacgttttcgggttaacgtaaccgtaacccggttaccgaaccggtccgtaaacgggcccgttaaggttttacgtccgttaccgttaacggtaacctaaccgggtcttaaacccggttgtaccgtttaaccgacccgggttacccgaccggaacccggtacccggttacgttacgttaaatttaccggttcgtacgccgggttaaagtaacgggtccgtaaacggaccgggttaacccggtaaaaccccctaaccgtaacccgttttacccttacgaacccgttaccggttacgggaacccggg

SEQ ID NO: 289518 - DNA, 811 bp, Homo sapiens
  misc_feature: GYAE6OF02HPXH4.25.53.E09.1.454.CMB.1.raw
tcagactgtacagtcacgaccggtgctcgatttagagagagtgtgttgggtttggggggggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggaggcgtggtccagcctgggaggtccctgagctctcctgtgaagcctctggattttagtttcaggttggttctggcagtgcacgtcgggtccgccgaggcctccgagggcggaagggggcccggtaggtgggttggactaggttatacgcactagtgtacgtaggaagtttcgtagtaaagttatttaagtggactaaggtacccgttaccgggtaggggtaaacggggtccccgtaagtttcccgaaacccctatttaccccgtaccgaaggtaacggtaaacctaaaccgggtttaaccccggaaaccttaaggtttaggtttaagtttaaccggttaagggttaaaacgttggggtaccctaacggtcgttaaggaaacgggttacgggtaaccggtaaccggggtaacccgtttaccgggtacccgtttaccggtttagggtttaacgttttaccggttgggttccgggttaaggggtaacggttacggggttaccgggggttaacggggtttagggtttaaaccggggtttacggtttaaccggggtttaccccgggggacgttacggtaacgggttgggtaaccccggggg

SEQ ID NO: 289519 - DNA, 701 bp, Homo sapiens
  misc_feature: GYAE6OF02HE2EE.25.53.E09.1.454.CMB.1.raw
  modified_base (471)..(471): a, c, t, g, unknown or other
  misc_feature (471)..(471): n is a, c, g, or t
tcagactgtacagtcacgaccggtgctcgatttagagagagtgtgttgggtttgggggggagaggagcccagcactagaagtcggcggtgtttccattcggtgatcagcactgaacacagaggactcaccatggagtttgggctgagcgttgggttttcctcgttgcttcgttttaaagaggtgtccacttgtcaggttgctaccgtggtggacgtcgtgggggagcgtggtccagtccgtgggacgtccctagagacctcctaccgtgtacggaacgtcctcgttagggtaatttttacggttttccgaagggtttcggttaccgtgggtccaagttcggccgtacgttcggggtccccaccgacggcctaccggagggaacgaaccgggggccgtaaggttgggtcgacgtaagttatgacaacgtagtggtaagtggtaaagtttcaggtaaatagtttaagcgtaanaccgtaaacctccggaaggtaacggtcgtactacactattaccgtacgaagaactaacgtaaaccttacccggtaatagttgtaacgttagtaaggaagttcgcacgtcttggaagtcgtacggtaggtaaccttcgggtactacgtgttaacttgttcgtggacggtaggtcgtcggggtagttacggttaggtacgttaggtaccggacgtacgtagtacggtacggg

SEQ ID NO: 289520 - DNA, 787 bp, Homo sapiens
  misc_feature: GYAE6OF02HIIZ9.25.53.E09.1.454.CMB.1.raw
tcagactgtacagtcacgaccggtgctcgatttagagagagtgtgttgggtttggggggaactgctcagttaggacccagagggaaccatggaagccccagctcagcttctcttcctcctgctactctggctcccagattcagcggcgaaactgtgttgacacagtctccagccacctgtctttgtcgtaccgggggaacagcccaccctctcctgcgacgggccggaccagactgttagacaacgacttacgccttacggtaaccaaacgagtaacgcctgggaccagggaccctccgaaggccttcctcaatcttaatcgaacttacttcccgaaggttacggggcccctaagtggtaccacgtccccaccggtcccgtacttacgaacggtggaccgtaggttcgggggtacgtacgggggtaactaacggtttagttttaaccctcctaaccaacccgtagttcccttacccgaacggtacccttaaaggaccggtacccgttaagtaaacggtttaatttttacgtaccgtttaagtttttaacgtttaaccgttacgttaccgtaacgtcccgttaacccgaacgtaaacggtaaacggttacggtaaccctacgtaaacgttaactttacccgttaaccgtttacccggtacccggtaacgggtaacccgtaaaggttacggtaaacttaacgtaaccgtaaacgtaacgtacgttacgggtacctacgtaccaaccgttactacgttactcgttccgtacttcccgtaccgtactaacg

SEQ ID NO: 289521 - DNA, 667 bp, Homo sapiens
  misc_feature: GYAE6OF02HN4BX.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctgggtcggcggccgcccagagtcgggtcctgtcccagctgcgtctgcgaggagtcgacgcccgagggacaggtgaacgtccgttacgggacgaccctcgtccctacgtaccgtgccttcgtcgtctcgttggtacgacctcactaccactagtaatcgctctacttcggtggcgtacgccgtccgaccgaccgaccccgagggaacggccgtaggaggtgtagttcgcgtattcgtcttacagtaggtggtagtcacctactacgtacccttcccgtactacgaagtaccggtcgacgtacccgtacgtttacgtttcggtacgtactaccgtaccgcggtcacgtcgtagttctcgttatcgactacgtgtacgtcgtacggtcgacccggtccgacgaccgtaccggcctttacgacttacgtggacacgggtacgtacgtacggacggtaaccggaacccgtaaccccgtacccttaacccgttaccgttaccggaacccgttaccggagggtaaccccggg

SEQ ID NO: 289522 - DNA, 692 bp, Homo sapiens
  misc_feature: GYAE6OF02I0J4U.25.53.E09.1.454.CMB.1.raw
  modified_base (263)..(263): a, c, t, g, unknown or other
  misc_feature (263)..(263): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
  modified_base (411)..(411): a, c, t, g, unknown or other
  misc_feature (411)..(411): n is a, c, g, or t
  modified_base (449)..(449): a, c, t, g, unknown or other
  misc_feature (449)..(449): n is a, c, g, or t
  modified_base (478)..(478): a, c, t, g, unknown or other
  misc_feature (478)..(478): n is a, c, g, or t
tcagactgtacagtcacgaccggtgctcgatttagagagagtgtgttgggtttgggggggagaggagcccagcactagaagtcggcggtgtttccattcggtgatcagcactgaacacagaggactcaccatggagtttgggctgagctgggttttcctcgttgctctttttaagaggtgtccactgtcaggtgcacctggtggagtcgtgggggaggcgtggtccaggccgtggggacggtccctgacgtactcctcctgtnaacgcctctggtatttagttcaggttcgttacgtggcatgcacgtcgggcccgccgaagggtcctaccgaggaccggaacgggggccggaggttggttggctaggttanacgacanagtcgagtacggtaagttctagaattattagngactacgactacggagacgggtaccgacttcaactacnccacgagacgtaacaacgtaaccggtaanagttacgttagttaaccgttaggtaaacgttccgggtacacgtaccgtaggaaccgtaacggttacggaacgggtacccttaccggttaacgttccgttaaagttacgtttacgtgggtaacgtacggtaaaggtacgggttagggggtacggtttaaggttacggttaacggtttaaccggttaccgggccgtaacgacggttggtaaccggg

SEQ ID NO: 289523 - DNA, 767 bp, Homo sapiens
  misc_feature: GYAE6OF02HC1OX.25.53.E09.1.454.CMB.1.raw
  modified_base (269)..(269): a, c, t, g, unknown or other
  misc_feature (269)..(269): n is a, c, g, or t
  modified_base (313)..(313): a, c, t, g, unknown or other
  misc_feature (313)..(313): n is a, c, g, or t
  modified_base (363)..(363): a, c, t, g, unknown or other
  misc_feature (363)..(363): n is a, c, g, or t
tcagactgtacagtcacgaccggtgctcgatttagagagagtgtgttggggtttggggggagaggagcccagcactagaagtcggcggtgtttccattcggtgatcagcactgaacacagaggactcaccatggagtttgggctgagctgggttttcctcgttgcttcttttaagaggtgtccactgtcaggtgcaccgtggtggagtcgtgggggaggcgtggtccaggcctgggacggtccctggacgactctcctgtcgaagcctntggtattttagttcaggttgttctggcagtgctacgtgggtccncgtaggctccgaggcgaacggggccggtagttggttgctagttagagcanatggagttagggaacgtttcagtaaatttacgttagtcgacgaacgtaccctaccggtagggaaaccgggtcctaaagttccgaacccgtaattacccgttaccgaaacgtaaacggtaaccgtaaaccgtttaccccggaattacgtttggttacgtttaaacccgttaggtaaaacgtttcggtaccgaacggttccccgtaaggtaacgggtaccggttaccggggaaggttacccggttaccgggtcctttacggttaaccggtttaacgttaacgggttcgggtcggtaaccggacgggtttaagggttcgggggtaaacgggtttgggttaaaccgggttttacggttaacccggggtttacccgggacggtacggttacggtaccgggtaccggggg

SEQ ID NO: 289524 - DNA, 698 bp, Homo sapiens
  misc_feature: GYAE6OF02GJ3N0.25.53.E09.1.454.CMB.1.raw
  modified_base (188)..(188): a, c, t, g, unknown or other
  misc_feature (188)..(188): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggngtcgagccccgagggcagggtgaacgccgttcggacgtaccctcggtcccctacaccctgccttctgtcctcgtggtcgacctccactcacctagtaatgtctactacgttacgtgggctcggcctcccggcctaccgacccccggaaggggaccggtccgtaggagttacgggattcggcgtactttcggttcctttacgaagttaggtacgggtacgtacgtaccgtactacctaccggttcccctaccgtacgaacgtacggtaccgacgtcccttaaccgtttaggttcggtacgtacctaccggttcccaacgtcgtacggtacttcggttctacctcgtactacgacgtcgtactcgtcgtaccgaccgtacccggccgtaccgccggttcctacgttaactcgtcgacggtacgacggtaccggtagacggtcccggtaacccgtaacccttaccccgaaccctttacgtacccggaccggttaacccgcggggtaaccccgg

SEQ ID NO: 289525 - DNA, 617 bp, Homo sapiens
  misc_feature: GYAE6OF02IQG8D.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcagggtgaagtccttcggagaccctgtcccctcacctgcctctgtctcgtggtcgacctccatccgaccagtaactgctactagttacgtgggctcggcctccgccacgccccgagggacggcgtaggagtggatgcgtatttcgtcttcagtgggtggagttcgacctactacgtacgtccctaccgactaacgtagtcgacgtacaccgttgtttcggtcgaccgtacgtccaacggcagctagttcgtctcgtacgacacgttcgacgttccgtgtcccgaccggcccgtaccgaaccgtccggtccgttactagttaccgtggtcgacgacgtacgtcgacggtacccggtaccgtaaacccccttccgtaacccgttcgttaccggaccgtacccgggtagggtaacccgg

SEQ ID NO: 289526 - DNA, 695 bp, Homo sapiens
  misc_feature: GYAE6OF02I4FYD.25.53.E09.1.454.CMB.1.raw
  modified_base (234)..(234): a, c, t, g, unknown or other
  misc_feature (234)..(234): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagtatgggtcctgtcccagctgcgtctgcaggagtcgagcccgaggcaggtgaagccgttacggacctacctcgtccnctacctgtcctcgtcgtctcgtgtactacctactataccacgtaacgtatcgtactacgtacgttacggtcggtacgtcggtccgtacccgaccgtaccggacccggtaagggaccggtcgtagggtacgtacggtagtcgtacgttacgttcgttacgttacgtagttacgggtacggtacgtacgtaccgttaacgtacgtaccgtacccgtaccgtaacgtaacggtacgtacgtacgtaccgtaccgttacgttacggtacgtaccgtacgtaccgtacgtacgtacgtacgtacgttacgtacgtacgtacgacgtacgtacgtacgtacgtacgtaccgtaccgtaccgtaccgtaccgtaccgtaccgtacgttacgttacgtacgtacgtacgtacgtacgtacgtacggtaccggtaccgtaacccgtaaccgtaccgttaccgtacgtacg

SEQ ID NO: 289527 - DNA, 754 bp, Homo sapiens
  misc_feature: GYAE6OF02FT6GU.25.53.E09.1.454.CMB.1.raw
tcagactgtacagtcacgaccggtgctcgatttagagagagtgtgttgggtttggggggaactgctcagttaggacccagagggaaccatggaagccccagctcagcttctcttcctcctgctactctggctcccagattccagcggcgaaactgtgttgacacagtctccagccaccctgtctttgtccggtacgggaacgcgcctaccctctcgtcgacgacgggccgaccgacgtacttgttacgaacgaacgttacgtacgtccgtacgtaaccaagaagacgcgtcgcgacgccgtccgagtcctcctctaacttctacgtacgtaacttacctaacggaacggttaccggacccgttacggtcggaacctaacccgttaccccgaacccggtcccgttcttacgtacgggtcggtaacgttcggggttcggtcggtacggtaacgtaagtttacggtttacctacgtacaacctctaccctaccggtaacgtccgaagtccgtacgtaagtaacgtttagttttcctagttttaaactttaccgttagtaccgtacggtacctacggttataacgggactaaacgggtacggtcccgttaacctaactttaacgttattaccccggtttacggtttaccggaaccggttacggaaaagttacgtgtaaacgtaacacgtaacgtagtcggtaacgtacgtaccgaacttcgtacttcgtactttaccgtactacgttccctccgtaac

SEQ ID NO: 289528 - DNA, 724 bp, Homo sapiens
  misc_feature: GYAE6OF02IWAMQ.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccgagggcagggtgaacgtccgttcgggacgtacccctggtcccctcacctgcacgttgtctcgtggtcgctccatcaccgtagttgttatccactacgtggacgtcgtggactccgccacggccgaacccgaggggaacggccgtagggacgttgggtacgtttgggtactagttaccgttaagttacccggtaggggacgtccttaacccgtttaccgtaaaccccgtaaccccgttacccttacgtaaacgttacggtaccggtacgtaccaccgtacttaccgtactaagttacgaaccgtaaccgttacgtaaacgtaaccttacgtttccctacccgttaaggtaacgtttacgaaccttcgttacgtacgtaccgttcggacccggtaccggacctacccggggtccgttacgtttaacgttccggtaggttcggacccggtactacgttaccgtacgtacgttaccggtacgggtaccggtaccgtacttacacccgaacctcgaccgtacgttagttccg

SEQ ID NO: 289529 - DNA, 718 bp, Homo sapiens
  misc_feature: GYAE6OF02GVR5J.25.53.E09.1.454.CMB.1.raw
  modified_base (553)..(553): a, c, t, g, unknown or other
  misc_feature (553)..(553): n is a, c, g, or t
  modified_base (592)..(592): a, c, t, g, unknown or other
  misc_feature (592)..(592): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcgcgcccagatgggtcctgtcccagctgcgtctgcaggagtcgagcccgagggcagggtacgacggtccttacgggaacgaccccttgtccccctacaccgtcgctccttcggtacctcttgggtacgtacctaccgtactcctaccgtaaggttaactcgtaccgtacctaagttttaccggtcggggtccttcgggacccgttccccggacccgaccggtacccccccggaaggggggtaaccgggtacccgtagggtaccggtgggttaaccgttggtaccggtagtttcgtttaccgtttacgtagttacgggtaggtacgtcgtaccttacgtacgtccgtcctacccgtacgacgtctcggactacgtaccgtagtttccgtcgactacgtccagtacncggtactggttcgtctccgtacgtaactcgtagtccgtntaccgacggccggccgacgcgtaaccgtcctagtacgttcgtcggacgcgacgttacgccgtaacgggacgttaaccgtaaccctaccgttaccgttaccgtagtacccgcggtacggtaccccgg

SEQ ID NO: 289530 - DNA, 911 bp, Homo sapiens
  misc_feature: GYAE6OF02GU5MH.25.53.E09.1.454.CMB.1.raw
  modified_base (172)..(172): a, c, t, g, unknown or other
  misc_feature (172)..(172): n is a, c, g, or t
tcagactgtacagtcacgaccggtgctcgatttagagagagtgtgttggggtttgggggggaactgctcagttaggacccagagggaaccatggaagccccagctcagcttctcttcctcctgctactctggctcccagattccagcggacgaaactgtgttgacacagtcncacgcccacctgttctttggtcggtaccgggggaacgacgcccaccctctccgtggacgaccgggccgaccagtacgttcggttacgaaccgaacgtacttaacgccgtacggtaaaccaaaacgacggaaacgtccgtacgggacccgaaccggtccgtacccgacgggtccccttacccgtacttaaccttacgttaacttacggtaactttacccgtttaccggtaaagggtaccggggtaccctaacggttccggaacctaccgttaccccggaaccggtccccggttactttccggtaacggggtcgggaccggttacggggtcgggggttaaccggtaggggtaaaccgttaagggtttaccggttttacctaccttaaccgtaaccgtactttaccgaccggtaaccgttacccgtacgggaaccggttccgtaaggttaaacgtttacgttttacggtaacgttttaacgttttacgttaacgtttcggtaccgtaacggtccgttaaccgaaccgttaaggtaaccgttccggtaacccttaacgttaaactttaccgttacctttaccccggtttacccgggtaccggttaacgggaaccgttaacgggtacgtaaacgttaacctaaaccgggtaaaccgtacggtacggttacggtaacgtaccgtacgtaaccgtactttcgtacgtttacccgtaccttacggttccccttaccgacccttaagg

SEQ ID NO: 289531 - DNA, 736 bp, Homo sapiens
  misc_feature: GYAE6OF02IMH0P.25.53.E09.1.454.CMB.1.raw
  modified_base (188)..(188): a, c, t, g, unknown or other
  misc_feature (188)..(188): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggngtcgacgcccgaggggcaggtgaacgtccgttcggacgtaccctcgtcccctacacctcgtctcctcgtctcgtggtacgtacctacctactaccaacgtaacgttaactcgccttactacgttacggtcgggtcgttacggtccctacccggaccgacccggaccccggaaggggaaccggtccggtcgggtagtggtcgttacggtcgtagttcgtttcttacgaggttagggtgggtacgtaccgtaccttacgtaccgtccttcccgtacccgtacgaacgtacgtccgtaacgtacctaccgttacgttttcgggcctaacgtccgtacccgacgcaggtcttacggttcttctacgttacgaccgttatccggtacgttcgtacggtacccgaccggcccgacccgtacggccttacccgttattaacccgttgtaccggtgaaccgtaaggtctaccggaagggtcccgtaaaacccggtaaccccttaacccgtacccgtttacggtacccggacccgttccggggtaccggtacccggg

SEQ ID NO: 289532 - DNA, 627 bp, Homo sapiens
  misc_feature: GYAE6OF02GX25X.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattacgtgggctggcctccgccacgcccccgagggaacggcctggagtggatgcgtattgtcttcgataggtgggagtcgtcctactacacgtccctccctacaacgtacgtcgtacgtccaaccgtagtttcggttagacctaccggttccacgacacgaccgtagtttcgtcctcgtacgtaccacgtcgtaccgttctggtcccgaccgggtcccgaccggaccgaccgggtcccttacttaacttaccgtgtcgacgtacggtaggtaccgacggtacccggttaaccggaaaccccctaccgtaaaccccttacgtttaccggaaccctacccgggtcggggtaaccccgg

SEQ ID NO: 289533 - DNA, 926 bp, Homo sapiens
  misc_feature: GYAE6OF02G89QP.25.53.E09.1.454.CMB.1.raw
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
tcagactgtacagtcacgaccggtgctcgatttagagagagtgtgttgggtttggggaggtccaactcataaagggaaatgctttctgagagtcatggacctcctgtgcaagaacatgaagcacctgtggtcttcctcctgctggtggcggcgcccagatgggtcctgtcccagctgcgtctgcaggagtcgagcccgagggcaggtgaacgtcttcgggacgaccctcgtcctccacctgctctgtctctggcactcatcaccagtacncgctcagttacgngggtactcggcctaccgccgaccggaccccgtaagggaacggtccggtggtacggtaggtagttcggtacgtagtttacgttctttaccgtaaggtttacggggtaggggtaccgttacggtacccgtttaacccgtaaaccggtccccggttaccccttaacccccgttaacgaaacgggtttaaccggtacccggtaacggtttacccaaacccggtttaacggttttttccgggttaaaccggaacccggttacccggttacccgtaaccgggtacctaacgggttaaccccggttaggttttccgttacccggtacctttacgggaaactacccggttaggtccccggttttacgtccgggttaacccgaacccccggggcccgggtaccccgtaaacccggggacccgggttttaccccgtttaaccgttaaccgggtttacccggttacggttaccccgggggtaacggttaaacgggttccggggtttaaacccggaaaccgggggttaaaccccggggtaaacccggttttaaaaaaccccccccaccccggttttaaaaccccccttttaccgggtttaaaccccgggttaaacccccggtacccggggggttacccggggtaaaccccggggg

SEQ ID NO: 289534 - DNA, 683 bp, Homo sapiens
  misc_feature: GYAE6OF02JYRA5.25.53.E09.1.454.CMB.1.raw
  modified_base (370)..(370): a, c, t, g, unknown or other
  misc_feature (370)..(370): n is a, c, g, or t
  modified_base (611)..(611): a, c, t, g, unknown or other
  misc_feature (611)..(611): n is a, c, g, or t
tcagactgtacagtcacgaccggtgctcgatttagagagagtgtgttgggtttggggaggtccaactcataagggaatgctttctgagagtcatggacctcctgtgcaagaacatgaacgcacctgtggttcttcctcctagctggtggcggcgccccagtacgtgggtcctgtcccagctgccgtactgaccaggacgtcgacgcccgaggctaggtgaaacgtccttaggacgtacccctgtcccctacacctgtcctctcgtctacgtgggtcaccttcgataccacctagttatcgactctagttacggcggcttccggccaccgacccgacgtaccccggaagggacggtctagggacgttcggnttcgcgttagttcgtcgtttcaacgttggtcggaagtctaccgacgttacgtaccgtccccgtaactaggtaacgtcgtaccgtagtcccgtaaacgttgtttaccggttacaccgtaccgtaccgtacgtacgtaacggtcttacggttcttccgtacgtacctaacgtcgtacgcgttcgtagtacccgacgttacccgcgtacccgacgttccgtgtaacgtcgtgcgtcgtaacggngttaacctcgggtaaccgtaccggaacccttaccgtaaccttcgtacgaacccggtccggtagtaacccggg

SEQ ID NO: 289535 - DNA, 676 bp, Homo sapiens
  misc_feature: GYAE6OF02GSX3C.25.53.E09.1.454.CMB.1.raw
  modified_base (188)..(188): a, c, t, g, unknown or other
  misc_feature (188)..(188): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcaggngtcgacgccccagggcagggtgaagccttcggacgccctgtacccctcacctgctctgtctctggtgactccatcaccagtaatcgctctacttacgtcggggctcggcctccggcccgacgcccccggaaggggaccggccgtggaggtgtacgttcgacgtgtttcgttctttcgagttagggtgggtactcgtaccttaactacgtaccgttcccttagtctaacgtaacgtcgtcgtacgtaccaccgtttagttttcggtacgacctacgtacctacgcgacgtccgtagttcgtccttacgtcgtaacctcggtcctcgttacgttccgtaccgaccccgggtcccgacccggtaacccgccggtttaccctacgtttaacgttcctaggtcgacgggtaacgtacgtcggtaacggtacccggtaaccgtaacccccttaccgtaaccccgtttcgttaccggaccgtcccgggtacgggg

SEQ ID NO: 289536 - DNA, 767 bp, Homo sapiens
  misc_feature: GYAE6OF02H9DTS.25.53.E09.1.454.CMB.1.raw
  modified_base (327)..(327): a, c, t, g, unknown or other
  misc_feature (327)..(327): n is a, c, g, or t
tcagactgtacagtcacgaccggtgctcgatttagagagagtgtggttgggtttggggagtccaactcataagggaaatgctttctgagagtcatggacctcctgtgcaagaacatgaagcacctgtggttcttcctcctgctggtggcggccgcccagagtgggtcctgtcccaggctgcgttctgcgagtgtcgacgcccgaggggcaagggtgaaacgtccccgtttacgggaacgacccccttcggtaccccctcgaacctggccttcgtcggttctccgtggtcaccttccataccacctaagtatgcttactagttacggnggggtctgggccctaccgcctacccggccccggaaaggggaccggtccgtagggacgtagggtagttcggacggttatttcggttctttacgtacggtagggtaggggtacgttacgtaccctaacgtaccgtaacccgttccccgtaaccctaggaaccgtacgggtcgtaacgtaccctaacggttacgtttttccggaacaccgtacccgtaccctacgtacgaacgtcggttacgtttcgtcccgttagttacgaccgttacgtcggtaccttcgtttaccgacccggacggtccccgaccggtaacgtcccgggtccgttacttacgttacgtcggacgtaccgaggtacggttcgaccggttaccgggtaaaccctaaacccctcccgtaaccgtttaccgtaccggtaaccgtccgggtaccgggtaaccggg

SEQ ID NO: 289537 - DNA, 665 bp, Homo sapiens
  misc_feature: GYAE6OF02GIJIV.25.53.E09.1.454.CMB.1.raw
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
  modified_base (279)..(279): a, c, t, g, unknown or other
  misc_feature (279)..(279): n is a, c, g, or t
  modified_base (631)..(631): a, c, t, g, unknown or other
  misc_feature (631)..(631): n is a, c, g, or t
tcagactgtacagtcacgaccggtgctcgatttagagagagtgtgttgggtttggggggaactgctcagttaggacccagagggaaccatggaagccccagctcagcttctcttcctcctgctactctggctcccagattccagcggcgaaactgtgttgacacagtctccagccacctgtcttgtcgtccgggggacncgccacctctcctgcacgggccgcagactntagacacgactagctggtaccaacagaacgctgacagcctccagcctccnatctatgattacctcaggtacggccagtcggacacgtacccacgtcccgcttacagggtcgacgtagggttcgggtacttaggggaccttaaggtacgttttaccgaccttacaacctactctaccgagtaccctagaccgtcctagtaacgttacttttgaactttagtttaacttacgtttacgtagtaccgtaccgttaacccgtaagtaaccggtaaggttccgtaccgttaccctaaacttacgttaccctttaccggttaccgttaccccggtaggtaacccgtaaaggttacggtaactacgtaaccgaacgttacgtagtacgggacttcgaaccgacgttacncgttagttcccttaagtccttccgtccctagtac

SEQ ID NO: 289538 - DNA, 721 bp, Homo sapiens
  misc_feature: GYAE6OF02FU73F.25.53.E09.1.454.CMB.1.raw
tcagactgtacagtcacgaccggtgctcgatttagagagagtgtgttgggtttggggaggtccaactcataagggaaatgctttctgagagtcatggaccctcctgtgcaagaacatgaagcacctgtggttcttcctcctgctggtggcggcgcccagatgggtcctgtcccagctgcgtctgcaggagtcgagcccagggcaggtgaagccttacggagaccctgtccccttacacctgcctctgtactctggtgaccttccaacttccaccgtaagtatcgtctactagttacgtggggcctggtccgacccgtaccacggccccccgaagggtaacgggccgtaggaaggttggtacgttcggcgtattcgttcttactagttaggtaggtagtacgccttaacgtcgtaactccccgtactacgtaaagacggtactacggtactaacccgtttagtttccggtacgtaacccgtaccgttaaccaccgtcgaaccggtacaacggtttcgttcttaccgtacggtaaccgtaactcggtaccggttctacgggttaccgtacccggggcccgtaaccggtaccggtaacccgggtccttacggttacgttacgtggtacggtccgaagtcgtaccgaggtacccgggttaaccgaaccccgtttaacctaacccccggttagtttaccggaccgttaacgggtcgggtaacccgg

SEQ ID NO: 289539 - DNA, 825 bp, Homo sapiens
  misc_feature: GYAE6OF02JPMP2.25.53.E09.1.454.CMB.1.raw
  modified_base (158)..(158): a, c, t, g, unknown or other
  misc_feature (158)..(158): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgccagntgggtcctgtccagctgcgtctgcaggagtcgacgcccgagggcaggtgaacgtcccgttacgggacgtaccccgttcggtcccctacgaccttcggccttctcggtcttcgtacggtcgtacctccgaactccaaccgtaagtaactcggtacttctagttaccggtggggtcctcgggccctcccggaccgacccgggtacccccggaaggggtaccgggtaccggtgggtaacggtcgggtaacgttcggtacgttacgtttcggttccgttttacgaacgtttacggggtagggttacggttccggtaccttaaccgttaccgtaaccgttccccgtacccgtaacgtaacgggtacggttacgtaccggtccgtaccgtttacgttttacgggtaccgtaacgtcccggtaccgtaccgtacgtacgtaccgtcggtttactccgttaccttcgaccgttacgtccgtaacgttccgttcggtaccggtacccggtcccgacccggtaaccgtcccgttccggttaacgttaccgtacggttacgttcgaaccggttacgtacggttaccgacgggttaacccgggtaacccgttaaaccccgtaccgtttaaccccgttacggttacccgtaaacccggttccgggtaccggtaacccggg

SEQ ID NO: 289540 - DNA, 962 bp, Homo sapiens
  misc_feature: GYAE6OF02HW7Z2.25.53.E09.1.454.CMB.1.raw
tcagactgtacagtcacgaccggtgctcgatttagagagagtgtgttgggtttggggaggtccaactcataagggaatgctttctgagagtcatggacctcctgtgcaagaacatgaagcacctgtgttctcctctgctggtggcggcgcccagatcgggtcctgtcccagcgtgcgtcgtgcgaggagtcgacgccgaagggcgaggtgacgtccgttacggactaccctcgtaccctcaccgtcgctcgttcgtctcgtggtcgcctaccgtactacaaccgtaagttactcgtacttaccgtagttacggtcgggtaccgtcggtaccctccgtacccggtaacccggccccgggtaagggggtaccggtaccggtagggtacggtggttaaccgttcggtacggttacgttttcggtttacctttaacggtaacggttacggggttacggggtacgttaccggttcccttaaaaccgttacccgttaccccggttacccccgttacccgtaacgtaacggttaccggttacccgtaccgtttaccgttaaccggttttacccgggtttttacggtacccgttaaaacccgggtaccccgtaccccgtaagggtacccgttacgggttaaccggttttaccggttaaccgtttccccgtttagtaaccggtaacccgttacgggtttaccgttacccgtttacggttacggaacccccggttacccggggaccccggtacccgtacccggtaaccggggtttttcccctaaagtttaaccgtttaccgggttacggtttacccgggaacgggtaaccggttaccgggtaacccggggtacccgggttaaacccccgggttaaaccccccgtttaaaccccgacccctttttaacccggggttaacctttaccccgggaacccccggggtagggtttaccccgggggttaacccccgggg

SEQ ID NO: 289541 - DNA, 784 bp, Homo sapiens
  misc_feature: GYAE6OF02HXV6N.25.53.E09.1.454.CMB.1.raw
  modified_base (177)..(177): a, c, t, g, unknown or other
  misc_feature (177)..(177): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtccagctgngtctgcaggagtcgagcccagggcaggtgaagtccttcggagacccttcgtccctcacctgcctactgtctcgtggtcgactccatccaacctagtaactcgtacctacgtacttacggtcggggtctacgggtcccgtacccggtacccgaaccgggtacccccgggaagggggtaaccgggtccggttaggggtacggttacgggtacgttcgggtcggttaacgtttcggttaccgttttacgtacgttacggggttacgggtacggtcggtacccttaacgttaccgtaaccggttcccctaccgtaacgaacggtacgtacgtacgtcctaccgtttacgtttacggtcgaacctaccgtacgtaccggactacgtcgtagttccgtacttcggtacgtactacgttcgtaacttcgtacggttcccgacggtacccgccggacgtaccggtccgttacgtaacgttacgttcggtacgtaccggtacggtacggttacccggtaacgggtcccgggttaaaccgtaaacccccgttacccggttaaacccctttaacggtttaccggaaccccggttccgggttaccggggtaaccccggg

SEQ ID NO: 289542 - DNA, 839 bp, Homo sapiens
  misc_feature: GYAE6OF02F333B.25.53.E09.1.454.CMB.1.raw
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggcgcccagatgggtcctgtcccagctgcgtctgcgaggagtcgacgcccgagggcagggtcgaacgtccgttacgggaacgtaccccgttggttccccctcgacccgttcggtccttccgttcgttccgtacgttcgggtacgtaaccttccaactccaaccgtaagttaacgtcgtccttacgtagtttaaccgggtcggggtccgttcgggtcccgttacccggacccgaccccgggtacccccggaaaggggggtacccgggtaccggtagggtacgggttagggtaacgtttccggacgtttacggtttccgttcttttaaccggtaaggttacggggttcgggtaacggttccgtaccgtttaactaccgtacccgttccccgttaccgacggtaacgtacggttaccgtacgttaccctaccggtttacgtttcggtaaccgaccgtaccgtccgaaccgtcgtaacgttacgtacggttttgaccgtacgttaccgacgttaacgtccgtaaaccgttccggttacgtcccgaccccgggtaccgtcccggacccggttacggtcccgtttattaccgttacggttgaccggtaggaaccgtggtaccggcgggtaccgttaacccgaaaccccttaccgttaacccgttgtacccggaccggttaccgggtcggaacccgg

SEQ ID NO: 289543 - DNA, 845 bp, Homo sapiens
  misc_feature: GYAE6OF02GCYXP.25.53.E09.1.454.CMB.1.raw
tcagactgtacagtcacgaccggtgctcgatttagagagagtgtgttgggtttgggggggaactgctcagttaggacccagagggaaccatggaagccccagctcagcttctcttcctcctgctactctggcctcccagattccagcggacgaaactgtgttgacacagtctccagccaccctgtcttgtcgtccgggggaacagccaccctctcctgcgacgggccggaccagacgtgttgacaacgtacttacgcctaggtaaccaaacgagaacgccgtaggaccgaagggcctccccgaagggccttccctacacttactagtacggtaacttacctttaccgaaggttacgggacctacgtcggactacctcccgacggtcccctcgtttacgaggttcggactagggtcggggttacgtacggggtaactaagggtacgttttaaccgtcttaccgaaccttaagttccctaacccgtagtccccgtaaaggtaccgtaccgttaaggtaacgttacgtttttcggaacgttttaacggtttttaacttaacccgtttggttaccgtaaccggtcccgtttaacccgggaacgtaaaggaaccgggtttaccggtacccgttaaccttaaacgtttcttttaaccgttaacccggttttacccgggtacccggttaaaccggggtaaccgttaaacgggttaacggtaaactaacgttaacccgtaaacggtacgtttcgggtaacgggtaccgtaccggtaaccctaaccgttacgtttaccgtacggtttaccctttacccgtaaccgttttcccccgttacccggtaccttaaccg

SEQ ID NO: 289544 - DNA, 923 bp, Homo sapiens
  misc_feature: GYAE6OF02H96DU.25.53.E09.1.454.CMB.1.raw
  modified_base (188)..(188): a, c, t, g, unknown or other
  misc_feature (188)..(188): n is a, c, g, or t
tcagactgtacagtcacgaccggtgctcgatttagagagagtgtgttgggtttggggagtccaactcataagggaaatgctttctgagagtcaatggacctcctgtgcaagaacatgaagcacctgtggttcttcctcctgctggtggcggcgcccagagtggtcctgtcccagctgcgtctgcaggngtcgacgccccgaggggcagggtcgtaacggtcccgtttacgggacgtaccccgttcgttcccctccgaacccgttcgaccttccgttggttccttccgttagggttaccgtaaccttccctacttccctaaaccctaggttaaactcggtacctttaacgttaacgtttaaccgggtcgggggtcccgttcggggccccttacccccggaccccggaccccgggtaacccccccgggaaggggggtaacccggggtcccggttagggggtaacggtttcggggtacgttacgggttaccggtttaacgttttcggtttaccttttaccggaacgtttacggggttacggggtacgttccggtaacccttaaccgttaaccgtacccggttccccctaccgtaaccgaacggtaccggttaccggtaacgttacccgtaaccgtttagtttttcccgggaacgtacccgtaaccggttacccaccgggtactaacggtccgttaaggttcccgttcgtacgtacgaccgttacctacggttcctccggttccgtaacccggccggggacccctaccggaaccgtcccggttacccgtacttaaccgtttacgtccggtaccgacggtaccgtacggtacccgtagggtacccccggttaaacccgtaacccccgttaacctaacccccgtttacggtacccgaacccggttaacccgggtcggaaacccccgggg

SEQ ID NO: 289545 - DNA, 722 bp, Homo sapiens
  misc_feature: GYAE6OF02I5DH2.25.53.E09.1.454.CMB.1.raw
  modified_base (253)..(253): a, c, t, g, unknown or other
  misc_feature (253)..(253): n is a, c, g, or t
  modified_base (651)..(651): a, c, t, g, unknown or other
  misc_feature (651)..(651): n is a, c, g, or t
  modified_base (664)..(664): a, c, t, g, unknown or other
  misc_feature (664)..(664): n is a, c, g, or t
  modified_base (692)..(692): a, c, t, g, unknown or other
  misc_feature (692)..(692): n is a, c, g, or t
tcagactgtacagtcacgaccggtgctcgatttagagagagtgtgttgggtttggggaggtccaactcataagggaaatgctttctgagagtcatggacctcctgtgcaagaacatgaagcacctgtggttcttcctcctgctggtggcggacgtcccagactgggtcctgtcccagctgcgtctgcaggatcgagcccaagggcaggtgaacgccttgggactaccctggtcccctcgtacctgcttccgtntactcctggtcgactccgatccaacctaagtaattcgcttacaggttaccggtggggacttcggtccgtcccgccaccggaccccgggtaaggggtaaccgggtccgttacggggaacggtggtaagtttcggaccgttaagttttccggttactttaccgtaggtaacggggttcggggtagggtacctacccggttaaacttaccgtccggttaacccccttcccgtaagtaaaccgggttacgtaacggttaccgttacccgtaaccgtttcggtttaaccgggtgtaaaccgtaccgtaccgtacgtacgtaactccgtagttacgtctacgttacgactacgtcgacttcgcttaccggcggtacccgcgaccgacgtccgtacttacgtacnggtacacgtacgntaaccgtgggccgtaaccgaccctaacncccggtaattcgaccgtggtaccggtacgg

SEQ ID NO: 289546 - DNA, 546 bp, Homo sapiens
  misc_feature: GYAE6OF01AVDH5.18.81.H04.1.454.CMB.1.raw
tcagtacgagtatgcacgaccggtgctcgatttagtagtgtagattcgcggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctcctagtggggccaccaactacaatccgtccctcgaaagtcgactcaccatatccctagacaactccaagaaccatttctccctgcaattgatctctgtgaccgccgcggacacggccatttattattgtgcgagacatctcttcgatgacagttcttattatggactggggtactactacggtctggacgtctggggccaagggaccccggtcaccgtctcctcagccctccaccaaggcccatcggtcttccccctggccgtccccg

SEQ ID NO: 289547 - DNA, 548 bp, Homo sapiens
  misc_feature: GYAE6OF01EI27M.18.81.H04.1.454.CMB.1.raw
tcagtacgagtatgcacgaccggtgctcgatttagtagtgtagattcgcggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctcctagtggggccaccaactacaatccgtccctcgaaagtcgactcaccatatccctagacaactccaagaaccatttctccctgcaaattgatctctgtgaccgccgcggacacggccatttatattgtgcgagacatctcttcgatgacagttcttattatggactggggtactactacggtctggacgttcgtggggccaagggccccggtcaccgtctcctcagcctccaccaagggcccatcggtccttccccctggccgtccccg

SEQ ID NO: 289548 - DNA, 210 bp, Homo sapiens
  misc_feature: GYAE6OF01C4SPS.18.81.H04.1.454.CMB.1.raw
  modified_base (159)..(210): a, c, t, g, unknown or other
  misc_feature (159)..(210): n is a, c, g, or t
tcagtacgagtatgcacgaccggtgctcgatttagtagtgtagattcgcggggccgaaagtggatcgtcagaacgtaacctgtggtcgtgcaaccaatctgtcttcatcttcccgccatctgacatactcgtactgagcgggctggcaaggcgcatagnnnnnnnnnnnnnnnnnnnnnnnnnnnnnnnnnnnnnnnnnnnnnnnnnnnn

SEQ ID NO: 289549 - DNA, 834 bp, Homo sapiens
  misc_feature: GYAE6OF01BZ6UE.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccgttcggggaccctgtcgctcacctgcgctgtctttaatgactccatcagtagtagtcacgtggtggacttgggtcccgccacggtccccgaagggaaacggggcgttagggaggttgggaagttagggggaaaactccgttacgttccgttaggtcgggggacccaaccgaaaccttaaccaaacgttccccggttacccctacggtaaaacgttccgaaccttccgaaccctaataacctaccccgtaagaaacccaaaccttacccgaaaacgtaaaccctacttttaccctaccctagacctaaattcgacttctctcggtacgacccggcccgtaccggaaccgaccggtaccttaatttttacgttagtttcggtacgtaccggtaagtacctattccgttcgtttacgacttagtaaccgttagttttacttaagtttacgtaggttaaccgttaggggttaacctttaaccggttaccgggttcgtacgggtaccgtttcggtaccgggggtacccgtaaaccggggtacccccgttacgtaccccggtttccgtaccccgttaccgtacccgcccccgttacccgaaaccccggtaaacccgggtccccgtaacgtttccccgggttaccccgtttcccccccggtgggtcccccgtacccccgg

SEQ ID NO: 289550 - DNA, 566 bp, Homo sapiens
  misc_feature: GYAE6OF01CR5O2.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctcctagtggggccaccaaactacaatccgtccctcgaaagtcgactcaccatatccctagacaactccaaagaaccatttcctccctgctaattgatctctgtcgaccgccgcggacacggccatttattattgtgcgagacatctcttcgatgactagttcttattatggacgtgggtaactactacggtctggacgtcgtcgggccaacgggccccggtccaccgtcctccgtcagccctccgaccgaacgggcccacgtccgtccttcccccgtggccgtccccg

SEQ ID NO: 289551 - DNA, 572 bp, Homo sapiens
  misc_feature: GYAE6OF01BWYLC.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctcctagtggggccaccaactacaatccgtccctcgaaagtcgactcaccatatccctagacaactccaagaaccatttctccctgcaaattgatctctgtgacccgccgcggaccacggcctatttattattgtgcgagacatctcttcgatgactagtttcttaattagtggtacgtggggtactacgtacggtctggcgttcgtgggaccaacgggccccggtcgaccgtcctccgtcagtccctccgaccgacgggaccctacgtccgtccttccccctggcccgtccccg

SEQ ID NO: 289552 - DNA, 579 bp, Homo sapiens
  misc_feature: GYAE6OF01DEIXG.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccagggaaaggggctggagtggattggggaaatctctcctagtgggccacaactacaatccgtcctcgaaagtcgactcaccatactccctagacaactccaaagaaccatttctccctgctaatgatctctgtcgacccgccgcggacaccggctatttattattgtgcgagactatctcttcgatgactagttcttatttatggacgttgggtaactacgttacggtctggacgtcgtggggccaacgggtaccccgtcacccgtctcccgtcacgccctccgaacccgaacgggccccaacgttcccggtcccttcccccgtggccgtccccg

SEQ ID NO: 289553 - DNA, 563 bp, Homo sapiens
  misc_feature: GYAE6OF01DK1OC.18.81.H04.1.454.CMB.1.raw
  modified_base (361)..(361): a, c, t, g, unknown or other
  misc_feature (361)..(361): n is a, c, g, or t
  modified_base (506)..(506): a, c, t, g, unknown or other
  misc_feature (506)..(506): n is a, c, g, or t
  modified_base (553)..(553): a, c, t, g, unknown or other
  misc_feature (553)..(553): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctcctagtggggccaccaactacaatccgtccctacgaaagtcgactcaccatactccctagacaactccaaagaaccatttcnccctgctaattgatctctgtcgaccgccgcggacacggcctatttattattgtgcgaagactatctacttcgatgactagttcttattatggacgttggggtaactactacggttctggacgtcgtggggccaacgggccccgtnacccgtctccgtcagccctccaccgaggccctacgtcgtcctccccnggccgtcccg

SEQ ID NO: 289554 - DNA, 556 bp, Homo sapiens
  misc_feature: GYAE6OF01ESQM0.18.81.H04.1.454.CMB.1.raw
  modified_base (358)..(358): a, c, t, g, unknown or other
  misc_feature (358)..(358): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctcctagtggggccaccaactacaatccgtccctcgaaagtcgactcaccatatccctagacaactccaagaaccatttcnccctgcattgatctctgtgaccgccgcggacacggccatttatattgtgcgagacatctcttcgatgacagttcttattatggactggggtactactacggtctggacgtctcggggccaacgggccccggtcaccgtctccgtcagccctccacccagggccccacgtccggtccttccccccgtggcccgtccccg

SEQ ID NO: 289555 - DNA, 649 bp, Homo sapiens
  misc_feature: GYAE6OF01BC9Z4.18.81.H04.1.454.CMB.1.raw
  modified_base (390)..(390): a, c, t, g, unknown or other
  misc_feature (390)..(390): n is a, c, g, or t
  modified_base (402)..(402): a, c, t, g, unknown or other
  misc_feature (402)..(402): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccgttcggggaccctgtcgctcacctgcgctgttcttaatgactccatcagtagtagtcacgtgggtggtacgttcgggtccgccacggtccccgaagggaaaggggcgtgggaggtggtagttaggggaaatcgtctcgtaggtcggggaccaaccgaactacaacgtccgtacctacgaaacgtcgactacacatactaccagacaactaccaaagaacctactttccncctgactaattnactcgtctgtacgaccgccggacgaccgacggtaccttaatttacttagttcgtcgacgagtactactcttacgttacgatcgtacttagtttcttagttagtacggtacgttacgggttactacgttcggtacgtcggtacgttcggacgggaccgaaccgggtcccgtcgaccgttcctaccgtcaccgcctaccgaccgtaaccgggtccctacggtcccgttccctccccggtgcccgtcccg

SEQ ID NO: 289556 - DNA, 567 bp, Homo sapiens
  misc_feature: GYAE6OF01B9SL2.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccagggaaaggggctggagtggattggggaaatctctctagtggggccaccaactacaatccgtccctcgaaagtcgactcaccatatccctagacaactccaagaaccatttcctccctgacaattgatctctgtgaccgccgcggacacggcctatttattattgtgcgtagacatctcttcgatgactagtttcttattatggtactggggtactactacggtctggacgtcgtgggaccacgggccccggtcgaccgtctcctcgacgccctccaaccgaacggccctacgtccggtcccttcccccgtggccgtccccg

SEQ ID NO: 289557 - DNA, 641 bp, Homo sapiens
  misc_feature: GYAE6OF01EEHMD.18.81.H04.1.454.CMB.1.raw
  modified_base (423)..(423): a, c, t, g, unknown or other
  misc_feature (423)..(423): n is a, c, g, or t
  modified_base (544)..(544): a, c, t, g, unknown or other
  misc_feature (544)..(544): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcacgttggtggtacttgggtcccgccgacgtccccagggaaaggggctggagtggattggggaaatctctctaggtcggggccaaccaactacaatcccgtccctacgaaagtcgacctcaccatactccctagacaactccaaagaccatttcctccctgacaattgatctctgtgaccgcgcggacacggcctatttatattgtncgagacatctcttcgattcgacttagttctttaattgtaggtacgtaggggttactaacgttacggtcgtagggtacgttcggtcgggaccgaaccggggaccccggttcgaccccggttntccccgtcgacggtccccttacccgaacccgaaaccggggtccccctaagttccccgggttccccctttccccccggtgggcccccttacccccggg

SEQ ID NO: 289558 - DNA, 567 bp, Homo sapiens
  misc_feature: GYAE6OF01CTY80.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgttctttaatgactccatcagtagtagtcactggtggacgttgggtccgccacgtccccgaagggaaaggggctgggaggtggagttggggaaatctctcctaggtcggggccaccaactacaatccgtccctcgaaagtcgactcaccatatccctagacaactccaaacgaacctatttcctcctgactaattgatctctgtgaccgccgcgacacggcctattacttatgtgcgagacatctcttcgatgactagttcttattatgacgtgggtactactacggtctgacgtctggggccaacgggacccgtcaccgtctccgtcacgcctccaccgacggccctacgtaccgtccttcccccgtggccgtcccg

SEQ ID NO: 289559 - DNA, 586 bp, Homo sapiens
  misc_feature: GYAE6OF01EEJG0.18.81.H04.1.454.CMB.1.raw
tcagtacgagtatgcacgaccggtgctcgatttagtagtgtagattcgcgggggcacaagaacatgagacacctgtggttcttcctcctcctggtggcagttcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctcctagtggggccacaactacaatccgtcctcgaaagtcgactcaccatatcctagacaactccaagaaccatttctctctgcaattgatctctgtgaccgcgcggacacggcctagtttattattgtgcgagacatctcttcgatgacagttcttattactggtactggggtactacgttacggtcttggacgttcgtggggccgaacggggtaccccggtcaacccggttctcccgtacgagccctcccaaccgtaaacgggcccctagtacccgggttccttcccccccgggcgtccccgtccgg

SEQ ID NO: 289560 - DNA, 583 bp, Homo sapiens
  misc_feature: GYAE6OF01EBCMC.18.81.H04.1.454.CMB.1.raw
  modified_base (236)..(236): a, c, t, g, unknown or other
  misc_feature (236)..(236): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccnccagtccccgaggaaaggggctggagtggatggggaaatctctctagtcggggccaccaactacaactccgtcctcgaagtcgactcacatactcctagacaactcaaagaacctattcctcctgactaattgatctctgtcgaccgccgacggacacggcctatttattatgtgcgagtacatcttctcgatcgactagtttcttattagtcggtactgggtactacgtacgtctaggtacgttcgacgggaccgtaacgggtacccgtctaccgtcctccgtccacgcctcccgaaccaacgggccctaacgtcccggtaccttcccccggtcggcccgtccccg

SEQ ID NO: 289561 - DNA, 980 bp, Homo sapiens
  misc_feature: GYAE6OF01EZR6L.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgacctcatcagtagtagtcacgtgggtcggtacgttcgggtcccgccgaccgtccccggaaaggggaaacggggtcctaggggtaggtggtaacggttagggggaaacttccgttccgttaccggttacggggtcgggggaccctaaaccgtaaacctaacgtaaccgttccccggttaccccgtaacggtaaaccggttaccggtaacctacccaaccctaacgttaccctaccccgtaacgaaaccctaaacctaacccgaaaaccgtaacccttaacttttccctacccgtagacctaaagtttcgaactttccttcgtcggtaccggaaccccggcccgggtaccggaaccggacccggtacctttaagttttaactttaggtttcggaccggtaccggtaacgtaacccttaactttccgtttaccgtttacggtaacgttacggtaacctttaccggttttaacttttaagtttaacgggttacgggttaaccgggtttaacgggggttttaaaccctttaacccggggttaaccgggtttccggttaacggggttaacccggtttccgggtaaccggggggtaccccgggtaaacccgggggttaaccccccgggtccgttaacccccggttcccgtttccccggttaacccggtaacccggttcccccggtaaccccggaaaccccgggtaacccgggtaacccccgttacccgggtttcccccggggttaccccccttttccccccgggtccggggcccccgttacccccggg

SEQ ID NO: 289562 - DNA, 603 bp, Homo sapiens
  misc_feature: GYAE6OF01EFKQP.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccgagggaaaggggctgggagtggatggggaaatctctccgtaggtggggccaccaactacaactccgtcctcgaaagtcgactcacatactcctagacaactccaaagaacctacttctccctgctaattgatctctgtcgaccgccgcggacacggcctatttattattgtgcgagacatctcttacgatgactagtttacttattagtggtacgtggggtactacgtacggtcgtacggtacgttcgtcggggaccgaacggggtaccccgtacgtacccgtcctccgtccgacgccctacccgacccgaacgggcccctacgttcccggttacccttccccgtcggcccgtccccg

SEQ ID NO: 289563 - DNA, 646 bp, Homo sapiens
  misc_feature: GYAE6OF01CMUN5.18.81.H04.1.454.CMB.1.raw
  modified_base (393)..(393): a, c, t, g, unknown or other
  misc_feature (393)..(393): n is a, c, g, or t
  modified_base (573)..(573): a, c, t, g, unknown or other
  misc_feature (573)..(573): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccgttcggggaccctgtcgctcacctgcgctgtcttaatgactccatcagtagtagtcacgtggtggacttgggtccgccacgtaccccgaagggaaaggggctgggagtggtagttaggggaatctactcgtaggtcggggacccaacctaactacgaacgttccccgtaccctacggtaaaaggtccaacttaccacctatactccctaagaaccaactaccaagaaccctntttacctccctagactaattgacttctcgtgtcgacccgcgacggacacggcctagtttattgtgtcgcgtagactattctacttacatacgtactagtttactttacgttagtcgtagttcgggtaacttacggtaccggttgtcggtacgtcggtacgggacgaaccgggtccccgtnaccgtcgtccgtacgacgtccctaccgacgaaccggtccctacgtacccggtccttccccgtggcccgtcccg

SEQ ID NO: 289564 - DNA, 587 bp, Homo sapiens
  misc_feature: GYAE6OF01BQHUC.18.81.H04.1.454.CMB.1.raw
  modified_base (421)..(421): a, c, t, g, unknown or other
  misc_feature (421)..(421): n is a, c, g, or t
  modified_base (443)..(443): a, c, t, g, unknown or other
  misc_feature (443)..(443): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtcttaatgactccatcagtagtagtcactggtggacttgggtccgccagtccccagggaaaggggctggagtggagttgggggaaatctctccgtagtggggccaccaactacaatccgtccctcgaaagtcgaactcacatatcctagacaactccaagaaccattctcctgcaattgatctctgtcgaccgccgcgacacggcctatttattattgtgcgagacatctnttcgatcgactagttcttattntacggacgtgggtactacgttacggtcgtacggacgtcgtagggggacctaacgggtaccccggtcgacccgtcgtcccgtcacgccctccgaacccgacgggcccctagttacccggttcccttcccccgtggcccgtccccg

SEQ ID NO: 289565 - DNA, 615 bp, Homo sapiens
  misc_feature: GYAE6OF01A2BG7.18.81.H04.1.454.CMB.1.raw
  modified_base (366)..(366): a, c, t, g, unknown or other
  misc_feature (366)..(366): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (426)..(426): a, c, t, g, unknown or other
  misc_feature (426)..(426): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtcttaatgactccatcagtagtagtcactggtggacttgggtccgccacgtcccagggaaaggggctggagtggagttggggaaatctctccgtaggtcggggccaccaactacaactccgtcctacgaagtcgactcaccatactcccagacaactacaacgaacctactttccncctagactaattcgatctctgtcgaccgccgacggacacggcctatttatnttgngcganacatctctacgatcgactagtttcttatatggacgttgggtaactacgtacgtcgtggtaccgttcgcggggaccgaacgggtccccggtactacccgttcctcccgtccgtaacgcccctaccgaacccggtaaccgggcccctacgttccccggttaccctttcccccggtcgggtcccgtccccgg

SEQ ID NO: 289566 - DNA, 612 bp, Homo sapiens
  misc_feature: GYAE6OF01B5M9R.18.81.H04.1.454.CMB.1.raw
  modified_base (532)..(532): a, c, t, g, unknown or other
  misc_feature (532)..(532): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccacgtccccgaagggaaaggggctgggagtggagttggggaaatctctcctaggtcggggaccaaccgaactacaactcccgtacctacgaaagtcgactcaccatatccctagacaacctaccaaacgaacctattcctcctgactaattgatctctgtcgaccgcgcggacacggctatttattatgtagcgagacatcctcttcgatcgtactagtttcttattagtggtacgttacggggtactaacgtcggtacgtggacgtcggtcgggacccaacggggtaccccgtntacccggttctcccgtcgacgcccttacccgaccgaaccgggccctacgttcccggttccctccccgtggccccgtcccg

SEQ ID NO: 289567 - DNA, 740 bp, Homo sapiens
  misc_feature: GYAE6OF01DEOQW.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaacgccgttcggggaccctgtcgctcacctgcgctgttctttaatgactccatcagtagtagtcacgtggtggacgttgggtccgccgacgtccccgaaggggaaacggggctgggagtggtagttaggggaaatctctcgtaggtcggggaccaaccaactacaacttcccgtaccgtacgaaacgtcgactcaccatactaccctaagaaccaacctaccaaacgtaacctactttcctaccctagactaattcgactctctgtcgacccgccgacggacgacggtccttaatttattagttgtacgacgaagtactacttccttcgttcgaattcgaacttacgtttactttaagtttagtacggtacggttacggggttaaccttaacggttacggttcgtacgggtaccggttcgggtaccggggaccgtaaacccggggtaccccggttaccgtaccccggttccccaccccggtaccgtaccccgttaacccccgaacccggaaacccgggtcccctaccggtttaccccgggttccccctttaccccccggtccgggtccccgtcccccgttccgg

SEQ ID NO: 289568 - DNA, 594 bp, Homo sapiens
  misc_feature: GYAE6OF01BDSC8.18.81.H04.1.454.CMB.1.raw
  modified_base (529)..(529): a, c, t, g, unknown or other
  misc_feature (529)..(529): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccagggaaaggggctgggagtggattggggaaatctctcctagtgggggccaccaactacaatcccgtccctcgaaagtcgactcaccatatccctagacaactccaagaaccatttcctccctgcaattcgatctctgtcgaccgccgcggacacggccatttatatgtgcgagacatctcttcgatcgactagtttcttattagtggacttggggtacttacgtacggtctaggacgttcgtcggggaccaacggggccccgtccgacccggtcctcccttcgnggtcccctcccgacccgaaacgggcccctacgtccggttcccttccccccgtgggcccgtccccg

SEQ ID NO: 289569 - DNA, 735 bp, Homo sapiens
  misc_feature: GYAE6OF01CGPP6.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccgttcggggaccctgtcgctcacctgcgctgtcttaatgactccatcagtagtagtcacgtggtggacttgggtccgccacgtccccgagggaaagggctggagtggagttaggggaaatctctccgtaggtcgggaccaaccaactacactcccgtcctacgaaagtcgactcacatactccctagacaactaccaaagaacctatttcctaccctagactaattcgactctcgtgtacgaccgccgacggaccacggcctatttattagtgtcgacgagactagtctcttacgatcgtacttagtttactttaagttagtacggtacgttcggggttaaccttaacggttaccgggtacgttacgggtaccggtttcgggtacgggggtaccccgtaaaccgggggttacccccggtaccgtaaccccgggtttccttaccccggtaccgtaacccggtcccccttaaccccggaaaaccccggtaaacccgggggttacccccttaaccgggtttacccccgggtttacccccgtttaccccccccggtggggtccccccggttacccccgg

SEQ ID NO: 289570 - DNA, 623 bp, Homo sapiens
  misc_feature: GYAE6OF01DJ5N1.18.81.H04.1.454.CMB.1.raw
  modified_base (411)..(411): a, c, t, g, unknown or other
  misc_feature (411)..(411): n is a, c, g, or t
  modified_base (608)..(608): a, c, t, g, unknown or other
  misc_feature (608)..(608): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcgggggaccctgtcgctcacctgcgctgtctttaatgactccatcagtagtagtcactggtggacttgggtccgccacgtccccgagggaaaggggctgggagtggagttaggggaaatctctcctaggtcggggccaccaactacaactccgtaccctcgaaagtccgactcaccatactccctagacaactccaaagaacctatttcctccctgactaattgattctctgtacgccgccgcggacncggcctatttattatgtgcgagactatctcttcgatgtactagtttcttattagtcggtacgttggggttaactacgtacggttctcgggtacgttcgtcggggccgaacggggtacccccggtcacccggttcctccgtacgacgtcccctccgacccgaacgggcccctacggttcccggtccctttcccccggnggtcccgtcccccgg

SEQ ID NO: 289571 - DNA, 617 bp, Homo sapiens
  misc_feature: GYAE6OF01B2KZG.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactgggtggacgttgggtccgccacgtccccgagggaaaggggctggagtggagttggggaaatctctcctaggtggggccaccaactacaatccgtccctacgaaacgtcgactcaccatactccctagacaactccaagaacctatttcctcctgacattcgatcctctgtcgaccgccgcggacacggtcctatttattattgtgcgagacactctcttcgatcgactagtttacttattagtggtaacgtgggttaactacgtacggtcgtacggtacgtcggtacgggccgaaaccgggtccccggtacgtacccgtacctcccgtcgaccgtccctacccgaccgaaccggcccgtacgtcccggttcccttcccccggtcggtcccgtccccg

SEQ ID NO: 289572 - DNA, 636 bp, Homo sapiens
  misc_feature: GYAE6OF01C1P2K.18.81.H04.1.454.CMB.1.raw
  modified_base (236)..(236): a, c, t, g, unknown or other
  misc_feature (236)..(236): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccnccacgtccccgagggaaaggggctggagtggagttaggggaaatctctccgtaggtcggggccaccaactacaactcccgtaccctacgaaagtcgactcaaccatactccctaagacaactaccaaacgaacctatttacctccctgacctaattgaacttctctgtcgacccgccgtacggacacggctatttattatgtcgcgagactagttcttctcgtagtgactagttactttagttagtggtacgttacgggttactacgttacggtcgtggacgttcggtacgggaccgaacgggtaccccgtcgacccgttctacccgtcacgtaccctacccgaaccgtaaccgggcccctaacgttcccggtacccttcccccgtggtccccgtccccg

SEQ ID NO: 289573 - DNA, 573 bp, Homo sapiens
  misc_feature: GYAE6OF01CI1J8.18.81.H04.1.454.CMB.1.raw
  modified_base (442)..(442): a, c, t, g, unknown or other
  misc_feature (442)..(442): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctcctagtggggccaccaactacaatccgtccctcgaaagtcgactcaccatactccctagacaactccaagaaccatttctccctgcaattgatctctgtcgaccgccgcggacacggctatttattattgtgcgagacatctcttcgatgactgttcttattntggactgggtactacgtacggtctggaccgtcgtcggggaccaacggggccccggtcacccgttctcccgtcacgccctccacccgaacgggccccacgttcccggtcccttcccccgtggcccgtccccg

SEQ ID NO: 289574 - DNA, 721 bp, Homo sapiens
  misc_feature: GYAE6OF01B8A4K.18.81.H04.1.454.CMB.1.raw
  modified_base (434)..(434): a, c, t, g, unknown or other
  misc_feature (434)..(434): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccgttcggggaccctgtcgctcacctgcgctgttctttaatgactccatcagtagtagtcacgtggtgacgttcgggtccgccacgtccccgagggaaacggggctgggagtggagttaggggaaatctcgtccgtaggtcggggccaaccaactacaactcccgtacctacgaaacgtcgactcaccatactccctagaccaactccaaagaacctatttcctcctagactaattgatctctgtcgaccgccgacggacacggtctatttattnttgtcgagagacattctcttacgatcgtaacttaggtttactttaagttacgtacgggtacgtttacggggtaaccttaacggttaccgggttcgttacggggtacccgttcgggtaccggggtacccggtaaacccgggggtacccccggttacccgtacccggttcccgttaccccgtaccgtacccggtacccctaccccggtaaacccgggaacccgggtccccgtaaccggtttcccccggttaccccggtttcccccccgtggggtcccccgttcccccgg

SEQ ID NO: 289575 - DNA, 624 bp, Homo sapiens
  misc_feature: GYAE6OF01BM6DO.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggtacgttgggtccgccgacgtccccgagggaaaggggctggagtggattggggaaatctctcctaggtggggccaccaactacaatcccgtccctcgaaagtcgactcaccatactccctagacaactccaagaaccactttcctccctgactaattgattctctgtcgaccgccgcggacacggctatttattattggtgtcgagactatcgtcttcgatgctagtttctttattacgtggacgtttggggtaaccttacgttacggtcgttacggtccgttacggtcggggacccgaacggggtacccccgtgtacccggtctcccgtctccgacccctccgacccgacgggacccctacgttaccccggttccttccccccgtgggcccgtccccgg

SEQ ID NO: 289576 - DNA, 643 bp, Homo sapiens
  misc_feature: GYAE6OF01DLA2Y.18.81.H04.1.454.CMB.1.raw
  modified_base (383)..(383): a, c, t, g, unknown or other
  misc_feature (383)..(383): n is a, c, g, or t
  modified_base (632)..(632): a, c, t, g, unknown or other
  misc_feature (632)..(632): n is a, c, g, or t
tcagtacgagtatgcacgaccggtgctcgatttagtagtgtagattcgcgggggcacaaagaacatgagacacctgtggttcttcctcctcctggtggcagctcccagatgggtcctgtctctcgtgcagttgcgtgagtcgggcccaggactggtgaagccgttcggggaccctgtcgctcacctgcgctgtctttatgactcatcagtagtagtcacgtggtggacttcgggtcccgccacgtccccgaagggaaaggggctagggagtggagttggggaaatctctccgtaggtcggggaccaaccaaactacaactccgtaccctacgaaagtcgactccaaccatactccctagacaactccaaacgacctatttccnccctagacctaaattgactctctcgtacgcccgtcgccgggaacaccgggtacctagttttattagttgttacgcgagtacgtacttcttacgttcgatgtaacttgtttactttaatttatggtacgtgggttaactacgttacggttctggtacggtcgtacggggccgtaacggggcccccgtgacccgttctccgtcacgccctccgaaccgtaacgggaccctacgttccggtcccttccccgnggccgtccccg

SEQ ID NO: 289577 - DNA, 568 bp, Homo sapiens
  misc_feature: GYAE6OF01A5Y0G.18.81.H04.1.454.CMB.1.raw
  modified_base (361)..(361): a, c, t, g, unknown or other
  misc_feature (361)..(361): n is a, c, g, or t
  modified_base (506)..(506): a, c, t, g, unknown or other
  misc_feature (506)..(506): n is a, c, g, or t
  modified_base (520)..(520): a, c, t, g, unknown or other
  misc_feature (520)..(520): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctctagtggggccaccaactacaatcccgtccctcgaaagtcgactcaccatactccctagacaactaccaagaaccatttccnccctgacaattgactctctgtcgacccgcgcggacacggcctatttattagttgtgcgagacatctcttcgatgaactagtttcttattatggtacgtgggtactacgtacgtcgtggacgtcgtggggccaacgggtcccgtcnccgtctcctcgacnccctccaccgacggccctactccggtcccttccccgtggcccgtcccg

SEQ ID NO: 289578 - DNA, 751 bp, Homo sapiens
  misc_feature: GYAE6OF01CQZO4.18.81.H04.1.454.CMB.1.raw
  modified_base (201)..(201): a, c, t, g, unknown or other
  misc_feature (201)..(201): n is a, c, g, or t
  modified_base (738)..(738): a, c, t, g, unknown or other
  misc_feature (738)..(738): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtagaagccgttccggggaccctgtcgctcacctgcgctgttcttaangtactccatcagtagtagtcacgtggtaggtacgttcggggtccgccacgtaccccggaagggaaaggggcgtgggagtggtagtagggaatctctccgtaggtcgggaccaaccaactacaacgtcccgtacctacgaaagtccgactaccaacctatactacctaacgaaccaaacctaccaaacgtaaccctactttccctcccgtagtaactaatttcgaactttccttacgtacggtacgaccccggccggaccggtaaccgtaccggtaccttaattttaacgtttacttggtacgacgtaagtaccttacgttacttacgttaccgtagttacgtaacgttagttttaactttaagttacgtacgggttaacggttacggggttaaaccttaccggtacggttacgtcgggtaaccgttcgggtaacgggggacccgtaaccggggtaccccgtacgtacccgttctccgtacgaccgtacccctaccgaaacccggacgtcccgtacgttcccggtacccttccccggnggtccccgtcccg

SEQ ID NO: 289579 - DNA, 853 bp, Homo sapiens
  misc_feature: GYAE6OF01B05OU.18.81.H04.1.454.CMB.1.raw
  modified_base (198)..(198): a, c, t, g, unknown or other
  misc_feature (198)..(198): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccgttcggggaccctgtcgctcacctgcgctgtcttaangactccatcagtagtacgtcacgttggtggtacgttcgggtccgccgacgtccccgaagggaaacgggggctagggaggtgggtagttaggggaaatcgtcgtccgtagggtcgggaccacgtaactacgaactcccgtccgtagaacgtcgactccacatactacccgagacctaactacccaaagtaacctactttccaccctagacttaagttcgtacttccgtcgttacgacggtcccgacccggtacggaacccggaccggtcccttaagtttttacgttacgtttaggtacggaaccggtaacgaacttacttccgtttaaccgttacggtaacttccggttaacgttaacgtttttacccgttttaaagtttcggttaacggggttaaccggtttacgggggttttaaccttaaccggtttacccgggggtttaccgttacggggtaacccggtttccggggttaaccggggggaaccccggttaaaaacccccggggggtcccccggttaacccggtaacccccgtttccgtaccccgttaacccggacccggttccccccgtaaccccggaacccgggtaaccgggtaccccctaccggtttccccggtacccccgttttcccccggacgggtcccccgtcccccg

SEQ ID NO: 289580 - DNA, 634 bp, Homo sapiens
  misc_feature: GYAE6OF01EIZWX.18.81.H04.1.454.CMB.1.raw
  modified_base (385)..(385): a, c, t, g, unknown or other
  misc_feature (385)..(385): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccgttcggggaccctgtcgctcacctgcgctgtcttaatgactccatcagtagtagtcacgtggtgacgttgggtccgccacgtccccgaagggaaacggggctgggaggtggagttggggaaatctcgtccgtaggtcgggaccaacaactacaactccgtacctacgaaacgtcgactcaccatactcctaagacaactccaaagtaacctattcctcccgtanactaattcgatctctgtcgaccgccgcgacacgactatttatatgngnacgacatctacttacgatgactagttcttagtcgtaggtacgtgggtaacttacgtacggtcgtcggtacgtcggtacggggacccgtaacggggtccccgtacgtacccgtccgttacccgtcctaccggtccctaccgaacccgtaaccgggccccttacggtccccggttacccttcccccggtggccccggtccccg

SEQ ID NO: 289581 - DNA, 152 bp, Homo sapiens
  misc_feature: GYAE6OF01BREGQ.18.81.H04.1.454.CMB.1.raw
  modified_base (150)..(152): a, c, t, g, unknown or other
  misc_feature (150)..(152): n is a, c, g, or t
tcagtacgagtatgcacgaccggtgctcgatttagtagtgtagattcgcggggccgaaagtggatgtcagacgaactgtggctgcaccatctgtcttcactcttcccgcatctgacatactcgtactgaggcggctggcaaggcacatgnnn

SEQ ID NO: 289582 - DNA, 898 bp, Homo sapiens
  misc_feature: GYAE6OF01D6OVK.18.81.H04.1.454.CMB.1.raw
  modified_base (888)..(888): a, c, t, g, unknown or other
  misc_feature (888)..(888): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgctaggttgcgtggacggtccgggcccgaggacgtgggtacgaacggtcccgttccggggtaccctggtccgcctactaccgtgcgtcttgttactttaatcgactcctatacgtagtagtacgtccgtacggtggtcggtacgtttcgggtaccccgccgtaccggtaccccggaagggggtaaacggggtcgtaggggaggttagggtaaggttaacggggtaaacttccgtaccggttaccggttacggggtccggggacctaaaccctaaactaaccgtaaccgttccccggtacccgtaacggtaaccggtaccgtaccctaaccaccctaacgttaacctacccgtaaacgaacctaaacccgtaaccctaaaaccgtaaccctttaacctttcccgtaacccttacggtaacttaacgtttacgtactttcccgtacggttaccggtcccggaccccgggtacccggaaccgggtacccgtaccggttaaccctttaagttttagtttacggttcggtaacggactaaccgtacttccgttacgttcgtaccgtagtacggttaacttacggttttattaaggttacggttacggttaccggttacggtttaaccgtacggtttacggtccggtaggttacccggtcgggtaccgggaaccgggtacccggtacccgtcgtcccgtcgtcccgtaccgtccgtaccccaccggaacccgtccgggcccttaccggttcccggtcccttccccgggngcccccgtcg

SEQ ID NO: 289583 - DNA, 931 bp, Homo sapiens
  misc_feature: GYAE6OF01D1GWC.18.81.H04.1.454.CMB.1.raw
  modified_base (430)..(430): a, c, t, g, unknown or other
  misc_feature (430)..(430): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtggagtcgggcccaggactggtagacgccgttcgggacctgtcgctcaccgtgcgtcttgttactttatcgacctccatacgagtagtacgtctacgtgggtcggtcgttcgggcccgaccgtaccgtaccccggaagggaaacggggtcgtaggggtaggtaggtaaggttaaggggtaaacttccttaccgtaccggttagggtacgggaccctaaaccgtaactaccgtaaccgttccccgtacccgtaacggaaacggttaccgtaccttacccaactactactaccctaanaacctaacctaccaaacgtaacccttactttcctcccgtagtacctaagttcgtactttccgttcgtacggtaccggacccggtaccggacccgggtaacccgtaaccggttacctttaacgtttttaagttacggtttacggtacggtaccggtaaacgttaaccttacgttacccgtttacgttacggttacgttaaccgttaaccgttttcgttttaaaccgttttaggtttaacggttacgggttaccgggtttaacgggtttaaccgtttaccgggttaacccgggtttcgggttccggggtacccgggtttccggggtaacccgggggacccggttaaaccccggggttcccccggtaccgttaaccccggttacccgtccccgtccgtaaccccgtccccaaccccgggtaacccggggtaccccggtaccccgttaccgggttccccccggggtttacccccttcccccggggttccggcccccgttacccgg

SEQ ID NO: 289584 - DNA, 798 bp, Homo sapiens
  misc_feature: GYAE6OF01BUTRH.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccgttcgggacctgtcgctcacctgcgctgtcttaatgactccatcagtagtagtcactggtggtacgttgggtccgcacgtccccgagggaaacggggctggagtggaagttggggaaatcgtctccgtaggtcggggacccaccgaacctacgaaacgtcccgtacccgtacgaaacgtccgacctacacctaatactaccctaagaaccaacctaccaaacgaaccctatttcctacccgtgactaattcgaacttctctgtacgacccggccgacggaccgacggtacctaattttacgtactttggtacggtaccgaagaactacgttacctaccttacggtaattcggaacttacgttttactttaactttaagttacgggtaaccgtttagggggttaacccttaaccggtttaaccgggttaccgttacggggtaaccgtttcgggggttaccggggaaccccggtaaacccgggggtacccccggttaccgtaaaccccgggttcccttaccccggttaccgacccggttccccgttacccccgaaacccggtaacccgggggtccccctaaaccgggtttcccggttaccccccgtttccccccggttgggtccccccggtacccccgg

SEQ ID NO: 289585 - DNA, 691 bp, Homo sapiens
  misc_feature: GYAE6OF01CRZLX.18.81.H04.1.454.CMB.1.raw
  modified_base (391)..(391): a, c, t, g, unknown or other
  misc_feature (391)..(391): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccgttcggggccctgtcgctcacctgcgcttgttctttaatcgactccatcgaagtagtacgtcacgtgggtcggtacgttgggtccgccacgtaccccgaaggggaaaggggcgtaggggagtggtacgttaggggaactctcgtcgtaggtcgggaccaccgaactacaactccgtcctacgaagtcgactcaccatactcctagacaactacaacgtaactctttaccncctcgactatagtactcttactgtacgcccggtacgacggtaccacggtaccgttatttacgttattgtcggtacgtacggactacgttcttacgttacgtagtactacttcgtttactttacgtttaagtcggttaacgttaggggttaaccttaacggttaccggtggttacggtaccggtcggtacgggtaccgacggggtccccgtacgtcccgttccgtcctcgtacccgtccaccccgaacgtacccggccgtaccggttaacccgttcctttaccccgtccgtcggtaccccg

SEQ ID NO: 289586 - DNA, 684 bp, Homo sapiens
  misc_feature: GYAE6OF01A10O5.18.81.H04.1.454.CMB.1.raw
  modified_base (389)..(389): a, c, t, g, unknown or other
  misc_feature (389)..(389): n is a, c, g, or t
  modified_base (406)..(406): a, c, t, g, unknown or other
  misc_feature (406)..(406): n is a, c, g, or t
  modified_base (415)..(415): a, c, t, g, unknown or other
  misc_feature (415)..(415): n is a, c, g, or t
  modified_base (673)..(673): a, c, t, g, unknown or other
  misc_feature (673)..(673): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccgttcggggaccctgtcgctcacctgcgctgttctttaatgacctccatcagtagtagtctacgtgggtggtacgttcgggtcccgcctacggtccccgaagggaaacggggtctgggaggtgggagttaggggaaactcgtctccgtaggtcggggacccaaccaactactaactcccgtccctagaaacgtcgactccaccatactaccctagaccaactaccaaanaacctactttcctcctnactaagttnacttctctgtccgaccgccggacggaccgacgcctagttttacttagtcgtagtacgaagtactacgttctacttacgagttacgaacttacgtttacttagtttaggtacggtacgtttacggggttacctacgtaccgggttcgtacgggtaccgttcggtacggggacccgtaaccggggtccccgtctacccgtcgtcccgtcaccgccctaccgaaccggacggtaccctacgttcccggtacccttccccgnggccccgtccg

SEQ ID NO: 289587 - DNA, 675 bp, Homo sapiens
  misc_feature: GYAE6OF01A9C7T.18.81.H04.1.454.CMB.1.raw
  modified_base (387)..(387): a, c, t, g, unknown or other
  misc_feature (387)..(387): n is a, c, g, or t
  modified_base (662)..(662): a, c, t, g, unknown or other
  misc_feature (662)..(662): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgacgtgacgtcgggcccaggactgggtgaagccgttcggggaccctggtcgctcacctgcgctgtctttaatgactccatcagtagtgtcactggtggtacgttcgggtccgccacgtccccgagggaaacggggctgggagtgggtagttaggggaaacttcgtcgtcgtaggtcggggaccaccaactacaactcccgtcctacgaacgtcgactcactatactcctagacaactaccaagtacctactttccncctgactaattcgactcgtctcggtaccgaccggccggacggtaccgacggacttaagttttataagttcgtacgacgtaactactacttcgttacgttacgattacggtacttagtttcttaagttacgtacgggtacgttaggggtacctacggttacggtcgtagggtacggtcggtacggggacccgacggggtccccgtacgtaccggtcctccgtcgaccgtccctaccggacccgacggccctacgttccccggttaccttccccggngggtccctacccg

SEQ ID NO: 289588 - DNA, 726 bp, Homo sapiens
  misc_feature: GYAE6OF01BSAB7.18.81.H04.1.454.CMB.1.raw
  modified_base (201)..(201): a, c, t, g, unknown or other
  misc_feature (201)..(201): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaacgtccgttcggggaccctgtcgctcactgcgctgttacttaancgtactccatcgagtagtacgtcacgtgggtacggtacgttcgggtccgaccgtaccggtaccccggaaggggaaacggggtcgtaggggaggtagggtaaggttaggggaaactcgtcgtacgtagggtcggggacctaaccgtaactaccgtaacgtcccgtaccgtaacggaacgttccgaaccttaccaacctaatacctacctaacgaacctaaacctaccaaaacgtaaccctatttcccaccgtagactaaagttcgaactctacgtgtaccgacccgccgacgaccgacggttacctagttttactagttagcgtaacgacgtactagttcctacgtagtactacgtattacgtttacttaagtcgtaggtaccgttagggttaacctacgttcggtacgtaggtaccgttcggacgggtacccgaaccgggtccgtcctcccgtctacccgtcgaccgtacctacccgaccggtaccgccctaacgtcccgttaccctcccgcggtcccgtacccg

SEQ ID NO: 289589 - DNA, 785 bp, Homo sapiens
  misc_feature: GYAE6OF01B3QLR.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcggccaggactggtgagccgttcgggaccctgtcgctcacctgcgctgttacttaatcgactcatcagtagtacgtcacgtggtggtacgttcgggtccgccacggtaccccgaagggaacggggctagggagtggtagttagggaatctctcgtaggtcgggccaacaactacacgtccgtaccgtacggaaacgtcgactacgacctactactccctaagaaccaaccttaccgaaacgtaacccttactttcccctacccgtagtaacctaaacgtttcgaacgtttaccgttcgttacggttacccggaccccggtacccggtaaccggtaacccgtaacccgggttacctttaacgttttttaaacgtttacggttacgttaccgggaaccggttaacgtaaccctagtttccctttacggtttacgaacgttcgtaaccgttgttttaacctttagttacggtacgggtacggttacgggttacctacggttacggtcgtacgggtacgttcggtacgggaccggtaccgggtaccccgtacgtacccgttcctccgtcgtaccgtacccgttcccgaacccggtaccggtacccctacggttaccccgttaccccgttccccggcggtccccgtacccg

SEQ ID NO: 289590 - DNA, 833 bp, Homo sapiens
  misc_feature: GYAE6OF01DHOYO.18.81.H04.1.454.CMB.1.raw
  modified_base (474)..(474): a, c, t, g, unknown or other
  misc_feature (474)..(474): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtggagtcgggcccaggactggtgaagccgttcggggaccctgtcgctcacctgcgtctgttactttaatcgtactccatactagttagtacgtctacgtgggtcggtacgttcggggtcccgaccgacgtaccccggaaggggaaacggggcgtaggggaggtagggtaggttaaggggtaaacttccgttaccttaccggtacgggtacggggacccaaccaactaacctaaccgttcccggtaccccgtaacggaaacggtccgtaacctaccaacctaacttacctacccgtaaagaacccaaacctacccaaacgtaaccttactttcctccctanaactaattcgtactctcgtacgtccgtacccggcccgtaccggaaccgtaccggtaccttaagttttacgtttagttacggtgtacggaacgtactaacttcgttacgttacgagttacgtaaccgtttagtttactttaagttacggtacgggtacggttacgggttaacttaccgggtaccggttcgtacgggtacgttcgggtaccgggtaccggtaacccgggtaccccggttctacccgttccttacccgtaccgtacccgtaccccgttacccgaacccgggtaacccggtcccctttacccgggtaccccggtttcccccgtttacccccgggtcgggtcccccgtccccgg

SEQ ID NO: 289591 - DNA, 652 bp, Homo sapiens
  misc_feature: GYAE6OF01CWAO8.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccgttcggggaccctgtcgctcacctgcgctgtctttaatgactccatcagtagtagtcacgtggtggtacgttgggtccgccgacgtccccgaagggaaaggggctggagtggagttaggggaaatctccttccgtaaggtcggggaccaaccgaataccaactccgtccctacgaaagtccgactccaacatactccctagacctaactaccgaaagaaccctatttcctacctgactaattcgacttctcgtgtacgacccgtccgcgtaccgacggtcctatttattatgtgcgagactatctctcgtatacgactacgttcttaattacgtaggtacgtgggttacttaacgttacggtcgtacgggtaccgtacggttccggggacctaaccggggtaccccgtaccgtaccggttcctacccgtcaccgcctacccgaaccgaacggcccctagtcccggtacccttcccccgtggcccgtccccg

SEQ ID NO: 289592 - DNA, 745 bp, Homo sapiens
  misc_feature: GYAE6OF01E4454.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcacgtggtggacgttgggtccgccacgtccccgagggaaaggggctgggagtggagttaggggaatctctccgtaggtcgggacccaacaactacaactcccgtccgtacggtaaactcgacctccacctatactccctaagaccaacctaccaaacgacctactttcctccctgactaattgattcctcgtaggtaccgtaccggccgacggaccgacggtaccttaatttactagttgtcgacgacgactacttcttacgttcgattacgacgttacgtttactttaagttacggtacgggtacggttacggggttaacccttaacggttcccgggttacgttacggggttaccggttccgggttaccgggggacccgtaaaccccgggggtacccccgttaccgtaccccggttccctcccgttcccgtacccggtaccccttaccccgaaacccgggtaaccgggtacccccttaccggttccccggttcccccgtttccccccggtggccccccggttaccccg

SEQ ID NO: 289593 - DNA, 756 bp, Homo sapiens
  misc_feature: GYAE6OF01E00ST.18.81.H04.1.454.CMB.1.raw
  modified_base (197)..(197): a, c, t, g, unknown or other
  misc_feature (197)..(197): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgaggtcgggcccaggactggtgaagccttcggggaccctgtcgctcacctgcgctgtcttangactccatcagtagtagtcacgtgggtggacttcgggtccgccacgtccccgagggaaacggggctgggagtggagttaggggaaactcgtctccgtaggtcggggacccaaccgtaacctaactaacttcccgtacccctaacggaaacgtccggaacctccaaccactaccttaccccgtaagaaccgtaaaccctacccaaaaccggtaacccttaactttccctacccgtagtacctaagtttcggaactttccgtctcggtacggaccccggaccgaccgggaaccacccggtaccttaagttttacttagttcggtcgacggtacgtactacgttcctttacgttaccggattacgtaacttacgtttactttaagttagtacggtacggttacgggtactaccggttacggtccgtaggtaccgttcggacggggtaaccgtaaccggggtacccggtacctacccggtctaccccgtctaccgtacccgtacccgtaccgaaacccgggccctacggttcccggtaccccttcccgtccgggcccgtcccg

SEQ ID NO: 289594 - DNA, 816 bp, Homo sapiens
  misc_feature: GYAE6OF01AMUKW.18.81.H04.1.454.CMB.1.raw
  modified_base (135)..(135): a, c, t, g, unknown or other
  misc_feature (135)..(135): n is a, c, g, or t
  modified_base (252)..(252): a, c, t, g, unknown or other
  misc_feature (252)..(252): n is a, c, g, or t
tcagtacgagtatgcacgaccggtgctcgatttagtagtgtagattcgcgggggcacaagaacatgagacacctgtggttcttcctcctcctggtggcagctcccagagtgggtcctgtctctcgtgctagttgnggtgacggtcgggcccgaggatggtgaagtccgttccggggacctcgtcgtctcacctgcgcttgttacttaatcgactaccatcagtagtagtcacgtggtacgtcgttcggtccnccgacgtacccggtaagggaacgggtctaggtcggtaggtacggttagggaacttctacgttccggtagggtccggggtacccgaactaacgtaaccgtaacgttcccggtacccgtacggtaaacgtccgtactacctaaccgtactaccgtcctaagaccctaacaacctaacctaacgttacctttccctacccgtagtaacgtaacttcgtaccgttaccgttcgtcggttaaccggaccccggtacgggtaccccggaaacgtcccggttacctttaaggtttactttagtttagtcggaacgtcgtaaccgtacttacgttccgttacgtacgtcgtaacgttacgttttacttacgttacggtcggttaacggtacgggttacctacggttaccggtacgggttacgggttaccggttcgggtaccgggtaaccggtacccgggtacccggtccgttacccggaccttccgaccggtacccgtcccgtacccggaacccgtccgggtaaccgtcccgttacggttcccccgtaacccgtccgggtacccgtccccgg

SEQ ID NO: 289595 - DNA, 999 bp, Homo sapiens
  misc_feature: GYAE6OF01CE5XE.18.81.H04.1.454.CMB.1.raw
  modified_base (126)..(126): a, c, t, g, unknown or other
  misc_feature (126)..(126): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtncagttgcgtgagtcgggccaggactggtgacgtccgttccggggacctgtcgctcacctgcgcttcgttactttaacgtcgtacctccataccgtaaggttaacggtacgttaccgacgttaggggtcggtacgttcggggtaccccgaccgtaccggttacccggaaggggaaacggggtcggtaggggtaggttagggtaacggttaacgggggtaaacttccgttaccgtccggttaacggggtaccgggggaccctaaaccgtaaacctaaccgtaaccgttaccccgtacccgtacggaaaccggttccgtaacctaccaaccgtaactaccttaacccgtaacgaaaccctaaccgtaccctaaaacggaaccctttacttacccttaccgtacgtaacttaacgttacgtacctttcgttaccgttcggttacccggacccggtacccggtaccggtaacccgtacccggttaaccttttaacttttaacgtttacgtttacggtccggtaaccgtaacgggtaactttacctacccgttttaccgtaaccggttacgtttaacgtaccgttttaaccgtttttacgtttaacggtttacgggtaaccggggtttaaccgggtttacggggttaaaccgtttaccgggtttacccggttaccggggttacggttacccggggttcgggtacccccgggggtaacccgggtaaaccggggtaccccccggttacggtacccccgtttacgtccccgtaaacccggtcccgttaaccccggaccccggttaacccggacccggttaccccggttcccggttacccccggtttccccccgtccccggttccgggtccccccgtacccgg

SEQ ID NO: 289596 - DNA, 705 bp, Homo sapiens
  misc_feature: GYAE6OF01A7U3I.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccgttcggggaccctgtcgctcacctgcgctgttcttatgactccatcagtagtacgtcactggtggacttcgggtccgccgtacgtccccgaagggaaacggggcgtagggaggtggtagttaggggaaacttcctcgtcgtaggtcggggaccaccgaactacaactccgtaccctacgaagtccgacctcacctactactcctacgaccaacctaccaaacgaacctactttcctcccgtgaactattcgtactcctcttgtcgacccgccgacggaaccacggtaccttatttaactttaagttcgtacgaccggaagtaccgtacttaccttaccttacgactaggtaacttacgttttactttacttaggtacggttaacggttagggttaaccttaacggttacggtcgtcgggaccgtttacgggccgggtaccggaaccgggtccccggtactacccggtctacccgcgtaccgaccctacccgaccggaaccgggtccctacgttcccggtcccttccccggtcgtccccgtcccg

SEQ ID NO: 289597 - DNA, 1028 bp, Homo sapiens
  misc_feature: GYAE6OF01AM2ZB.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttggcgtgagtcgggcccaggactggtgaacgccgttcggggaccctgtcgctccaccgtgcgtctgttactttaactcgtactccatcaggttagtacgtcacgttgggtacggtacgttcgggtcccgacctaacggtccccgaaggggaaacggggttcgtaggggtaggttcgggtaacggttagggggtaaaactcgttaccgttaccggttaggtccggggaccctaaccgtaaacctaaccgtaaaccttccccggtaaccccgttaacgtaaaacggttcccgtaaccttacccgaaaccctaacgtttacccgtccccgtaaaagtaaaccccgtaaaccttaaccccgaaaagttaaaccccgttaccctttttaccctaccccgttaggtaaccttaaaacgtttcgtacgtttacccgttacggttacggtaccgtaacccccggtccggaacgggtaacccgtaaccgggttaacccgtttaatttttaacggtttaacggttcggttacccggggaacgttacgggtaacccttacgttttcccggttaacgtttaacggtacgtacccggtttaacgttaaacccggtttttagttttaaacccggtttggttaaccgggttaacccggggtttaggggtttaaaccctttaccgggtttacggggttaaccccgtttagggggtaacccgttccggggggtaaaccgggggtaccccggttaaacccgggggacccccccggtttaccgtacccggttacccgttacccggtacctaacccgggttcccccaaacccgtaaaccccggggacgtttaccccccgtaacggtttcccccgggttttaaccccctccccgggttaaccggggccccttccccggg

SEQ ID NO: 289598 - DNA, 695 bp, Homo sapiens
  misc_feature: GYAE6OF01A969R.18.81.H04.1.454.CMB.1.raw
  modified_base (236)..(236): a, c, t, g, unknown or other
  misc_feature (236)..(236): n is a, c, g, or t
  modified_base (478)..(478): a, c, t, g, unknown or other
  misc_feature (478)..(478): n is a, c, g, or t
  modified_base (503)..(503): a, c, t, g, unknown or other
  misc_feature (503)..(503): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccgttcgggacctgtcgctcacctgcgctgtcttaatgactcatcagtagtagtcacgtggtggtacttcgggtccnccgaccggtacccgaagggaaacggggtctagggaggttggaagttagggggaaaacttccgttaccgtacgtacggttcggggacccaacctaaaacgtacaacgttcccggttaccctacgtaaaacgtcggaacttaccgactaactacgtaccctagaacctaaacctacccgaaacgtaacctaacgtttacctcccttagaactacgtagacttcctgtcgtcgaccgcgcgaacncgtactattagttactgtgacgtanaactatctcgttacatacgattagtacttactggtacgcgttaggtactaacggtacgtcgtacgtacgttgtcgggaaccgtacgggtaacccgtcgtaccgttaccgacgtaccgtacctcccgaacccgaacccggtaaccgtaccccgtacggttcccgttaccgtcccccgtgggtcccgtccccgg

SEQ ID NO: 289599 - DNA, 165 bp, Homo sapiens
  misc_feature: GYAE6OF02H9Z7J.18.81.H04.1.454.CMB.1.raw
  modified_base (153)..(165): a, c, t, g, unknown or other
  misc_feature (153)..(165): n is a, c, g, or t
tcagtacgagtatgcacgaccggtgctcgatttagtagtgtagattcgcggggtccggaaagtggatgtcagacgaactgtggctgcaccatctgtcttcatcttcccgccatctgacatactcgtactgagcgggctggcaaggcgcatagnnnnnnnnnnnnn

SEQ ID NO: 289600 - DNA, 556 bp, Homo sapiens
  misc_feature: GYAE6OF02I9UY9.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctcctagtggggccaccaactacaatccgtccctcgaaagtcgactcaccatatccctagacaactccaagaaccattctccctgcaattgatctctgtgaccgcgcggacacggccatttattattgtgcgagacatctcttcgatgacagttcttattatggactggggtactactacggtctggacgtcgtgggccgaagggacccggtccgaccgtctccgtcacgcctacccaccgaacgggcccacgtccgtccttcccctcggccgtccccg

SEQ ID NO: 289601 - DNA, 550 bp, Homo sapiens
  misc_feature: GYAE6OF02G0KWM.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcgggggaccctgtcgctcacctgcgctgtctttaatgactccatcagtagtagtcactggtggacttgggtccgccagtccccaggaaaggggctggagtggattggggaaatctctcctagtggggccaccaactacaatccgtccctcgaaagtcgactcaccatatccctagacaactccaagaaccatttctccctgcaattgatctctgtgaccgcgcggacacggccatttattattgtgcgagacatctcttcgatgacagttcttattatggactggggtactactacggtctggacgtcgtggggccaaggggaccccgtcaccgtctccctcagcctccaccagggcccagtccggtccttcccctggccgtccccg

SEQ ID NO: 289602 - DNA, 556 bp, Homo sapiens
  misc_feature: GYAE6OF02GLH11.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctcctagtggggccaccaactacaatccgtccctcgaaagtcgactcaccatatccctagacaactccaagaaccatttctccctgcaattgatctctgtgaccgccgcggacaccggcctatttatattgtgcgagacatctcttcgatgactagttcttattatggactgggtactacgtacggtctggacgtcgtcgggccaacgggccccgtcaccgtctcctcacgccctccaccaacgggcccagtccggtccttccccgtggcccgtccccg

SEQ ID NO: 289603 - DNA, 550 bp, Homo sapiens
  misc_feature: GYAE6OF02JGVNC.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctcctagtggggccaccaactacaatccgtccctcgaaagtcgactcaccatatccctagacaactccaagaaccatttctccctgcaattgatctctgtgaccgccgcggacacggccatttatattgtgcgagacatctcttcgatgacagttcttattatggactgggtactactacggtctggacgtcgtgggccaagggacccgtcaccgtctccctcacgcctccaccaacgggcccagtccggtccttcccccgtggccgtccccg

SEQ ID NO: 289604 - DNA, 589 bp, Homo sapiens
  misc_feature: GYAE6OF02GE7F4.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcgggggaccctgtcgctcacctgcgctgtctttaatgactccatcagtagtagtcactggtgacttgggtccgccagtccccaggaaaggggctggagtggattggggaaatctctcctagtggggccaccaactacaatccgtccctcgaaagtcgactcacatactccctagacaactccaagaaccattctcctgacaattgatctctgtcgaccgccgcggacacggctaatttacttattgtgcgagactatctcttcgatgactagttcttattatggtacgttggggtacttacgtacggtcgtggtacgttcgtcggggaccgtaacgggtacccggtcctaccgtctacccgtcacgtccctaccgaaccgaacgggccctacgttcccggtcctttcccccgtcggccgtaccccg

SEQ ID NO: 289605 - DNA, 624 bp, Homo sapiens
  misc_feature: GYAE6OF02GKAF6.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctcctagtgggccaccaactacaatccgtccctcgaaagtcgactcaccatactccctagacaactccaagaaccatttcctccctgactaattgatctctgtcgaccgcgcggacaccggcctatttattattgtgcgagacatctctcgatgactagtttcttattatggtactggggtactacgtacggtctcggtacgttcgtggggacccgtaacggggtacccccgtcgacccggttccttacccgtccgaaccggtccccttacccgaacccggtaaccgggtaccccctacggttcccgggttacccctttcccccccggtcgggaccccgtcccccgg

SEQ ID NO: 289606 - DNA, 552 bp, Homo sapiens
  misc_feature: GYAE6OF02GX03I.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctcctagtggggccaccaactacaatccgtccctcgaaagtcgactcaccatatccctagacaactccaagaaccattctccctgcaattgatctctgtgaccgccgcggacacggccatttattattgtgcgagacatctcttcgatgacagttcttattatgactggggtactacgtacggtctggacgtcgtgggccgaacgggaccccggtcaccgtctcctcacgcctccaccgaacggcccacgtccgtccttcccctcggccgtcccg

SEQ ID NO: 289607 - DNA, 553 bp, Homo sapiens
  misc_feature: GYAE6OF02I6PR6.18.81.H04.1.454.CMB.1.raw
tcagtacgagtatgcacgaccggtgctcgatttagtagtgtagattcgcgggggcgacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctcctagtggggccaccaactacaatccgtccctcgaaagtcgactcaccatatccctagaccaactccaagaaccatttctccctgcaattgatctctgtgaccgccgcggacacggcatttatattgtgcgagacatctcttcgatgacagttcttatatggactggggtactactacggtctggacgttcgtggggccaacgggacccgtcaccgtcgtcctcagtctcccaccgaacggcccagtccggtccttcccccgtggccgtcccg

SEQ ID NO: 289608 - DNA, 596 bp, Homo sapiens
  misc_feature: GYAE6OF02IYPAR.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctcctagtggggccaccaactacaatccgtccctcgaaagtcgactcaccatactccctagaccaactccaagaacctatttcctccctgactaattgatctctgtcgaccgccgcggacacggcctatttactattgtgcgagactatctcttcgattgaactagttcttattatggtacgttggggtacttacgttacggtcgtcgggtacgttcgtcggggaccaaacggggccccgtacgacccgtctccgtcaccgtcctacccgaccgaacggccctacgttcccggtacccttccccggtcggcccgtcccg

SEQ ID NO: 289609 - DNA, 749 bp, Homo sapiens
  misc_feature: GYAE6OF02I9PAJ.18.81.H04.1.454.CMB.1.raw
tcagtacgagtatgcacgaccggtgctcgatttagtagtgtagattcgcgggggcgacaagaacaatgagacacctgtggttcttcctcctcctggtggcagctcccacgatgggtcctgtctctcgtgcagttgcgtgagtcgggcccaggactggtgaagccttcggggacccgtgtcgctcacctgcgctgtctttaatgactccatcagtagtagtcactggtgacttgggtccgccagtcccccagggaaaggggctggagtggattgggggaaatctcttcctagtggggccaccaactacaatccgtccctcgaaacgtcgactcgaccatactccctagaacaactacccaaagaacccattttcctacccttgacctaaactttggactcttactcggtcgtacccgccggcccggaacgtaccgggccctaagttttaacgtttaatttcgtttacggcgtaacggaaccttaagttccttccgtttaccggattagacttaacggtttactttattaattggaaccggtttggggtaacccttacgttaccgggttccttaggggtaccggttaccgtacgggggtacccgtaaacgggggtacccccgggtccggtaacccgttcccggtccccttccggtaacgacccccgttcccgtaaccccgaacgggggtaccccctaacggttacccgggttcccgttttaccccccccggtgggtcccccgtacccccgg

SEQ ID NO: 289610 - DNA, 581 bp, Homo sapiens
  misc_feature: GYAE6OF02HR4S8.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtccgtgtctctcgtgcagtgcgtgagtcgggcccgaggactggtgaagccttcggggaccctgtcgctcacctgcgctgttctttaatgactccatcagtagtagtcactggtggacttgggtccgccagtccccaggaaaggggctggagtggattggggaaatctctcctaggtggggccaccaactacaactcccgtccctcgaaagtcgactcaccatactccctagacaactccaaagaaccatttctccctgcaaattgatctctgtcaccgccgcgacacgcctatttattattgtgcgagacatcttctcgatgactattcttatatggtacgtgggttactacgtacgtcgtggtacgtcgtgggaccgaacgggtacccgtctaccgtctcccgtcgacgtcctaccgacccgaacgggccctagtcccggttcccttcccccggtcggcccgtccccg

SEQ ID NO: 289611 - DNA, 601 bp, Homo sapiens
  misc_feature: GYAE6OF02JEW1X.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcgggggaccctgtcgctcacctgcgctgtctttaatgactccatcagtagtagtcactggtggacttgggtccgccagtccccaggaaaggggctggagtggattggggaaatctctcctagtggggccacgaactacaatccgtccctcgaaagtcgactcaccatatccctagacaactccaagaaccatttctccctgcaattgatctctgtcgaccgccgcgacacggctatttatattgtgcgagcatctcttcgatgactagtttcttattatggacgttggggttactacgttacggtcgttggaccgttcgttcgggggacccaaacgggggtaccccggtccgacccgttcctcccgtcacgtccctacccgaaccgaaccgggcccctacgttcccggttaccctttccccccgtgggcccgtccccg

SEQ ID NO: 289612 - DNA, 563 bp, Homo sapiens
  misc_feature: GYAE6OF02FPE2M.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcgggggaccctgtcgctcacctgcgctgtctttaatgactccatcagtagtagtcactggtggacttgggtccgccagtccccaggaaaggggctggagtggattggggaaatctctcctagtggggccaccaactacaatccgtccctcgaaagtcgactcaccatatccctagacaactccaagaaccatttcctccctgcaattgatctctgtgaccgccgcggacacgggccatttattattgtgcgagacatctcttcgatgacagttcttattatggactgggtactacgtacggtctggtacgtcgtggggccaacgggccccggtcgaccgtctccgtcacgccctccacccgaacggcccagtccggttcctcccccgtggcccgtccccg

SEQ ID NO: 289613 - DNA, 604 bp, Homo sapiens
  misc_feature: GYAE6OF02HWHRW.18.81.H04.1.454.CMB.1.raw
  modified_base (399)..(399): a, c, t, g, unknown or other
  misc_feature (399)..(399): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggccgccagtccccaggaaagggctggagtggagttggggaaatctctcctaggtgggggccaccaactacaactcccgtccctacgaaagtcgactcaccatactccctagacaactccaaagaacctattctccctgacaattgatctctgtcgaccgccgcggacncggcctaatttattattgtgcgagactatctcttacgatgactagttcttattatggacgttgggtacctacgttacggtctagggacgttcgcggggtaccgaaacggggccccgtcgacccgttcctcccgtccgaccgtccctacccgaaccgaaccgggcccacgttcccggtccctttcccccgtcgggccccgtccccg

SEQ ID NO: 289614 - DNA, 566 bp, Homo sapiens
  misc_feature: GYAE6OF02JBX5M.18.81.H04.1.454.CMB.1.raw
  modified_base (363)..(363): a, c, t, g, unknown or other
  misc_feature (363)..(363): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcgggggaccctgtcgctcacctgcgctgtctttaatgactccatcagtagtagtcactggtggacttgggtccgccagtccccaggaaaggggctgggagtggattggggaaatctctcctagtggggccacaactacaatccgtccctcgaaagtcgactcaccatactccctagacaactccaaagaacctatttccnccctgcaattgatctctgtcgaccgccgcggacacggcctatttattattgtgcgagactatctcttcgatgactagttacttattatggactggggtactacgtacgtctggtacgtcgtcggggctaacgggaccccggtcaccgtctccgtcacgcctccgaccgacggcccacgtccgtccctcccgtcggccgtcccg

SEQ ID NO: 289615 - DNA, 732 bp, Homo sapiens
  misc_feature: GYAE6OF02JV61V.18.81.H04.1.454.CMB.1.raw
  modified_base (200)..(200): a, c, t, g, unknown or other
  misc_feature (200)..(200): n is a, c, g, or t
  modified_base (241)..(241): a, c, t, g, unknown or other
  misc_feature (241)..(241): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgaggtcgggcccaggactggtgaagccgttcggggaccctgtcgctcacctgcgctgtctttaangactccatcagtagtagtcacgtggtggtacgttgggtccncagtcctgaagggaaggggctaggagtaggagtagggaatctctctaggtcgggccacaactacaactcccgtcctacgaagtcgactcacatactccctagacaacctaccaaacgaacctactttcctacccgtagacctaaattagacttccgttcgtacggttacgaccccggaccggtaccggaaccgtaccgggtaccttaagttttaactttagttcggtacggtacgaacgtactacttcgtccgttacgagttacgaacttacgtttactttaattacggttacggtaacgttcggggttaaccttacggttacgggttacgttacgggttacggttccgggttacggggaacccgggtaacccggggtaccccggttacccgtacccggttccgtacccgttacgacccggtacccgtaacccgaacccggtaaccggtcccgtaccggtcccgttaccccggttccccgccggtccccgg

SEQ ID NO: 289616 - DNA, 617 bp, Homo sapiens
  misc_feature: GYAE6OF02IXFEW.18.81.H04.1.454.CMB.1.raw
  modified_base (359)..(359): a, c, t, g, unknown or other
  misc_feature (359)..(359): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggacctgtcgctcacctgcgctgtctttaatgactccatcagtagtagtcactggtggacttgggtccgccagtccccagggaaaggggctggagtggagttggggaaatctctcctaggtggggccacaactacaatccgtcctcgaaagtcgactcaccatactccctagaacaactccaagaaccattcncctgacaattcgatctctgtacgaccgccgcggacacggacctagtttacttattgtcgcgagacatctctcgatagactagttacttatagtcggacgttaggggtactacgttacgtctagggaccttcgtcggggtaccgaaacggggtaccccgttaccgacccggttacctacccgtcgaacgtcccgtacccgaaccggtaaaccggggcccctaacggtccggttccctacccccggttggcccgtccccg

SEQ ID NO: 289617 - DNA, 589 bp, Homo sapiens
  misc_feature: GYAE6OF02HVZSO.18.81.H04.1.454.CMB.1.raw
  modified_base (448)..(448): a, c, t, g, unknown or other
  misc_feature (448)..(448): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctcctagtggggccaccaactacaatccgtccctacgaaagtcgactcaccatactccctagacaactccaagaccatttctaccctgcaattgactctctgtgaccgccgcggaccacggccatttattatttgtgcgaggacatctcttcgatgactagttctttattntaggtacttggggtacttacgtacgggtctgggaccgttcgtcggggccaacggggtaccccgtcgaccgttcctacccgtcacgccctccgaaccgaacgggccccagtcccggttcccttcccccgtggcccgtccccg

SEQ ID NO: 289618 - DNA, 565 bp, Homo sapiens
  misc_feature: GYAE6OF02FKAEV.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctcctagtggggccaccaactacaatccgtccctcgaaagtcgactcaccatatccctagacaactccaagaaccatttctccctgcaattgatctctgtgaccgccgcggacacggccatttattattgtgcgagacatctcttcgatgacagttcttattatggtactggggtactacgtacggtctggacgtcgtcggggccgaacgggaccccggtcgacccgtctcctcacgccctcccaaccgaacggcccagtccggtccttcccccgtggcccgtccccg

SEQ ID NO: 289619 - DNA, 581 bp, Homo sapiens
  misc_feature: GYAE6OF02F19SY.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccagggaaggggctggagtggattggggaaatctctctagtggggccaccaactacatccgtccctcggaagtcgactcaccatactccctagacaactccaagaacctatttcctcctagctaatgatctctgtcgaccgccgcggacaccggctatttatattgtgcgtagactatcttctcgatgactagtttcttattagtgtacgttgggttactacgtacggtgtacggtcgttgtcgggccgtaaacgggccccggtcaccggttctccgtcacgtcccgtaccacccgagggcccctacgttcccggtcccttccccgtggcccgtcccg

SEQ ID NO: 289620 - DNA, 572 bp, Homo sapiens
  misc_feature: GYAE6OF02F8WUV.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtaccccagggaaagggggctgggagtggattggggaaatctctcctagtgggggcccaccaactacaatccgtccctcgaaagtcgactcaccatactccctagacaactccaaagaacctatttcctccctgacaattgactctctgtcgaccgccgcggacacggcctatttattatgtgcgagacatctcttcgatgactagttcttattatgacgtgggtactacgtacggtctggacgttcgcgggaccgaacgggtacccgtcaccgtctccgtcacgcctaccgaccgaacggcccacgtcccggtcctccccgtggccctcccg

SEQ ID NO: 289621 - DNA, 696 bp, Homo sapiens
  misc_feature: GYAE6OF02HV7QB.18.81.H04.1.454.CMB.1.raw
  modified_base (388)..(388): a, c, t, g, unknown or other
  misc_feature (388)..(388): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgaggtcgggccaggactaggcgacgccgttcggggcctgtcgctcacctgcgctgtactttaatgactccatcagtagtagtcagtggtggacgttcgggccgccaacgtcccaagggaaagggctggagtggtagttggggaaatctctcgtggcgggaccaccaacacaacgtccgtaccctacggaaacgtccgactaccacctactacttcccagaaccaacctaccaaactaactacttttcaccctntaactaagttcactctcgtagtcgaccgccggacgaccgacggtaccttatttagttagtcggtgaccgagtactacttcttcgttacgtatacgtaacgttactttctttaagtagttacggacgttcggggtaaccttacgttaccgggtcgtacgggtacggttacgggtacggggtaacccgaaccggggtacccgtacctaccgggttcctccggttaccgaccgtacccgttacccgaaacccgggtacccggtacctcggttccccggttaccccgttccccggtacggtccccgtacccg

SEQ ID NO: 289622 - DNA, 594 bp, Homo sapiens
  misc_feature: GYAE6OF02GYKF3.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctcctagtggggccaccaactacaatccgtccctcgaaagtcgactcacatatcccagacaactccaagaaccatttcctccctgcaaattgaacttctctgtcgacccgccgacgggacaccggcctattttacttattcgtgtcgagactatcttcttcgatggaactagtttacttattagtggtacgtcggggtactacgtacgtcgtggtacgtcgtggggaccgaacgggccccggtcaccgtcctcctcgacgtccctccgaaccgacgggcccacgttcccggttaccctcccccgtggcccgtccccg

SEQ ID NO: 289623 - DNA, 572 bp, Homo sapiens
  misc_feature: GYAE6OF02GP72T.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctcctagtggggccaccaactacaatccatccctcgaaagtcgactcaccatactccctagacaactccaacgaaccatttcctccctgctaattgactctctgtcgaccgccgcggacacggcctatttattattgtgcgagacatctctcgatgactagttcttattatggactgggtactacgtacggtctggacgttcgtcgggccgaacgggtaccccgtcgacccgtcgtccgtccggccctaccgaaccgacggcccagtcccggttcctccccgtggtcccgtcccg

SEQ ID NO: 289624 - DNA, 571 bp, Homo sapiens
  misc_feature: GYAE6OF02HPWER.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggagttggggaaatctctcctagtggggccaccaactacaatccgtccctcgaaagtcgactcaccatactccctagacaactccaagaaccattctccctgacaattgatctctgtcgaccgccgcggacacggcctaatttattacttgtgcgagacatctcttcgatgactagttcttattatggactggggtactacgtacggtctggacgtcgtcggggccaacgggcccgtcaccgtctcccgtcaccgccctcccaaccgacgggccctacgtccggttcccttccccgtcggccgtccccg

SEQ ID NO: 289625 - DNA, 690 bp, Homo sapiens
  misc_feature: GYAE6OF02IT6TM.18.81.H04.1.454.CMB.1.raw
  modified_base (360)..(360): a, c, t, g, unknown or other
  misc_feature (360)..(360): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccgttcggggaccctgtcgctcacctgcgctgtcttaatgactccatcgagtagtagtcacgtggtggacgttcgggtccgccacgtccccgaagggaaagggtctggaggtggagttaggggaaatctcgtacctaggtcggggccaaccgaactacaacgtcccgtccctacgaaagtccgactcaccatactccctanacaaccgacaacgaacctactttccgtcctagactaattcgactctcgtacgtcgaccgtccggacgaccgtaaccggctaacttttagttactttaggtcgacgagtactacgttcctcgttcgacgtagaacttacgtttacttagttacgtacggtaggttacgggtaacttaaccggtcggttactcgggtacgttcgtacggggacctaaaccggggcccctacggtacccgttcctacccgtcgtacctcccgaaccccgtacgaacccgggtacccttaacggtccccgttaccccggttcccccgtacggcccgtaccccgg

SEQ ID NO: 289626 - DNA, 602 bp, Homo sapiens
  misc_feature: GYAE6OF02IXN3N.18.81.H04.1.454.CMB.1.raw
  modified_base (405)..(405): a, c, t, g, unknown or other
  misc_feature (405)..(405): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctccagtgggccacaactacatccgtcctcgaaagtcgactcacatatccctagacaactccaagaacccatttcctccctgccaattgatctctgtgaccgcgccggacaccggcattttatattgngcgagaccatctcgttcgatcgtactagtttctttattatcgggtacgtggggtaactaccgttacggtcgttcggacggttcgtacggggaccctaaacggggaccccggttcacccggttctcccgtcgtaaccgccctcccgaacccgaagggtcccctaggttcccggtacccttccccctgggccctccccg

SEQ ID NO: 289627 - DNA, 587 bp, Homo sapiens
  misc_feature: GYAE6OF02GEIZ2.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccagggaaaggggctggagtggattggggaaatctctcctagtgggccaccaactacaatcccgtccctcgaaagtcgactcaccatactccctagacaacctaccaagaacctatttcctccctgccaaattgatctctgtcgaccgccgcggaccacgggccattttattattgtgcgagacatcctcgtttcgatgactgtttacttattatggacgttaggggtacttacgtacggttctggtacgtcgtgggaccgaacgggccccgtcaccgtctcccgtcaacgtccctaccgaccgacgggccctagttccggtcccttccccgtcgcccgtcccg

SEQ ID NO: 289628 - DNA, 646 bp, Homo sapiens
  misc_feature: GYAE6OF02HQPW7.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccagggaaaggggctgggagtggagttggggaaatctctcctagtgggccaccaactacaactccgtccctacgaagtacgactcaccatactcctagacaactaccaacgaaccacttctccctcacgggggtaattagactctctcgtcgaccgccgcggacacggcctatttattattgtgcgagacatctcttacgtatagtactagttactttattagtaggtacggttacgggttacttaccgttacggtacgtcggtacgtacgtcggggaccggaaaccggggtaccccggtccgtacccgttccgtacccgtccgtaccgaccctacccgtaacccgaacgggtaccccgtacgtacccggttccccgttcccccggtccggtcccgtaccccg

SEQ ID NO: 289629 - DNA, 605 bp, Homo sapiens
  misc_feature: GYAE6OF02F7ZAL.18.81.H04.1.454.CMB.1.raw
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccagggaaaggggctgggagtggagttggggaaatctctccgtaggtcggggccaccaactacaatcccgtccctacgaaagtcgactcaccatatccctagacaactccaaagaacctatttccncctnactaattgatctctgtcgaccgccgcggacacggcctatttattattgtgcgagactatcttcttcgatcgactagtttacttattatcggtacttaggggtactacgtacggttacgtcggtacgttcggtcgggccgtaaccggggtaccccgtcgaccgtccgtccgtcgacgcccgtcccaaccgaacggtcccacggttccgttcccgtcccccgtggcccgtcccg

SEQ ID NO: 289630 - DNA, 589 bp, Homo sapiens
  misc_feature: GYAE6OF02IE311.18.81.H04.1.454.CMB.1.raw
tcagtacgagtatgcacgaccggtgctcgatttagtagtgtagattcgcgggggcacaagaacatgagacacctgtggttcttcctcctcctggtggcagctccccagatgggtcctgtctctcgtgcagttgcgtgagtcgggcccaggactggtgaagccttcggggaccctgtcgctcacctgcgctgtctttaatgactccatcagtagtagtcactggtggacttgggtccgccacgtccccaggaaaggggctggagtggattggggaaatctctcctagtggggccaaccaactacaatccgtccctcgaaagtcgactcaccatactccctagacaactccaaagaacctattcctccctgacaattgaatctctgtgacccgcgcggacaccgggcctatttattattgtgcgagactatctcttcgatgactagtttcttattatggacgtggggttacctacgtacgtcgtggtacgtcgtgggaccgaacggggacccgtcgacccgtctcctcacgccctcccgaaccgaacgggccctacgtcccggttcccgttccccccgtcggccgtccccg

SEQ ID NO: 289631 - DNA, 637 bp, Homo sapiens
  misc_feature: GYAE6OF02HW0M3.18.81.H04.1.454.CMB.1.raw
tcagtacgagtatgcacgaccggtgctcgatttagtagtgtagattcgcggggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccagggaaaggggctggagtggagttggggaaatctctcctagtggggccaccaactacaactccgtccctacgaaagtcgactcaccatactccctagacaactccaaagaacctactttcctaccctgacaattgacttctctgtcgacccgccgcggaccacggcctaattttattagttgtcgcgagactatctcttcgatgactagttcttagttatcggtacgttggggtaaccttacgttacgggtctagggtaccgttcgtacgggggaccgaaaccggggtaccccggtcctacccggttcctacccgtccaccggtccctcccgaacccgaaccgggtccctacggttcccggttaccctttcccccgtacggcccgtccccg

SEQ ID NO: 289632 - DNA, 617 bp, Homo sapiens
  misc_feature: GYAE6OF02IFPPG.18.81.H04.1.454.CMB.1.raw
  modified_base (365)..(365): a, c, t, g, unknown or other
  misc_feature (365)..(365): n is a, c, g, or t
  modified_base (381)..(381): a, c, t, g, unknown or other
  misc_feature (381)..(381): n is a, c, g, or t
  modified_base (604)..(604): a, c, t, g, unknown or other
  misc_feature (604)..(604): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtcttaatgactccatcagtagtagtcactggtggacttgggtccgccagtccccagggaaggggctggagtggagttggggaaatctctctgtcgggccaccaactacaatcccgccctacgaaagtcgactccaccatactaccctagaacaactccaaacgaactactttccnccctgctaatgatctntcgtcgaccgccgcgacacggcctatttattattcgcgacgagactatctcttacgatcgaactgttacttattagtggtacgttgggtacctacgttacgtcgtaggaccgttcgtcggggacccaacggggtaccccgtcctacccggtccttcccgacgaccgtcccctaccgaacccgtaaccgggccctacggttcccggttacccctttcccccggngtccccgtccccg

SEQ ID NO: 289633 - DNA, 607 bp, Homo sapiens
  misc_feature: GYAE6OF02HNZIS.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccacgtccccagggaagggctggagtggattggggaaatctctcctagtgggccacaactacaatccgtccctacgaaagtcgactcaccatactccctagacaactccaagaaccatttcctcctgactaattgactctctgtcgaccgccgacggacacggcctaatttacttagttcgtgcgagactatcttcttacgatgactagttctttatagtggtacgttgggtacttacgtacggtcttaggacgttcgtcggggaccgaaacggggtaccccgtacgacccgttctacccgtcaccgtccctacccgacccgaacggccctaacggtcccggttcccttcccccgtggaccccgtccccgg

SEQ ID NO: 289634 - DNA, 625 bp, Homo sapiens
  misc_feature: GYAE6OF02IBC60.18.81.H04.1.454.CMB.1.raw
  modified_base (197)..(197): a, c, t, g, unknown or other
  misc_feature (197)..(197): n is a, c, g, or t
  modified_base (455)..(455): a, c, t, g, unknown or other
  misc_feature (455)..(455): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtcttaangactccatcagtagtagtcactggtggacttgggtccgccacgtcccaggaaagggctggagtggattggggaaatctctcctagtcggggccaccaactacaatccgtccctcgaaagtcgactcaccatactccctagaaccaactccaagaacctacttcctccctgactaattgactctctgtcgaccgccgtcgacacggctactttatattgtgcgagactatctacttcgatgacgtagttcttattacgnggtacgtcggggttaacctaacgtaccggtcgttagggaccgttcggtcggggaccgtaaaccggggtaccccgggtcctaccggttccttaccgtcgaccgtccctacccgaacccgaacgggtccctacggttccggtaccctttcccccgtgggtacccgtccccgg

SEQ ID NO: 289635 - DNA, 556 bp, Homo sapiens
  misc_feature: GYAE6OF02IKPKR.18.81.H04.1.454.CMB.1.raw
  modified_base (508)..(508): a, c, t, g, unknown or other
  misc_feature (508)..(508): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaggggctggagtggattggggaatctctcctagtgggccaccaactacaatccgtccctcgaagtcgactcaccatactccctagacaactccaacgacctattctccctgactaattgactctctgtcgaccgccgcgacacggcctatttattattgtgcgagacatctcttcgatgactgttcttattgtgacgttgggtactacgtacgtctggtacgtcgtcgggacaacgggtcccgtcaccgtcctccgtcncgccctaccgacgacggcccagtccgtccgttcccgtcggccgtcccg

SEQ ID NO: 289636 - DNA, 714 bp, Homo sapiens
  misc_feature: GYAE6OF02GQ0SD.18.81.H04.1.454.CMB.1.raw
  modified_base (398)..(398): a, c, t, g, unknown or other
  misc_feature (398)..(398): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccgaggactggtgaagccgttccggggaccctgtcgctcacctgcgctgtctttaatgactcatcagtagtagtcagtggtggtacgttcgggtccgacctacgtaccccgaaggggaaacggggggtctggggaaggtggagttaggggaaatctctccgttaggtcggggaccaaccgaactacaacgtcccgtcccgtacgaaagtccgactcaacctactactccctaagacaactacaaacgtaacctntttcctaccctagactaattcgtactctcgtcgtacggacccgtcgaccggaacgtaccggtacctaattttactttaatcggtgacgaagtacacttacttccgttacgacttaggtaacgttcgttttaacctttaatttacgtacggtacgttaggggtaaccttaacgtccggtacgttgggaccgttcggtccgggaacgtaacccggggacccgttcgaccttccgtacctccggtactccccgtaccgaacccgtacgggaccccttaccgggttccgtaccccgttttcccgaccgggccccgtcccg

SEQ ID NO: 289637 - DNA, 798 bp, Homo sapiens
  misc_feature: GYAE6OF02FVIN5.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactcatcagtagtagtcacgtggtggtacgttcgggtccgccgacgtccccgaagggaaacggggtctgggaggtggaagttgggggaaaattccgtcgtaccgttaagggttcgggggacccaaccgtaaactaccgaaacgttcccgttacccctacggtaaaacggtccgaacctaccgaaccaagttaacctccccgtaagaaaccctaacctaccaaacgaaccctactttcctaccccttgacctaattcgaactccttcgttggtacgacccggtccgaccgggtaaccaccgggtccctaagttttacttaacgtttggtacgtacggtaacggaactattccttaccttcgattacgtaaccttaggtttactttaagttagtacggtaccgttaggggttaacttaccggttaacgggtcgttcgggtaaccgttccggggtacggggacccggtaaaccggggttccccggtaccgtacccggttacccgtcccgtaaccggtaccgtacccctaacccgtaacccggtaaccggacccgtacgttccccggtttaccccttcccccggtcggtaccccgtcccccgg

SEQ ID NO: 289638 - DNA, 583 bp, Homo sapiens
  misc_feature: GYAE6OF02HBGH1.18.81.H04.1.454.CMB.1.raw
  modified_base (199)..(199): a, c, t, g, unknown or other
  misc_feature (199)..(199): n is a, c, g, or t
  modified_base (344)..(344): a, c, t, g, unknown or other
  misc_feature (344)..(344): n is a, c, g, or t
  modified_base (375)..(375): a, c, t, g, unknown or other
  misc_feature (375)..(375): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
  modified_base (530)..(530): a, c, t, g, unknown or other
  misc_feature (530)..(530): n is a, c, g, or t
  modified_base (534)..(534): a, c, t, g, unknown or other
  misc_feature (534)..(534): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccgttcggggaccctgtcgctcacctgcgctgtctttaangactccatcagtagtagtcacgtggtggtacttgggtccgccacgtccccgagggaaacggggctggagtggagttggggaaatctctcgtaggtcgggccaaccaactacaactcccgtcctacgaacgtcgactcaccatacnccctagacaactaccaaagaacctatttccncctgactaacttgacttctctgtcgaccgccgcggacacggctaatttactatgtgcganactntcttntcgatgacttagtttacttatcgtggtacgtgggtactacgttcgtagtcggacgtcgcgggaccgacgggtcccgtctaccgtcncctnccgcctaccgaccgacgccgtacgtccgtcctccccgtcggcccgtccg

SEQ ID NO: 289639 - DNA, 600 bp, Homo sapiens
  misc_feature: GYAE6OF02F7IP0.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactcatcagtagtagtcactggtggacttgggtccgccgacgtccccgaggaaacggggctgggagtggagttggggaaatctctcctaggtgggccaccaaactacaactccgtcccacgtaaacgtcgactcaccatactaccctagacaactccaaacgaacctatttctccctgactaacttgattctctcgtacgaccgccgcggactacggacctattttattattgtgacgagtacatctactttcgattcgaactacttctttaacttagtaggtacgttagggttacctacgttacggtacgtcggtacgttcgagggaccgaacgggccccgtgaccgtctaccgtcacgtcctccacgacggcctacgtccgtcctcccgtgccgtcccg

SEQ ID NO: 289640 - DNA, 582 bp, Homo sapiens
  misc_feature: GYAE6OF02FHXW3.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttggggtccgccagtccccagggaaaggggctggagtggattggggaaatctctcctaggtggggccaccaactacaatccgtccctcgaaagtcgactcaccatatccctagacaactccaagaaccatttcctccctgcaattgatctctgtgacccgccgcggacaccgggcctatttatttatgtgacgagacattctcttcgatgacagtttcttatagtggacgttgggttactagtacggtcgtaggacgttcgtggggccgaacgggtccccggtcgacccgtccgtccgtcgctcccgtaccaccgtaaggccccacgtccggtccttcccccgtggcccgtcccg

SEQ ID NO: 289641 - DNA, 749 bp, Homo sapiens
  misc_feature: GYAE6OF02J2PCY.18.81.H04.1.454.CMB.1.raw
  modified_base (187)..(187): a, c, t, g, unknown or other
  misc_feature (187)..(187): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccgttcggggacctgtcgctcactgcgntgtctttaatgactccatcagtagtatcacgtgggtggtacgtttcgggtcccgccgacgtccccgaagggaaacgggggtcctagggtagtgggtaagttggggaaattcttcgtccgtaggtcggggcccaaccaacttaccaagttccccgtaccctacggtaaactccgacctccaactactactccccgtaagaacctaacctaccctaaacgaaccctaacttttccctaccctggtaactaacgtttgacctttacctcgttacggtccggaacccgggccccgttacgggaacccgtaccgggtaccttaatttacgtttagttcgtacgcgtaacgactactttctacgttacgtagtacggtacttacgtttatttaacttagtcggtacggttacgggtacctttacgggacgttcgtacgtaccggttcggttaccggggacctaaccggggtacccgtccgtaccggttcctcctaaccggcctaccgttacccgaaccggtaaccgcccgtacggtcccggttcccttacccggtcggacccgtcccg

SEQ ID NO: 289642 - DNA, 924 bp, Homo sapiens
  misc_feature: GYAE6OF02GVZ7Z.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacgttgggtccgccacgtccccgaagggaacgggctggacgtggagttggggaaatctctccgtaggtggggcccaaccaacgtacaacttcccgtacccgtacggaaacgtccgaaccttccaaccctaatacgtacccctaagaacctaaaccgtacccaaacgaaaccctacttttacccgtacccttagaccctaaatttcgaactttccgttccgttagtccggaaccccggcccggaccgggaacccgtaacccgggtaccctttaagttttttaacgtttacgttttacgggttcggtaaccgtaacggtaaaccctaacgtttcccgtttccgtttaacggttaacgttaaccgggttacctttaaaccggttttttaccgttttaaagtttttaacgtcgggggtttaaaccggttttacgggggggtttaaaaccctttaaacccggggtttaaccgggtttaccgggtttacggggtaacccgggttttccgggttacggggggaacccccggttaaaccgggggtaccccccgggttacccggtacccggttttcccctacccggttcccgttaacccggtaccccttaacccccgtaaacccgggtaacccgggtacccccgtaaccgggtttcccggtttaccccccgttttcccccccgggtacgggtcccccgtccccccggg

SEQ ID NO: 289643 - DNA, 580 bp, Homo sapiens
  misc_feature: GYAE6OF02H1MMC.18.81.H04.1.454.CMB.1.raw
  modified_base (508)..(508): a, c, t, g, unknown or other
  misc_feature (508)..(508): n is a, c, g, or t
tcagtacgagtatgcacgaccggtgctcgatttagtagtgtagattcgcgggggaacaagaacatgagacacctgtggttcttcctcctcctggtggcagctcccagatgggtcctgtctctcgtgcagttgcgtgagtcgggcccaggactggtgaagccttcgggggaccctgtcgctcacctgcgctgtctttaatgactccatcagtagtagtcactggtggactttgggtccgcacgtccccagggaaaggggctggagtggattgggggaaatctctcctagtggggccaccaactacaatccgtccctcgaaatcggactcaccatatcccctagacaactccaagaaccatttcctcctgccaattgatctctgtcgccgccgcggacacggcctatttattattgtgcgagacatctcttcgatgaactagtttcttattagtgacttggggtactacgttacgtacgtggacgtcgtgggcccgaaggggaccccgtnaccgtctcctacgcgccctccgacccgaacggccctacgtccgtcccgttcccccgtaggcccgtccctcgg

SEQ ID NO: 289644 - DNA, 930 bp, Homo sapiens
  misc_feature: GYAE6OF02GU8KG.18.81.H04.1.454.CMB.1.raw
  modified_base (544)..(544): a, c, t, g, unknown or other
  misc_feature (544)..(544): n is a, c, g, or t
tcagtacgagtatgcacgaccggtgctcgatttagtagtgtagattcgcgggggcgacaagaacatgagacacctgtggttcttcctcctcctggtgggcagctcccagatgggtcctgtcctctcgtcactgtgcgtagcggtccggccgacgcgtggagtacgtccggtccgggacctcggtcgactcctcgtcggccgtcgttacgtttactttaagtcgtacctacgtactacgtaaggttacgtacgtaccgtacggttgggtacggttaccggtttcgggggtcccccgaccgtaacccggtaaccccgggaaaggggggtaaaccgggtcggtacgggtaggtacggttagggtaagggttaactccgtcgttaacggtgggtacccggaccaaccgtaaactactaaccggttccccgtaccgtaagggtaacctacgacctaaccacctaacttacccgtcgaaacaaccgtaacctacggaaaaccttacttaccttaccctccgtagtaaccttagtacttctctaccggttnaccggtaccccggtcggaaccgccgggtaacccgtactttttaattttacgtttaacgttcggtaccgggtacgtaaaccggttacctaacgtttccgttctaacggtagttaaccgtaacggtttactttaacggtttacttacggttacgggtacgggttccggtttaaaccgtcggtttaaccccggtttgtaccgggttacccgggtagggaccccggtaaaccgggtcccgggtaaacccgggttcccgtacccttacccggttcccgttaaaccgggccctacccccggttaaccggaaacccggttacccggggtaacccgtttcccggtaccccggtttttcccccggccccggttaccgggttacccccgtacccgg

SEQ ID NO: 289645 - DNA, 887 bp, Homo sapiens
  misc_feature: GYAE6OF02H8NLB.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgaggtcgggccaggactggtgaagccgttcggggaccctgtcgctcacctgcgtctgtactttaatgactccatcagtagtatcacgtgggtggtacgtttcgggtcccgaccgtacgtccccgaaggggaaacggggcttacgggagttagggaggttagggggaaactcgtaccgttaccgtaggttcggggacccaaccgtaaactaaccgaacgttccccggtacccctaacggtaaacgttccggaacctaccaacctactaccgtaccctaacgaaccaaacctaccaaagaacccttaactttaccgtacccttaggactaaacgttacgtactttcgtacgttacggtccgtaaccccggaccggtaccgggaaccgacccgggtaccttaaagtttttaactttagtttcggtacgggtaaccgtaagtaaccttacgttaccctttacgtttacggacgtttaacgtaaaccgtttacgtttaaacgtttttaacgttaaggtttaccggggtaacggttttaccggggggttaaaccctttaaccgggtttaccgggtttaccgttaccggggttaacgttaacccgggttgggggtaaaccccggtaaccggggtacccccggtaccggtaccccgtctaccccggttacgacccgtacccttaccccggaacccgggaccggtacccctagggttacccccggtttccccgttacccccgtcgggaccccttaccccgg

SEQ ID NO: 289646 - DNA, 648 bp, Homo sapiens
  misc_feature: GYAE6OF02G8U8K.18.81.H04.1.454.CMB.1.raw
  modified_base (455)..(455): a, c, t, g, unknown or other
  misc_feature (455)..(455): n is a, c, g, or t
  modified_base (484)..(484): a, c, t, g, unknown or other
  misc_feature (484)..(484): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtatcactggtgtacgttgggtccgccacgtccccgagggaaacggggctggagtggagttggggaaatctctcctaggtcgggccaaccgaactacaacgtcccgtcctacgaacgtcgactaccacatacctcctaagacaactaccaagaacctatttccgtctacgctaattcgattcgtctgtacgaccgccgcggacgaccggtactacttttattaacgttgtacggacgtagactntaccttcgtactagacgttattacggttnttattaacgtcggtacggttacggtactacgtacggtacgtggaccgttcggcgggaccgaaacggggtcccctacgccgttcctccgtaccgtacgtcccgtaccgacccgtaacggcccctacgttcccgggttacccctacccggtcggtcccgtccccgg

SEQ ID NO: 289647 - DNA, 737 bp, Homo sapiens
  misc_feature: GYAE6OF02FK729.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcgggggaccctgtcgctcacctgcgctgtctttaatgacctccatcagtagtagtcacgtggtggacgttgggtcccgccacgtccccgagggtaaacggggctggaggtggagttggggaatcctctccgtaaggtcgggccaccgaactaccaactccgtccctacgaaacgtcgactcaccatacgtaccctagacaacctaccaacgaacctactttcctcccgtcgctaacttgactctctcgtcgaacccggtcccgacggaccgaccggacctactttactttacgtgtacgacgaagaccgtactccttcgttacgtacgtacgtaaccttacgttttacgtttaacttcgttacgggtaccgtttaacggggttaaccttaaccggttaccgggttaccgttaggtaaccggttccggtaccgggtacccggtaacccggggaccccggtaccgtacccggttccctccgtaaccgtccgtaccccgtacccgaacccggtaaccgggtaccccgtaaccgttcccgggttccccttccccccggtcgggtccccgttaccccgg

SEQ ID NO: 289648 - DNA, 677 bp, Homo sapiens
  misc_feature: GYAE6OF02FJK1Z.18.81.H04.1.454.CMB.1.raw
  modified_base (382)..(382): a, c, t, g, unknown or other
  misc_feature (382)..(382): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcacgtggtggtacgttcggggtcccgcctacgtccccgaagggaaacggggctgggagtggagttaggggaaatctctccgtaggtcggggccaaccaactacaactcccgtccctacgaaacgtcgactcaccatactcccagacaactcaacgaaccatttccnccctagacattcgattctcgtgtcgacccgccggacggaccacggacctattttacgttagttggtacgacggtacgactactccttcgttcgattacgactagtttcttattacgtgtacgtgggttaaccttacgtacgtcgttagggaccgttccggtacggggacccgtaaacggggtccccgttaccgtacccggttaccgtccctacggaccgacccctacccgacccgtaacgggccccttaccgttaccccgggttcccctttacccccggccggtcccgtccccgg

SEQ ID NO: 289649 - DNA, 629 bp, Homo sapiens
  misc_feature: GYAE6OF02GV06N.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccgttcggggaccctgtcgctcacctgcgctgtctttaatgactccatcagtagtagtcacgtggtggacttgggtccgccagtccccgaggaaaggggctggagtggagttaggggtaaatctctccgtaggtcgggtccaccgaactacaatccactccctagaaacgtcgactaccaccatactcctacgaacaactaccaacgaacctacttctccctgctaatagtcttactctcgtacgaccggcccgaccggaccacgcctaagtttactttagttgtgtaccgagtacgattccttacttcgagttactagttacgttactttattagttacgggtacgttgggtaaccttacgtacgtacgtcgtacgtcggtacgggtaccgacgggaccccgtcgaccgtccgtcctccgacgtcctacccgacgaccgtcccacgtccggtcctccccgtagtcccgg

SEQ ID NO: 289650 - DNA, 777 bp, Homo sapiens
  misc_feature: GYAE6OF02JHRQH.18.81.H04.1.454.CMB.1.raw
  modified_base (661)..(661): a, c, t, g, unknown or other
  misc_feature (661)..(661): n is a, c, g, or t
tcagtacgagtatgcacgaccggtgctcgatttagtagtgtagattcgcgggggcgacaagaacatgagacacctgtggttcttcctcctcctcggtggcagctcccagatgggtcctgtctctcgtgcagttgcgtgagtcgggcccaggactggtgaagccttcggggaccctgtcgctcacctgcgctgtctttaatgactccatcagtagtagcactggtggacttgggtccgccacgtccccgaggaaaggggctgggagtggtattggggaaatctctcctaggtcgggggccaccaactacaatccgtccctcgaaaagtccggaatccaaccataactccctaagacaacctaccaaacgaacctactttacctccctcgtacaaagttgaacttctcgtcgttgaccccggtcggacccggtacgacccggacttaattttaactttatttggtggaccgtaaggaacccttattcctaccgttttccgaaggttacaaccgttaacgtttcctttaaagtttaagtcggtaaccggttagggggttaacttaaccgtacgggtttaacccttggggtaaccctttccggggtagggggaccccggtaaaaaccggggggacccccggggttacctaaccccgggtttcccncccggtttaacccaacccgggtttccaaccccccgtaaagtaacccccgggggacccctaaggttcccccggggttaacccttttccccccccgggttagggaccccgtcccccgg

SEQ ID NO: 289651 - DNA, 698 bp, Homo sapiens
  misc_feature: GYAE6OF02G4B0C.18.81.H04.1.454.CMB.1.raw
  modified_base (385)..(385): a, c, t, g, unknown or other
  misc_feature (385)..(385): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtactttaatgactccatcagtagtagtcacgtggtggacgttgggtcccgccgacgtccccgagggaaacggggcgtggagtggagttgggggaaatctctccgtaggtggggcccaaccaacctacaactcccggtccctacgaagtccgactcacatactcctagacactaccaagaacctattcctccctanactaattcgactctcgtgtacgacccgccgcggaccgaccggtcctaattttacgttagtttgtcgacgtaacgtactactcttacgtcgtactacgtactaggtttacttattagtcggtacggttacgggttacgttaaccggttacggtacgttacggtaccggttcggtcggggtaccgaacccggggtaccccgtaccggtacccgtccgttacccgtcggtacccgtacccgtacccgaacccgtaaccgggtcccctaccggttacccgggtttcccctttccccggacggtccccggtaccccgg

SEQ ID NO: 289652 - DNA, 802 bp, Homo sapiens
  misc_feature: GYAE6OF02HJWUF.18.81.H04.1.454.CMB.1.raw
tcagtacgagtatgcacgaccggtgctcgatttagtagtgtagattcgcggggcgacaagaacatgagacacctgtggttcgttcctcctcctcggtggcagctcccagatgggtctgtctctcgtgcagtgcgtgagtcggccgaggactggtgaagccgttcggggaccatgtcgctcacctgcgctagtcttaatcgtactcatcagtacgtaggtctaacgtggtacggtacgtcgggtcccgaccgtaccgtaccccgaagggaaaggggcctgggaggttggaggttaggggaatccgtctccgtaggtcgggggaccaaccgaactaaccgtaactcccgttacccgtcggtaaacgtccgaccttcaacccgtataacctccgttaacgacctaaccttacccgaaagtaaccctactttcccgttccccgtagtacctaacttaggtaacttccttaacgttcggtaccggtaacccggcccggtacgggaacccacccggggttccctaaagttttacgtttacgttcggtaggccggtacgtaactacgttcttaccgtaccggtagaccgttaactacggtttaacttaagtttacgtacgggtaggttacggggttacctacggttaccgttaacggtcggttaaccgtacgggttcggggaacccggtaaccgggtaccccgggttcgaacccgttccgttaccgtccgaacggtcccctaaccccggaacgtaacccggtaccgtacccgttaacccgggtcctttacccccggacgttcccccggg

SEQ ID NO: 289653 - DNA, 602 bp, Homo sapiens
  misc_feature: GYAE6OF02HW33E.18.81.H04.1.454.CMB.1.raw
  modified_base (533)..(533): a, c, t, g, unknown or other
  misc_feature (533)..(533): n is a, c, g, or t
  modified_base (550)..(550): a, c, t, g, unknown or other
  misc_feature (550)..(550): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgttctttaatgactccatcagtagtagtcactggtggacttgggccgccacgtcccagggaacgggctgggagtggagttggggaaatcgtctcgtaggtcggggccaaccgtaactacaactcccgtaccctacgaagtccgactcaccatactccctagaccaactccaacgaacctatttcctacctgactacttgactctctgtacgacccgcgcggacacggtacttatttattacttgtacgcgacgtactatccgtcttcgatcgacttacgttacttattagtggtacgttgggtactacgtacggtcgtaggcgtgtcgggacacgggtcccgtntacgtcgtcctcgtacncgtcccaccgaccgaccggcctacgttcccggtcccttcccggtgtaccccg

SEQ ID NO: 289654 - DNA, 586 bp, Homo sapiens
  misc_feature: GYAE6OF02GQQZU.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtcttaatgactcatcagtagtagtcactggtggacttggtccgcctagtccccgaggaaagggctggagtgagtgggaatctctctagtcgggccacgaactacactccgtcctacgaagtcgactcaccatactccctagactaactccaacgaactacttactccctgactaatcgatctctgtcgaccgcgcggacacgtctattattatcgtgacgacgactactctcttgatgactagttacttagttagtgtacgtgggtactacgttacgtcgtggtacgtacgtcgggaccgtaccgggacccgtccgtaccgtccgtacgtcgaccgtccgtcccgaaccgaacggcccgtcgtcccgttaccgtacccccgttggacccgtccccg

SEQ ID NO: 289655 - DNA, 758 bp, Homo sapiens
  misc_feature: GYAE6OF02FH87A.18.81.H04.1.454.CMB.1.raw
  modified_base (242)..(242): a, c, t, g, unknown or other
  misc_feature (242)..(242): n is a, c, g, or t
tcagtacgagtatgcacgaccggtgctcgatttagtagtgtagattcgcgggggcacaagaacatgagacacctgtggtttcttcctcctcctggtggcagctcccagatgggtcctgtctctcgtgcagttgcgtgagtcgggccaggactggtgaagccgttcgggaccctgtcgctcacctgcgtctgtactttaatcgactcctatcagttagtatcagtggtggtacgttcgggccncgaccgtacccgaagggaaacgggggctgggaggtcggtagtagggaatcgttctaccgttaggttcgggacctaacgtaacgtacaaccgttcccggtaccctacggtaacgtacgactaccaaccgtactactacccgtaagaacctaaacgtaccaaacgtaaccttactttcctcctagtacctaacgttgtactcttacgtcgtaccggaccgtcgaaccgtaccgaaccggtctttaatttacttcgtttcggtacgtcgtaacgcgttacgtcttacgtacgtatacgtaacttacgtttacttacgttagttagggtacgttacgggttacctacggttccggttacgtacgggttaccgttcgggtaacgggccggtaacccggggtacccggtacccttaccgtccgtttaccgacgttacccgtacccgttcgtaaacccgggtcccgtaacccggttccggttaccccggttacccgtttaccccggttcgggcccctacccgg

SEQ ID NO: 289656 - DNA, 764 bp, Homo sapiens
  misc_feature: GYAE6OF02ILVG6.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccgttcggggaccctgtcgctcacctgcgctgtctttaatcgactccatcagtagtagtcacgttggtaggtacgttcggggtccgcccgtacgtccccgagggaaaggggcctgggacgtgggtagttagggggaaattccgtcgtaccgtaggttcggggccaaccgtaaactaccaaacgttcccgtccctacgtaaacggtccgactaccgacctaatacctccctagaaccacctaccaagaacctactttcctcctcgactaattcgactttctcttagcgaccgcccgacgaccgaccggtaccttagtttttacttagtttacggtacgtacggaaacgtaacgtctttaccttcgtttacgtaacgttcgtaaccgtttcgttttaacttttaattacgttacgggtaacgggtttacggggttaaccgttaacggttaccgggttaccgttcgggtaaccggttccggtacggggtacccgaaaccgggggtacccccgttacgtacccggttctcccgtaccaccggtccctaccgaacccgaacggtccccgtacggttccccgttacccgttcccctacgggtccctcccgg

SEQ ID NO: 289657 - DNA, 626 bp, Homo sapiens
  misc_feature: GYAE6OF02H5BA6.18.81.H04.1.454.CMB.1.raw
  modified_base (192)..(192): a, c, t, g, unknown or other
  misc_feature (192)..(192): n is a, c, g, or t
  modified_base (242)..(242): a, c, t, g, unknown or other
  misc_feature (242)..(242): n is a, c, g, or t
  modified_base (445)..(445): a, c, t, g, unknown or other
  misc_feature (445)..(445): n is a, c, g, or t
  modified_base (476)..(476): a, c, t, g, unknown or other
  misc_feature (476)..(476): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccgttcggggaccctgtcgctcactgcgctgtntttaatgactccatcagtagtacgtcacgtggtaggtacgttcgggtccnccacgtcccgaaggaacgggctggagtggtagttggggaaactcgtctcgtaggtcgggaccacaactacaactccgccgtacgaacgtcactcacactactcctagaaccacttaccaagtacctatttcctacctacgactatgtactctcgtcgtcgaccgcggcggacaccgtcttatttacgtattgacgagacactntctctcgattagacttagttcttagttacgngtacggttggtaactacgtcgtacgtcggtacgtcggtacggaccgaaccggtcccgtctaccgtccttaccgtcaccggtaccctcccggtaaccgaccggtacccgttacggttcccggttccccgttacccggtccggccgttcccg

SEQ ID NO: 289658 - DNA, 625 bp, Homo sapiens
  misc_feature: GYAE6OF02JIJ4C.18.81.H04.1.454.CMB.1.raw
  modified_base (199)..(199): a, c, t, g, unknown or other
  misc_feature (199)..(199): n is a, c, g, or t
  modified_base (439)..(439): a, c, t, g, unknown or other
  misc_feature (439)..(439): n is a, c, g, or t
  modified_base (447)..(447): a, c, t, g, unknown or other
  misc_feature (447)..(447): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcgggggaccctgtcgctcacctgcgctgtctttaangactccatcagtagtagtcactggtggacttgggtccgccagtccccagggaaaggggctggagtggattggggaaatctctccgtaggtggggccaccaactacaatcccggtccctacggaaacgtcgacctcgaaccatactcccgtagacaacctaccgaaagaacctacttttcctccctagtctaattgacttctctgtacgaccgccgacgacgaccgcttatttactattgngcgagacntcttcgtacgagtcgacgtacgtttcttaagtatcgggtacgttagggtactaccggtcgttcgtaggtaccgttcggcgggaccgaacggggtcccgtacgtaccgtccgtacctcgacgtcccaccaccgtaacggacccttgtcccggttcccgttaccccgtggcccgtacccg

SEQ ID NO: 289659 - DNA, 621 bp, Homo sapiens
  misc_feature: GYAE6OF02G0N2N.18.81.H04.1.454.CMB.1.raw
  modified_base (198)..(198): a, c, t, g, unknown or other
  misc_feature (198)..(198): n is a, c, g, or t
  modified_base (401)..(401): a, c, t, g, unknown or other
  misc_feature (401)..(401): n is a, c, g, or t
  modified_base (420)..(420): a, c, t, g, unknown or other
  misc_feature (420)..(420): n is a, c, g, or t
  modified_base (608)..(608): a, c, t, g, unknown or other
  misc_feature (608)..(608): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaangactccatcagtagtagtcactgggtggtacttcggggtccgccgacgtcccccgaagggaaacgggggctgggagtggattagggggaaattctctccgtaggtggggccaccaactacaatcccgtccctacgaagtcgactcaccatactccctagaccaacctccaacgaacctatttcctaccctgctaattgattcncttgtagccgccgcggacncggcctagtttacttatcgtgcgagactattcctcttcgattgaacctagtttcttaattatggacttgggtactaccgtggtctgggtaccgtgtcggggaccgaacgggtccccggtactacccgtcctccgtcgacgtcccttaccgaccgaaccgggccctacggtccggttacccttccccgnggtcccgtccccg

SEQ ID NO: 289660 - DNA, 654 bp, Homo sapiens
  misc_feature: GYAE6OF02GQ282.18.81.H04.1.454.CMB.1.raw
  modified_base (387)..(387): a, c, t, g, unknown or other
  misc_feature (387)..(387): n is a, c, g, or t
tcagtacgagtatgcacgaccggtgctcgatttagtagtgtagattcgcggggggcacaagaacatgagacacctgtggttcttcctcctcctggtggcagctcccagatgggtcctgtctctcgtgcagttgcgtgagtcgggcccaggactggtgaagccgttcggggaccctgtcgctcacctgcgctgtctttaatgactccatcagtagtagtcactggtggacttgggtccaccacgtccccgagggaaaggggctagggagtggagttggggaaatctactctaggtggggcccaccgaactacaactcccgtacccctacggaaacgtcgactccaccatactccctagactaactaccaagaacctattcctccctanactaattgtactcgtctgtcgaccgtcccgcggacaccggtcctattttacttagttgtgtacgaagtctatccttcgttcgatcgaacttagtttacttattagttggtaacggttcgggttaactacgtacggttcgtaggtaccgttcggtcgggaccgtaaacgggtccccgtcgtacccgttccaccgtccgacgtcccgtaccgaaccggtaccggacccacggttcccggtacccgttcccccggtcggtcccgtcccgg

SEQ ID NO: 289661 - DNA, 711 bp, Homo sapiens
  misc_feature: GYAE6OF02I9NW9.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactcatcagtagtatcactggtgacttgggtccgccacgtccccgagggaaagggctggagtggattaggggaatctactccgtaggtcggggacccaccgaactacaactcccgtacccgtacgaaacgtccgactccaccatactacctagaacaactccaaacgaacctactttcctccctagactaattgatctcgtagtcgaccgtcccgacgggactaccgggtacctagtttttaactttacgttgggtaggccgaacgtaccgtaatttccgttaccttaccggtacttacgttaccgttagttttacttaacgtttacggtacggtacggttacgggtttaaccgtaccgtttacgggtacgttacggtaccggtcggtaccggggtacccggtaaaccgggtcccgtaccgtaccgttcctacccggtccgaccgtccctacccgaaccggaaccggtcccttcggtaccccgttccttcccccggtacggtccctccccgg

SEQ ID NO: 289662 - DNA, 804 bp, Homo sapiens
  misc_feature: GYAE6OF02GTRKM.18.81.H04.1.454.CMB.1.raw
  modified_base (350)..(350): a, c, t, g, unknown or other
  misc_feature (350)..(350): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccgttcggggaccctgtcgctcacctgcgctgtctttaatgactccatcagtagtagtcactggtggacttgggtcccgccacgtccccgaagggaaaggggctgggagtggagttaggggaaatctctccgtaggtcgggccaacaactacaacgtccgtacctagaacgtcgactcaccatactcctanacaactaccaagaacctatttcctaccctgactaattcgaactttcctacgttggtacgacccgaccggtaccggaaccgtaccgggtaccttaagtttttactttaagtttcggtacggaccggtaagtaccgtaatttccttacgtttaccgtaagttacggtaacttacgttttactttaagttttaacgttcggggtaaccggtttacgggggttaacctttaaccgggttaccgggttacgttaccggggtaccggtttccgggtaccggggggtaacccgaaacccggggggttcccccggttaaccggtaccccggtttccctacccggttacctaacccggtcccccgttaaccccggaaccccggtaaccggggtaccccctaccgggtttacccccgggttacccccttttcccccccggtacggggtcccccgttacccccgg

SEQ ID NO: 289663 - DNA, 736 bp, Homo sapiens
  misc_feature: GYAE6OF02IWPC7.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccttcggggaccctgtcgctcacctgcgctgttctttaatgactccatcagtagtagtcactggtgacttgggtccgccgtacgtccccgaagggaacgggtcctggtagtggtagttagggaatctctacgtaggtcgggcccaacctaactacaacgttcccgtcctacggaacgtcgacctcaccactactccaacgaccaactaccaaagtacctatttccctccgtagacctaattcgacttcttacgtgtaccgaccggcccgacggtaccgaaccggtccttaacgttttatttacgtttcggtacgaccgtaacggtacccttattccttacgttcgaagttgtaacctttcgtttacgttattaacgggttcggtaaccgttagggtaccctacgtttcgggtacgttcgggtacgttacgtccggggtaacccgaaccggggtacccgttccggaccgttcccgttaccgtcccggaacgtcccccggtaactaaccccgggtaacggacccccttcggttacccgggttaccccccgtttcccgggacggttccccggtacccccg

SEQ ID NO: 289664 - DNA, 848 bp, Homo sapiens
  misc_feature: GYAE6OF02H0PNI.18.81.H04.1.454.CMB.1.raw
  modified_base (201)..(201): a, c, t, g, unknown or other
  misc_feature (201)..(201): n is a, c, g, or t
  modified_base (775)..(775): a, c, t, g, unknown or other
  misc_feature (775)..(775): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgctaggttgcgtgaggtccgggccaggactggtgaagtccgttcgggcctgtcgctcacctgcgtctgttcttaancgtactccatctaaggtagtacgtcacgtgggtacgtacgttcgggcccgaccctacggtacccggaagggtaaggggtctagggaggtagtaggtagggtaactcgtctacgtgggtcggggacccaacctaaccgtaacaccgttcccgtacccgtaacgtaaacggtcccgtaaccgtacccaacctaacttacctaccccgtaacgaaaacccgtaccctaaccgtaaaaccgtaaacccttcctttaacccgttccccacgtaccttaagttagtacttcccttcgttacggtacccgtaccggcccggtaaccgggtaacccgaccggttaacctttaagtttttaagtttacggttcgttaacggccgtacggttaacttccgtttccgtactttcggacttaagtaccggtttacttttagttaacgtttacggtacggttaaccgggtagggttaacccttaccgggttacggttcgggtaacggttaccggtacggggttaacccggggaacccgggttaaccccgggtaaccccgggtcctaccggttccctcggttaacccncccggtacccctaccgacccggaccggtacccgtctttccccgggtacccctccccgtcggtccccgtcccgg

SEQ ID NO: 289665 - DNA, 677 bp, Homo sapiens
  misc_feature: GYAE6OF02F4ZW1.18.81.H04.1.454.CMB.1.raw
  modified_base (199)..(199): a, c, t, g, unknown or other
  misc_feature (199)..(199): n is a, c, g, or t
  modified_base (534)..(534): a, c, t, g, unknown or other
  misc_feature (534)..(534): n is a, c, g, or t
  modified_base (609)..(609): a, c, t, g, unknown or other
  misc_feature (609)..(609): n is a, c, g, or t
  modified_base (616)..(616): a, c, t, g, unknown or other
  misc_feature (616)..(616): n is a, c, g, or t
  modified_base (645)..(645): a, c, t, g, unknown or other
  misc_feature (645)..(645): n is a, c, g, or t
tcagtacgagtatgcacgaccggtgctcgatttagtagtgtagattcgcgggggcacaagaacatgagacacctgtggttcttcctcctcctggtggcagctcccagatggtcctgtctctcgtgcagttgcgtgagtccgggccaggactggtgaagccgttcggggaccctgtcgctcacctgcgctgtctttaagngactccatcgagtagtagtcacgtggtggtacttggggtcccgccaacgttccccgaaggggaaacggggctggggtaggtggtagttagggggaaacttctaccgttaccgttaggttcgggggacccaccgtaaactaacgaacttcccgtcccgtacgaaagtccgactccgacatactcccagaccactacaagaacctactttcgtccctaggactaattcgacttcgtactgtacgaccgcccggtacggacgtaccggacttacttttaacgttacgtttcgtagacgtacgaccgtctttaccgttcttacggaacttcgaacgttnttttacttagttagtcggtacgttcgggttactacgtacggttgtcggagttcggcggacgaccggtcccgtacncgttccncgtcaccgaccgtcccgacgaccggtccncgttaccgcccgtttacccgcggtccgtcccg

SEQ ID NO: 289666 - DNA, 743 bp, Homo sapiens
  misc_feature: GYAE6OF02JQUF3.18.81.H04.1.454.CMB.1.raw
  modified_base (132)..(132): a, c, t, g, unknown or other
  misc_feature (132)..(132): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttncgtgagtcgggcccaggactggtgaagccttcggggacctgtcgctcactgcgctgtcttaatgactcatcagtagtagtcacgtggtggacgttggtccgccacgtccccaagggtaaggggctggagtggagttacggggaaatctcctccgtaaggtcggggtccaaccgaacgtaccaagtcccgtcccgtacgaacgtccgactcaccgatacctaccgtaacgaccaacgtcctaaacgtaccctactttccgtacctacggtactaacgttatactcgttactaggttcgaccggacccgtacggaacccttaccgggaaccctttagtttaacgtttaacgttcggttcgacggtaacgtaacgtaccttcccgttacgttaacccgtagttaaccgttacgttacgtttacttttaacgtttaacgttacgggttacgttacgggttaacttacggtacccggttgtacgtacggttcgtaccgggaccgtaaccgggtacccgtaccgtacccgtcgttcccgtaagtccggtcctacccggaaccgtaacccggtccctaacggtccggttaaccccttccccggtcgtacccgtcccgg

SEQ ID NO: 289667 - DNA, 1024 bp, Homo sapiens
  misc_feature: GYAE6OF02HIBKF.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgacgtcgggcccaggactggtgaagccgttcggggaccctgtcgctcactgcgctgtactttaagcgactccatcgtagtagtacgtctacgttgggtcgtacgttcgggtcccgaccgtaccggtaccccgaaggggaaacggggcgttagggaggtgggtacgttaggggtaaacttccgtccttaccgttagggtccggggaccctaaccgtaaacctaaccgtaaaccgttcccggttaccccgttaacggtaaaccggttccgtaaccgtaccgtaacccgtaacgttaaccgtaccccgttaacgtaaaccctaaacccgttaacccgaaaaaccggttaaaccccttacctttttaaccccgtacccccgtttaggttaaacccgttaaacgtttaaccggtaccttttacccgttaccgtttacgggttaacccgggtaacccccgggtccccggtaccggggaacccgtacccgggttaacccttttaacttttttaacggtttaacgttttacgggttaccggaaccggttaaaccggtaacccttacgttttacccgttacgtttaacccggtacggttaaccgttaaccgttttacgtttttaacccgtttaaggttttacgtccggggtttaaccgggtttacgggttacccgttaaacgggttaccggtttccgggtaccggttacggggttacccgggttacccggggtaacccgggttaaacccggggtccccggttaacccgttaccccgggttccgttaaccccggtaacccggttaccggtccccgttaacccgaacccgggttaacccgcccgttaaccggttcccccggtttacccccggtaccccggttccggtacccggttccccg

SEQ ID NO: 289668 - DNA, 730 bp, Homo sapiens
  misc_feature: GYAE6OF02HTH4X.18.81.H04.1.454.CMB.1.raw
tcagtacgagtatgcacgaccggtgctcgatttagtagtgtagattcgcgggggcacaagaacatgagacacctgtggttcttcctcctcctgtggcagctcccagatgggtcctgtctctcgtgcagttgcgtgagtcgggcccaggactggtgaagccgttcggggaccctgtcgctcacctgcgctgtctttatgactccatcagtagtagtcacgtgggtggtcgttcgggtccgccacgtaccccgagggaaggggctgggaggtggagttgggaaagtctctccgtaggtcggggacccaaccgtaactaacgacttacccgtaccccttacggaaacgtcgtaccgtaccacctaactactccctaacgaacaacctaccgaacgtaacctactttcctaccctcgactaattacgtactctacgtgtacgacccggtaccggaccggaccgaccggtaccttaacgttttatttacgtttcgtacggtcgagtactacgttccttacgttacggtataccgtactttaacgttttactttaagttagtcggttacggttagggttaaccttacgttacggtcgtacgggtaccgttcgacggggtaaccggtaacgggtccccgtaccgtacccggttcctccgttaccgcccgtaccgtacccgacccgaccggtaccctacgttcccggttccccgttacccggtccgggtccctcccgg

SEQ ID NO: 289669 - DNA, 794 bp, Homo sapiens
  misc_feature: GYAE6OF02JUMVD.18.81.H04.1.454.CMB.1.raw
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtagaagccgttccggggacctgtcgctcacctgcgcttgttactttaatgacctcctatcgtaagttagttagtctacgttgggtaggtacgtttcggggtcccgaccgtaccgtacccccggaaggggaaacgggggtcgtaggtaggtgggtaagtttacgggggaaacttccgttccgttaccggttacgggtccgggggacccctaaccgaaccttaacgaaaccgttccccggtacccgtaacggtaaaccggttaccgtaacctaccgtaaccctaactaccgtaccctaacgtaaccctaaccgtaccaaacgtaaccttactttcctaccgtcgacttacgtactactttctcgttcgtaccgtaccgcccggacgaaccgtcggtaccttatttacgttattcgcgacgtataactacttcttacgttagactcgtactttagttcgtttaagttcgtcggtacggttacggttaccgttacgttccggttacggtcgttaacggttcggtaccggtaccggtaacccgggtcccgtacgttacccgtctccgtccgtacgtacccgtaccggaacccgtacgggtaccctacggttccggttacccccgtccggtcccggtaccctccgg

SEQ ID NO: 289670 - DNA, 796 bp, Homo sapiens
  misc_feature: GYAE6OF02JK6H9.18.81.H04.1.454.CMB.1.raw
  modified_base (456)..(456): a, c, t, g, unknown or other
  misc_feature (456)..(456): n is a, c, g, or t
tcagtacgagtatgcacgaccggtgctcgatttagtagtgtagattcgcgggggcacaagaacatgagacacctgtggttcttcctcctcctggtggcagctcccagatgggtcctgtctctcgtgcagttgcgtgagtcgggcccaggactggtgaagccgttcggggaccctgtcgctcacctgcgctgtctttaatgactccatcagtagtagtcacgtggtggacgttgggtcccgccacgtccccgaagggaaagggggcgtggaggtggtagttagggggaactctctcctaggtcggggcccaaccaactaccaactcccgtccccgtacgaacgtcgacctcaccatactccctaacgacaacctcaaagaacctacttcctccctagaccaattcgacttctcttgtcgacccgaccgccggaccgaccgtccgtaattttactttnttcggttacggacgtaacggacttattccttaccgttacgacgttacgtaactttaacgtttcctttaaagtttcgtacgggtaccggttacggggttaaacctttaccggtttaaccgggtttggttaccgggtaaccgggtttccggggttacgggggtaaaccccgggtaaaccggggggtaccccccgggttacccgttaacccgggttcccttacccgtccggtaaccggttaccccgtaacccccgaaacccggggtaacccgggttccccttaaccgggttcccggttttacccccggtttacccccggtcccgggttacccggtccccccgg

SEQ ID NO: 289671 - DNA, 549 bp, Homo sapiens
  misc_feature: GYAE6OF01C0J6F.19.16.B05.1.454.CMB.1.raw
tcagtactctcgtgcacgaccggtgctcgatttagagctcacgtagttgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaaggccctcggtacttgatgaaggttaacagtgatggcagccaacgacgaagggggacggactccgtgagttcgttttcgagggtccagctcgtgggctggagcgctaccgtcacctatcctccacgccctacacgtctagacggatgaggctagacttattacgtgtacagtaccgtggggtctacgttggttatggtttgggtttcggacgggacgggtaaccgaaggtcgttcggacccggttcgtacgggtaccacgaccccgaaggccgtccgtcccccgg

SEQ ID NO: 289672 - DNA, 856 bp, Homo sapiens
  misc_feature: GYAE6OF01BT813.19.16.B05.1.454.CMB.1.raw
  modified_base (203)..(203): a, c, t, g, unknown or other
  misc_feature (203)..(203): n is a, c, g, or t
tcagtactctcgtgcacgaccggtgctcgatttagagctcacgtatttgggtttggggagagctcgtgggggagtctgcaccagtggcttcggaccccactcctcttcctcaccctcctcctccactgcacgacgggtcctctcctacccagcgttgtcgctgactcaactccgtccctctcgcctctcgcctccgtgggacnccgtacggtacagtcctctactcgtcgcctacgttcgaggacgtcgagggtccggactaccgacgaaccgtaaccgtacgaccgtacgtccgacgtacggttcggacctactaccggacgcgacgaccggacgaccggaaggaaccgggtacccggtacggtacggttaacgtaggtaacggttaacggtaaacggttaacgacggtacgacggtacgacgaccgaccgaacgggaccggggaacggggcctacgtaccgttacgtacgtttacgtcgggtacgtccgtagtccggttcggtacggtcgtacggaccggtacctacccgtccgtaaccctaaccgtccgttaccgtaccccgtacgtaccgtaccgggtcgttaccggacgggtaaggaccgggttcggaacccgttacggttacttaaccggtttaacggttccttaacgggtaccggtaaccgggtacgggtttccgggtacggtttaacggttttcggggttacgggtttcgggttacccggggtttaaacgggtaccgggttaaaccgggtaacccgtacggttacgggtccccggtttaacccgtccggggtaaccgtaccgggtaacccgtaacccgggtcggttccccgggtcccgttaacccggg

SEQ ID NO: 289673 - DNA, 663 bp, Homo sapiens
  misc_feature: GYAE6OF02IQH8B.19.16.B05.1.454.CMB.1.raw
tcagtactctcgtgcacgaccggtgctcgatttagagctcacgtagttgggtttggggagagcctctcggggaggtcttgcgacctatggtcttggaccccactcctcttcctcaccctcctcctaccactgcacgagggttctctctcccagcttgttgctgacttctaaatcgccctctgcctctgcctcctgggagcctcggtcgaagctcatctgcacgtctgagcagtggcacagccaactcgcctatcgtcatggcatcagcagcagccagagaacgggccctcgggtacgttgagtaggaaggttaacaggtgaagttgggcagtccgaacaccggaaagggggacggatcccgtagtacttcggtttttacgacgggtccaaggtcgtcgtggggcctaggacgtccgacgtaccctacgtaacctactacctacccgaacgcccttaccgtagttccgtaggaacggtaacgttcggaacgtcctagaaccttaagttacgtacggttaccgaacggtacccgtagggtacctacggtttaggttacgtgggtttacgggtttacgggacgggtacgggtaaccgtaacgtcggtacgtacccggttacggtacggtccgaccggtacccgaacggtccgtccgtaccccccgg

SEQ ID NO: 289674 - DNA, 727 bp, Homo sapiens
  misc_feature: GYAE6OF02HEEDA.19.16.B05.1.454.CMB.1.raw
tcagtactctcgtgcacgaccggtgctcgatttagagctcacgtagtggttgggagagctctagggacgtctggtctacccactcggcgttgggaccccactccctccttcctcacccgtccctcctcccacgtgcacgagggtctcgtctcccgacgcgttgtggctagaccttcgaatcccgaccccctctcgcctctcgtccctcccgtgggtagcctacggtccaagtcctacgactctcgacctacgtctgaggctacgggtcggccacccgacgggccaaacggtaccgccgaagttccggactaggtcggctactcgacgccagcaacgcgagacgaacggtccccgtacggtacgtgacgtacggaacggttacacgtagtatcggacacgaccaccgaaccgaaaggggtaccggaacgttccgtacgtagttaccggttttacgacgggtcctacgtccgtcggtcgggacctcggacggtccgtaccggtacctacgaaccttacgtccgtaccgacggtccggaccgggtaccggtacgtacggaaggtcgtcggtacgtacgtacgtacttacggtaccgtacggtaccgtacgtaccgtcgggtacctccggtcgttacgtcggttacggttaccggacggaccggtactaggtccctaccggtaccgtccgtaccgtccgacccgtaccgaacggtcctaccccgtaccccg

SEQ ID NO: 289675 - DNA, 677 bp, Homo sapiens
  misc_feature: GYAE6OF01B8ZLW.35.66.F11.1.454.CMB.1.raw
tcagtacagatcgtcacgaccggtgctcgatttagtcacgcgagaaagggtaagggggtagggaacgtagctcagttaggtacccgacgacggaaccgaactggaaggacccacgcgcagcttccttcttccttcctcgtctacttctggctcccacgatactccacgtaggaataagtgtgatgacgcacgtctccaacctctcttgtctagtggtctcgagggaccacgacgcccacctcgtccgtcgcgacgggcctagttacgaagtagttcgttacgcgaacgaccgtaaacgttacgccgtacggtaaccacgtacgaaggtaaacgtttccgaccaggtcctaccgaggtccttccgtactaacgttccgtttggtcgtacgtccgaccgttacgggcctcgttcggcgtcccgaggtcgtacggttcgaggtcgactacggttcgaccttcgtacggaactggtaccgttacacgttcctacaccgtatcgagtcgtacgtcgttcgacgtagtctagtacgttacgttcgtactacgtttacgtcgtacgtacgtacgtaccgtaagtaacggtagtacgtgtaccggtactacggtgtacgtcttacggttcgacgtacggtctacgtgtacgacgtacgtacaacggtactcggtatctcgtaacg

SEQ ID NO: 289676 - DNA, 822 bp, Homo sapiens
  misc_feature: GYAE6OF02HLB3S.35.66.F11.1.454.CMB.1.raw
  modified_base (151)..(151): a, c, t, g, unknown or other
  misc_feature (151)..(151): n is a, c, g, or t
  modified_base (520)..(520): a, c, t, g, unknown or other
  misc_feature (520)..(520): n is a, c, g, or t
tcagtacagatcgtcacgaccggtgctcgatttagtcacgcgagaaaagggaaagggggaggaactgctcagttaggacccaggacggaaccatggaagccccagcgcagcttctcttcctcctgctactctgctccagactacactgganaaatagtgatgacgcagtctccacgcctacctgtctgtcgtacgcggaaggggtaacagcctacgtcctcttccgagcgacgggtccaagtcgaagtagttacgttacggaaactacggtacgtcgtaacggtaccaaggtacgaaagtaaaccctgggacccgtaagccccttacccggaacggtcctaccctcgtaacttacgtttaaggcggttcaaccgtcgtacccgaaccgtacggtccctaacggttacgtaaccgtcccgaaccggtaaccgttggtaccgaaggttccggaaacggtcgttacggggtcgttacgggaacttacggtacctcgaacttccgaccttaactacgcgtaacnccgtgccgtagcctagtacgtaagaattacgtatacgtaacgttactaactacgttaactaccgttaagtacgttaacgtttaaacgtttacgttaaccgtacccggttaccggtaacccggtcccgttttaaccggtccggttttaacccggggtcccgggtaaacccggggtacggttaaaccggggttaaggggtaaaccctcggggtttaaaaacgttaaaaccggaaacgttttacggggacccgtttaagggaacccccggttataaacccccggttaagttacccggtttaccgg

SEQ ID NO: 289677 - DNA, 155 bp, Homo sapiens
  misc_feature: GYAE6OF01A2MZ8.51.22.B11.1.454.CMB.1.raw
  modified_base (152)..(155): a, c, t, g, unknown or other
  misc_feature (152)..(155): n is a, c, g, or t
tcagcgatcgtatacacgaccggtgctcgatttagacgacagctcagggcacgaccggtgctcgatttagagtgctacgaagggaagggcagcgtcactctgttcccaccctcctctcgtagcactctgagcgggctggcaaggcgcatagnnnn

SEQ ID NO: 289678 - DNA, 172 bp, Homo sapiens
  misc_feature: GYAE6OF01EVKXK.51.22.B11.1.454.CMB.1.raw
  modified_base (154)..(172): a, c, t, g, unknown or other
  misc_feature (154)..(172): n is a, c, g, or t
tcagcgatcgtatacacgaccggtgctcgatttagacgacagctcaggggcacgaccggtgctcgatttagagtgctacgaagggaaaggcagcgtcgactctgttcccacctcctctccgtagcactctgagcgggctggcaaggcgcatagnnnnnnnnnnnnnnnnnnn

SEQ ID NO: 289679 - DNA, 155 bp, Homo sapiens
  misc_feature: GYAE6OF01BL9F3.51.22.B11.1.454.CMB.1.raw
  modified_base (152)..(155): a, c, t, g, unknown or other
  misc_feature (152)..(155): n is a, c, g, or t
tcagcgatcgtatacacgaccggtgctcgatttagacgacagctcagggcacgaccggtgctcgatttagagtgctacgaagggaaaggcagcgtcactctgttcccgccctcctctcgtagcactctgagcgggctggcaaggcgcatagnnnn

SEQ ID NO: 289680 - DNA, 154 bp, Homo sapiens
  misc_feature: GYAE6OF01BBUFS.51.22.B11.1.454.CMB.1.raw
  modified_base (153)..(154): a, c, t, g, unknown or other
  misc_feature (153)..(154): n is a, c, g, or t
tcagcgatcgtatacacgaccggtgctcgatttagacgacagctcagggcacgaccggtgctcgatttagagtgctacgaagggaaagggcagcgtcactctgttcccaccctcctctcgtagcactctgagcgggctggcaaggcgcatagnn

SEQ ID NO: 289681 - DNA, 128 bp, Homo sapiens
  misc_feature: GYAE6OF01BMPN0.51.22.B11.1.454.CMB.1.raw
  modified_base (128)..(128): a, c, t, g, unknown or other
  misc_feature (128)..(128): n is a, c, g, or t
tcagcgatcgtatacacgaccggtgctcgatttagacgacagctcagggcacgaccggtgctcgatttagagcgactagcaacacacaaagggccctatcccctgagcgggctggcaaggcgcatagn

SEQ ID NO: 289682 - DNA, 154 bp, Homo sapiens
  misc_feature: GYAE6OF01EX5Q0.51.22.B11.1.454.CMB.1.raw
  modified_base (153)..(154): a, c, t, g, unknown or other
  misc_feature (153)..(154): n is a, c, g, or t
tcagcgatcgtatacacgaccggtgctcgatttagacgacagctcagggcacgaccggtgctcgatttagagtgctacgaagggaaagggcagcgtcactctgttcccgccctcctctcgtagcactctgagcgggctggcaaggcgcatagnn

SEQ ID NO: 289683 - DNA, 152 bp, Homo sapiens
  misc_feature: GYAE6OF01DU0EJ.51.22.B11.1.454.CMB.1.raw
  modified_base (152)..(152): a, c, t, g, unknown or other
  misc_feature (152)..(152): n is a, c, g, or t
tcagcgatcgtatacacgaccggtgctcgatttagacgacagctcaggtcacgaccggtgctcgatttagagtgctacgaagggaagggcagcgtcactctgttcccgccctcctctcgtagcactctgagcgggctggcaaggcgcatagn

SEQ ID NO: 289684 - DNA, 193 bp, Homo sapiens
  misc_feature: GYAE6OF01BAZMU.51.22.B11.1.454.CMB.1.raw
  modified_base (187)..(193): a, c, t, g, unknown or other
  misc_feature (187)..(193): n is a, c, g, or t
tcagcgatcgtatacacgaccggtgctcgatttagacgacagctcagggcacgaccggtgctcgatttagacgacagctcagggcacgaccggtgctcgatttagagtgctacgaagggaaaggcagcgtcactctgttcccgccctcctctcgtagcactctgagcgggctggcaaggcgcatagnnnnnnn

SEQ ID NO: 289685 - DNA, 156 bp, Homo sapiens
  misc_feature: GYAE6OF02GG7C3.51.22.B11.1.454.CMB.1.raw
  modified_base (153)..(156): a, c, t, g, unknown or other
  misc_feature (153)..(156): n is a, c, g, or t
tcagcgatcgtatacacgaccggtgctcgatttagacgacagctcagggcacgaccggtgctcgatttagagtgctacgaagggaaagggcagcgtcactctgttcccaccctcctctcgtagcactctgagcgggctggcaaggcgcatagnnnn

SEQ ID NO: 289686 - DNA, 153 bp, Homo sapiens
  misc_feature: GYAE6OF02JDO35.51.22.B11.1.454.CMB.1.raw
  modified_base (153)..(153): a, c, t, g, unknown or other
  misc_feature (153)..(153): n is a, c, g, or t
tcagcgatcgtatacacgaccggtgctcgatttagacgacagctcagggcacgaccggtgctcgatttagagtgctacgaagggaaagggcagcgtcactctgttcccaccctcctctcgtagcactctgagcgggctggcaaggcgcatagn

SEQ ID NO: 289687 - DNA, 156 bp, Homo sapiens
  misc_feature: GYAE6OF02GH6U1.51.22.B11.1.454.CMB.1.raw
  modified_base (151)..(156): a, c, t, g, unknown or other
  misc_feature (151)..(156): n is a, c, g, or t
tcagcgatcgtatacacgaccggtgctcgatttagacgacagctcagggcacgaccggtgctcgatttagagtgctacgaagggaagggcagcgtcactctgttcccgcctcctctcgtagcactctgagcgggctggcaaggcgcatagnnnnnn

SEQ ID NO: 289688 - DNA, 153 bp, Homo sapiens; identical to SEQ ID NO: 289686
  misc_feature: GYAE6OF02IHH7X.51.22.B11.1.454.CMB.1.raw
  modified_base (153)..(153): a, c, t, g, unknown or other
  misc_feature (153)..(153): n is a, c, g, or t

SEQ ID NO: 289689 - DNA, 156 bp, Homo sapiens
  misc_feature: GYAE6OF02HV7EE.51.22.B11.1.454.CMB.1.raw
  modified_base (153)..(156): a, c, t, g, unknown or other
  misc_feature (153)..(156): n is a, c, g, or t
tcagcgatcgtatacacgaccggtgctcgatttagacgacagctcagggcacgaccggtgctcgatttagagtgctacgaagggaaagggcagcgtcactctgttcccgccctcctctcgtagcactctgagcgggctggcaaggcgcatagnnnn

SEQ ID NO: 289690 - DNA, 167 bp, Homo sapiens
  misc_feature: GYAE6OF02HGPMA.51.22.B11.1.454.CMB.1.raw
  modified_base (155)..(167): a, c, t, g, unknown or other
  misc_feature (155)..(167): n is a, c, g, or t
tcagcgatcgtatacacgaccggtgctcgatttagacgacagctcagggcgacggaccggtgctcgatttagagtgctacgaagggaaagggcagcgtcactctgttcccgccctcctctcgtagcactctgagcgggctggcaaggcgcatagnnnnnnnnnnnnn

SEQ ID NO: 289691 - DNA, 153 bp, Homo sapiens
  misc_feature: GYAE6OF02H1Y4W.51.22.B11.1.454.CMB.1.raw
  modified_base (153)..(153): a, c, t, g, unknown or other
  misc_feature (153)..(153): n is a, c, g, or t
tcagcgatcgtatacacgaccggtgctcgatttagacgacagctcagggcacgaccggtgctcgatttagagtgctacgaagggaaagggcagcgtcactctgttcccgccctcctctcgtagcactctgagcgggctggcaaggcgcatagn

SEQ ID NO: 289692 - DNA, 230 bp, Homo sapiens
  misc_feature: GYAE6OF02FO2CB.51.22.B11.1.454.CMB.1.raw
  modified_base (227)..(230): a, c, t, g, unknown or other
  misc_feature (227)..(230): n is a, c, g, or t
tcagcgatcgtatacacgaccggtgctcgatttagacgacagctcagggcacgaccggtgctcgatttagacagtatatatccgcgggcacgaccggtgctcgatttagctctacgctcagggcacgaccggtgctcgatttagagtgctacgaagggaaagggcagcgtcactctgttcccgccctcctctcgtagcactctgagcgggctggcaaggcgcatagnnnn

SEQ ID NO: 289693 - DNA, 245 bp, Homo sapiens
  misc_feature: GYAE6OF01DZEL2.45.38.D05.1.454.CMB.1.raw
  modified_base (244)..(245): a, c, t, g, unknown or other
  misc_feature (244)..(245): n is a, c, g, or t
tcagacgcgatcgacacgaccggtgctcgatttagtatctgatagttgggtttggggtgtggtggtctccactcccgccttgacgaggctgattatttctgttgctcatatgcagggaccagcacttgggtgttcggcggagggaccaggttgaccgtcctaggtcagcccaaggctgcccctcggtcactctgttcccgccctcctctcgatcgcgtctgagcgggctggcaaggcgcatagnn

SEQ ID NO: 289694 - DNA, 171 bp, Homo sapiens
  misc_feature: GYAE6OF01EJR9J.45.38.D05.1.454.CMB.1.raw
  modified_base (171)..(171): a, c, t, g, unknown or other
  misc_feature (171)..(171): n is a, c, g, or t
tcagacgcgatcgacacgaccggtgctcgatttagtatctgatagttgggtttggggaagaggaagactgacggtccccaggagttcaggtgctgggcacagcggccctgggctgcctggtcaaggactacttcctcgatcgcgtctgagcgggctggcaaggcgcatagn

SEQ ID NO: 289695 - DNA, 239 bp, Homo sapiens
  misc_feature: GYAE6OF01AT30B.45.38.D05.1.454.CMB.1.raw
  modified_base (238)..(239): a, c, t, g, unknown or other
  misc_feature (238)..(239): n is a, c, g, or t
tcagacgcgatcgacacgaccggtgctcgatttagtatctgatagttggttgggtgtggtggtctccactccgccttgacgaggctgattattctgttgctcatatgcagggaccagcacttgggtgttcggcggagggaccaggttgaccgtcctaggtcagcccaaggctgcccctcggtcactctgttcccacctcctctcgatcgcgtctgagcgggctggcaaggcgcatagnn

SEQ ID NO: 289696 - DNA, 172 bp, Homo sapiens
  misc_feature: GYAE6OF01CM9F9.45.38.D05.1.454.CMB.1.raw
  modified_base (170)..(172): a, c, t, g, unknown or other
  misc_feature (170)..(172): n is a, c, g, or t
tcagacgcgatcgacacgaccggtgctcgatttagtatctgatagttgggtttgggaagaggaagactgacggtccccaggagttcaggtgctgggcacagcggccctgggctgcctggtcaaggactacttcctcgatcgcgtctgagcgggctggcaaggcgcatagnnn

SEQ ID NO: 289697 - DNA, 244 bp, Homo sapiens
  misc_feature: GYAE6OF01EN5OV.45.38.D05.1.454.CMB.1.raw
  modified_base (242)..(244): a, c, t, g, unknown or other
  misc_feature (242)..(244): n is a, c, g, or t
tcagacgcgatcgacacgaccggtgctcgatttagtatctgatagttgggttggggtgtggtggtctccactcccgccttgacgaggctgattatttctgttgctcatatgcagggaccagcacttgggtgttcggcggagggaccaggttgaccgtcctaggtcagcccaaggctgcccctcggtcactctgttccaccctcctctcgatcgcgtctgagcgggctggcaaggcgcatagnnn

SEQ ID NO: 289698 - DNA, 173 bp, Homo sapiens
  misc_feature: GYAE6OF01D0KDS.45.38.D05.1.454.CMB.1.raw
  modified_base (172)..(173): a, c, t, g, unknown or other
  misc_feature (172)..(173): n is a, c, g, or t
tcagacgcgatcgacacgaccggtgctcgatttagtatctgatagttgggtttgggggaagaggaagactgacggtcccccaggagttcaggtgctgggcacagcggccctgggctgcctggtcaaggatacttcctcgatcgcgtctgagcgggctggcaaggcgcatagnn

SEQ ID NO: 289699 - DNA, 173 bp, Homo sapiens
  misc_feature: GYAE6OF01CI6VC.45.38.D05.1.454.CMB.1.raw
  modified_base (173)..(173): a, c, t, g, unknown or other
  misc_feature (173)..(173): n is a, c, g, or t
tcagacgcgatcgacacgaccggtgctcgatttagtatctgatagttgggtttgggggaagaggaagactgacggtcccccaggagttcaggtgctgggcacagcggccctgggctgcctggtcaaggactacttcctcgatcgcgtctgagcgggctggcaaggcgcatagn

SEQ ID NO: 289700 - DNA, 530 bp, Homo sapiens
  misc_feature: GYAE6OF01D8QMI.45.38.D05.1.454.CMB.1.raw
  modified_base (526)..(526): a, c, t, g, unknown or other
  misc_feature (526)..(526): n is a, c, g, or t
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagttttgtctcctggtaccaacaacaccccggcgaagcccccaaactaatcatttatagggacactaagcggccctcgggggtttcaagtcgcttctctggctccaagtctggcaacacggcctccctgacaatctctgggctccaggctcaggacgaggctgattatttctgttgctcatatgcagggaccagcaacttgggtgttcgggcggagggaccaggttgaccgtcctaggtcagcccaaggcctgccccctggtcactctgttcccaccctcnctcg

SEQ ID NO: 289701 - DNA, 251 bp, Homo sapiens
  misc_feature: GYAE6OF01C2M4N.45.38.D05.1.454.CMB.1.raw
  modified_base (245)..(251): a, c, t, g, unknown or other
  misc_feature (245)..(251): n is a, c, g, or t
tcagacgcgatcgacacgaccggtgctcgatttagtatctgatagttgggtttgggggtgtggtggtctccactcccgccttgacgaggctgattatttctgttgctcatatgcagggaccagcacttgggtgttcggcggagggaccaggttgaccgtcctaggtcagcccaaggctgcccctcggtcactctgttcccgccctcctctcgatcgcgtctgagcgggctggcaaggcgcatagnnnnnnn

SEQ ID NO: 289702 - DNA, 579 bp, Homo sapiens
  misc_feature: GYAE6OF01AF0XT.45.38.D05.1.454.CMB.1.raw
  modified_base (229)..(229): a, c, t, g, unknown or other
  misc_feature (229)..(229): n is a, c, g, or t
  modified_base (367)..(367): a, c, t, g, unknown or other
  misc_feature (367)..(367): n is a, c, g, or t
tcagacgcgatcgacacgaccggtgctcgatttagtatctgatagttgggtttggggggggtcacaagaggcagccgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttgggagttataaccttgtctcctggtaccacagcaccaggcaaacgcccccaaatcatgatttagtgaggcagtaacgcggccctcgtagggtttcaatcgcttctcgtggctccaagtctggacacnccggcctcctgacatctcgtcggctcgaggctggacggcgaggctgtattactactgctgctctatatgacgtaggttagttacgttacgtttggtcggttcgggacgggtacgggacctaacggtccgttacggtacccggttccgtaacgggtacccgaaccggtaccccggtaaacgggtccctcccgggtccccccgtgggttacccc

SEQ ID NO: 289703 - DNA, 246 bp, Homo sapiens
  misc_feature: GYAE6OF01ATLDT.45.38.D05.1.454.CMB.1.raw
  modified_base (246)..(246): a, c, t, g, unknown or other
  misc_feature (246)..(246): n is a, c, g, or t
tcagacgcgatcgacacgaccggtgctcgatttagtatctgatagttgggtttgggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccaccctcctctcgatcgcgtctgagcgggctggcaaggcgcatagn

SEQ ID NO: 289704 - DNA, 540 bp, Homo sapiens
  misc_feature: GYAE6OF01BUDF1.45.38.D05.1.454.CMB.1.raw
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagttttgtctcctggtaccaacaacacccggcgaagcccccaaactaatcatttatagggacactaagcggccctcgggggtttcaagtcgcttctctggctccaagtctggcaacacggcctccctgacaatctctgggctccaggctcaggacgaggctgattatttctgttgctcatatgcagggaccagcacgttgggtgttcgggcggagggaccaggttgaccgtcctaggtcgagcccgaaggcctgcccccgtcggtccactctcgttccccgccctcctccgtcg

SEQ ID NO: 289705 - DNA, 278 bp, Homo sapiens
  misc_feature: GYAE6OF01E0ZZ7.45.38.D05.1.454.CMB.1.raw
  modified_base (247)..(252): a, c, t, g, unknown or other
  misc_feature (247)..(252): n is a, c, g, or t
  modified_base (254)..(278): a, c, t, g, unknown or other
  misc_feature (254)..(278): n is a, c, g, or t
tcagacgcgatcgacacgaccggtgctcgatttagtatctgatagttgggtttgggggtgtggtggtctccactcccgccttgacgaggctgattatttcctgttgctcatagtgcagggaccagcacttgggtgttcggcggagggaccaggttgaccgtcctaggtcagcccaaggctgccccctggtcactctgttcccacctcctctcgatcgcgtctgagcgggctggcaagggcgcatagnnnnnncnnnnnnnnnnnnnnnnnnnnnnnnn

SEQ ID NO: 289706 - DNA, 174 bp, Homo sapiens
  misc_feature: GYAE6OF01E0XH0.45.38.D05.1.454.CMB.1.raw
  modified_base (173)..(174): a, c, t, g, unknown or other
  misc_feature (173)..(174): n is a, c, g, or t
tcagacgcgatcgacacgaccggtgctcgatttagtatctgatagttgggtttgggggaagaggaagactgacggtcccccaggagttcaggtgctgggcacagcggccctgggctgcctggtcaaggactacttcctcgatcgcgtctgagcgggctggcaaggcgcatagnn

SEQ ID NO: 289707 - DNA, 543 bp, Homo sapiens
  misc_feature: GYAE6OF01AB15H.45.38.D05.1.454.CMB.1.raw
  modified_base (211)..(211): a, c, t, g, unknown or other
  misc_feature (211)..(211): n is a, c, g, or t
  modified_base (388)..(388): a, c, t, g, unknown or other
  misc_feature (388)..(388): n is a, c, g, or t
  modified_base (431)..(431): a, c, t, g, unknown or other
  misc_feature (431)..(431): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctnacttgcagtgtctctggtgactccatcagtagtagtcataaattttggggctgggtccgccagccccagggaaggggctggagtggattgggactgtctactctagtgggaccacctattacagcccgtccctcaagactcgactggtgatctcaataacacgtcaagaccaattcnccctgagctgaactctagtgaccgccgcggacacggccaaatnttaactgtagcaagagagggtcctgggaattatcctttgaccacgtggggccttgggaaccctgggtccaccggtctcctcagccctccaccaagggccccagtccggtccc

SEQ ID NO: 289708 - DNA, 561 bp, Homo sapiens
  misc_feature: GYAE6OF01DBOFY.45.38.D05.1.454.CMB.1.raw
  modified_base (228)..(228): a, c, t, g, unknown or other
  misc_feature (228)..(228): n is a, c, g, or t
  modified_base (436)..(436): a, c, t, g, unknown or other
  misc_feature (436)..(436): n is a, c, g, or t
  modified_base (445)..(445): a, c, t, g, unknown or other
  misc_feature (445)..(445): n is a, c, g, or t
tcagacgcgatcgacacgaccggtgctcgatttagtatctgatagttgggtttgagggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtnactccatcagtagtagtcataaagttttggggctgggtccgcagccccgaggggaagggctggagtggattgggactgtctactctagtgggaccactattacagcccgtcctcaagactcgactggtgatctacaaataaacacgtaccaaagaaccaattctccctagagctagaactctgtcgaccgcgcggacacggacaaatntactgcganaagagagggcctaggaattactcctttagaccctacgtcgggcctagggaccctggtaccaccgtctccgtcacgtccctaccgaaccgacgggcccagttccggtccttcccccg

SEQ ID NO: 289709 - DNA, 250 bp, Homo sapiens
  misc_feature: GYAE6OF01CWW4D.45.38.D05.1.454.CMB.1.raw
  modified_base (246)..(250): a, c, t, g, unknown or other
  misc_feature (246)..(250): n is a, c, g, or t
tcagacgcgatcgacacgaccggtgctcgatttagtatctgatagttgggtttgggggtgtggtggtctccactcccgccttgacgaggctgattatttctgttgctcatatgcagggaccagcacttgggtgttcggcggagggaccaggttgaccgtcctaggtcagcccaaggctgccccctcggtcactctgttcccaccctcctctcgatcgcgtctgagcgggctggcaaggcgcatagnnnnn

SEQ ID NO: 289710 - DNA, 582 bp, Homo sapiens
  misc_feature: GYAE6OF01EYAM1.45.38.D05.1.454.CMB.1.raw
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagtttgtctcctggtaccaacaacaccccggcgaagcccccaaactaatcatttatagggacactaagcggccctcgggggtttcaagtcgcttctctggctccaagtctggcaacacggcctccctgaccaatctctgggctccaggctcgaggacgaggctgatttatttctgttgctcatatgcagggaccagctagttggggtgttcgggcgggacgggaccgtagggttcgaccggttccgtacggttcaacggtcccgaacgggtccttccggcccccccgtcgggtccacccgttccgttccgttcccccaccccttccctccgtcccg

SEQ ID NO: 289711 - DNA, 575 bp, Homo sapiens
  misc_feature: GYAE6OF01C72WU.45.38.D05.1.454.CMB.1.raw
  modified_base (304)..(304): a, c, t, g, unknown or other
  misc_feature (304)..(304): n is a, c, g, or t
  modified_base (361)..(361): a, c, t, g, unknown or other
  misc_feature (361)..(361): n is a, c, g, or t
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggtagtttttagtttgtctctggtaccaacaacaccccggcgaacgccccaaactatctatttanaggacactaagcgtccgtcggggtttcaagtcgcttctctggctcagtctggcaacncggcctcctgacaatctcgtggctccgaggctcgaggacgaggctgtatttatttctgttgcttcatatgacgtaggttagtagttacgtttggtgttcggcgggaggtaccaaggtcgtacggacccgttcgtaggtccagacccgaaggtcctaccggccccccgtcgggtcctaccgttccttccgttcccccgccccttccgtccgtccg

SEQ ID NO: 289712 - DNA, 558 bp, Homo sapiens
  misc_feature: GYAE6OF01EP0Q7.45.38.D05.1.454.CMB.1.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagttttgtctcctggtaccaacaacaccccggcgaagcccccaaactaatcatttatagggacactaagcggccctcgggggtttcaagtcgcttctctggctccaagtctggcaacacggcctccctgacaatctctggctccaggctcaggacgaggctgattatttctgttgctcatatgcagggaccagcacgttgggtgttcgggcggagggaccagggttcgaccggtctaggtccaggcccgaaggcctcggccccccgtcggtccaccgtcctcgttacccccgcccttccgtccttcccgg

SEQ ID NO: 289713 - DNA, 593 bp, Homo sapiens
  misc_feature: GYAE6OF01DC64Q.45.38.D05.1.454.CMB.1.raw
tcagacgcgatcgacacgaccggtgctcgatttagtatctgatagttggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagtttttagttttgtctcctggtaccaacaacaccccggcgaagcccccaaactaatcatttataggacactaagcggccctcggggtttcaagtcgcttctctggcctcagtctggacaacacggcctccctgaacaactcctcgtcgggcctccgacggtcctacgacggacggaggtcctagtatttatttctgttgtctctatagtgcgaggaccagctacgttgggttcggttcgggcgggacgggaccgtagggttcgaccggtccgtacggtcgacgacccgaaggtcctccggtcccccgtcgtcctaccttccgtccgttccccgcccttcccgtccgtaccg

SEQ ID NO: 289714 - DNA, 566 bp, Homo sapiens
  misc_feature: GYAE6OF01EPDMW.45.38.D05.1.454.CMB.1.raw
  modified_base (357)..(357): a, c, t, g, unknown or other
  misc_feature (357)..(357): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcattaaattttgggctgggtccgccagcccccagggaaggggctggagtggattgggactgtctactctagtgggaccactattacagcccgtcctcaagactcgactggtnatctacaataaacacgtaccaaagaacctaattctccctagacggctgaactctgtcgaccgccgcggacaccggaccaaatacttactgtgacaagagaggcctaggaacttatcctttagaccctacgtcggggcctagggaacccttggtcctacccgtctcctcacgccctccaccgtaacggcccagtcccgtctcccccgtcg

SEQ ID NO: 289715 - DNA, 588 bp, Homo sapiens
  misc_feature: GYAE6OF01BNAWV.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaattttggggctgggtccgccagcccccgagggaaggggctggagtggattgggactgtctactctagtgggaccacctattacagcccgtccctcaagactcgactggtgatctacaaataaacacgtaccaaagaaccaattcctcctgagctgaactctgtcgaccgccgcggacacggaccaaatattactgtgcaagagagggcctaggtaattacgtcctttgacctacggtcggggccctcggggaacccctggtaccctacccgtccttccctccgacgcccctacccgaacccgtaacgggccccaagtcccggtcccttcccccgtcgg

SEQ ID NO: 289716 - DNA, 725 bp, Homo sapiens
  misc_feature: GYAE6OF01B1Y30.45.38.D05.1.454.CMB.1.raw
tcagacgcgatcgacacgaccggtgctcgatttagtatctgatagttggggtttgggggctttcctgagacgtcgacggtaccctcctgtgtcaggaactatgaagcacctggtggttcctcctcctgctggtggcggctccggatggcgtcctggtcccagctgtcgtacctgtcaggtagttacgggcccaggactggtgaaggtccttcggagaccctggtcccgtcggacttgctagtgtcctcggtggtcgactccatcagttagtagtctattaagttttggggactgggtccgtccacgtccccctagggaaggggctgggagtggtagttcgggaacctagtcctacgtacgtaggtgggacctacgtacttacgacgtcccctcctacaacgtactcgtcgtgtagtagtactactaataacgtacgtaccaacgtaaccgaagttcctcctagacgtctagtaacctcgtaggtacgacccgaccggacggaacgaccggtacctaaattacttacgtgtagaactaaggaacgagggtcctagggtaacgtttagttacccgtttacggaaccgttaccgtggggtacccgttacgggttaaacccctgggttaccctaccggttccgttcccgtaccgtaccggtccccttacccgaacccggtacgggtacccctaacggttcccgggtcccgttaccccccggtacccggg

SEQ ID NO: 289717 - DNA, 561 bp, Homo sapiens
  misc_feature: GYAE6OF01B988U.45.38.D05.1.454.CMB.1.raw
  modified_base (304)..(304): a, c, t, g, unknown or other
  misc_feature (304)..(304): n is a, c, g, or t
  modified_base (547)..(547): a, c, t, g, unknown or other
  misc_feature (547)..(547): n is a, c, g, or t
tcagacgcgatcgacacgaccggtgctcgatttagtatctgatagttgggtttggggggggtcacaagaggcagcgctctcgggcgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggattttagttttgtctcctggtaccaacaacaccccggcgaagcccccaaactaatcatttanagggacactaagcggccctcgggggtttcaagtcgcttctctggctcaagtctggcaacacggcctccctgacaatctctggctccaggctcgaggacgaggctgattatttctgttgctcatagtgcagggaccagctacgttgggtcggttcgggcgggagggaccgtagggttcgacccggttccgtaggtccacgcccgaaggcctcggccccctcgggtccaccgtcctcgttccccnccctcctcgtccgg

SEQ ID NO: 289718 - DNA, 173 bp, Homo sapiens; identical to SEQ ID NO: 289699
  misc_feature: GYAE6OF01BQ3GV.45.38.D05.1.454.CMB.1.raw
  modified_base (173)..(173): a, c, t, g, unknown or other
  misc_feature (173)..(173): n is a, c, g, or t

SEQ ID NO: 289719 - DNA, 665 bp, Homo sapiens
  misc_feature: GYAE6OF01AP7EZ.45.38.D05.1.454.CMB.1.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctcgtgtctgggtctcctggacagtcgatcaccatggcctgcactggaaccaacagtgatggttgggagtttttagtttgtctcctggtaccaacaaccacccggcaacgcccccaaactaatcatttatagggacactaagccggcccgtcggggtttcaagtcgcttctctggctccaagtctggccaacgaccggcctcctagactaatcctcgtcgggctccgagggtcctcgaggacgaggtctggtactttatttcgtgtttgcttctagttacgtcgaccgtaacgggacctagtccgtaacgtttggggtacggttcgggacggggacgggtacccgtagggttaccggaccccgttacggtacggtccgaccggtaccccggtaacgggtcccgttacccggtcccccccggttagggttaccccgtaccgttacccgttcccggttacccccgcccccgtttcccgttacccgtcccggg

SEQ ID NO: 289720 - DNA, 735 bp, Homo sapiens
  misc_feature: GYAE6OF01BJIZ7.45.38.D05.1.454.CMB.1.raw
  modified_base (215)..(215): a, c, t, g, unknown or other
  misc_feature (215)..(215): n is a, c, g, or t
  modified_base (234)..(234): a, c, t, g, unknown or other
  misc_feature (234)..(234): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccagggactgggtgaagccttcggagacccctgtcccctnacttgcagtgtctctggtnactccatcagtagtagtcattaaagttttggggctgggtccgccacggaccccgagggaaggggctggaggtggagttgggactggtctactcgtagtggaccacctattacgacgtccccgtcctacaacgactcgaactggtgatctacaactaaacacgtaccaaagaaacctaattcctaccctagacggactagaacctcgtgtacgaccgaccgacggaaccaccggacctaaaagttacttaactggttagaccgtaaggaacggtaacgggtacccgttaggggtaaactttaacgttacccgttttacggaacccgtaccgggtcgggggttacccccgttacgggggtaaaacccccgtttggggttaccccgttaaccccggtttaccccgttaccccgttacccgtaacccggtacccccgttaacccccgaaacccgggtaaacccggggtcccccctaaaccggtttcccgggtttaaccccccccg

SEQ ID NO: 289721 - DNA, 565 bp, Homo sapiens
  misc_feature: GYAE6OF01CDB0V.45.38.D05.1.454.CMB.1.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggagttttagttttgtctctggttaccaacaacaccccggcgaagcccccaaactaatacatttatagggacactaagcggccctcgggggtttcaagtcgcttctctggctcaagtctggcaacacggcctccctgacaatctctggctccaggctcaggacgaggcctggattatttctgttgctcatatgcagggaccagcaacgttgggtgttcgggcggacgggacctagggttgaccgtccgtaggtcgagcccgaaggtcctcggccccctcggtcacccgttctacggttccccgccccttccgtccgttacccgg

SEQ ID NO: 289722 - DNA, 613 bp, Homo sapiens
  misc_feature: GYAE6OF01D8B6B.45.38.D05.1.454.CMB.1.raw
  modified_base (300)..(300): a, c, t, g, unknown or other
  misc_feature (300)..(300): n is a, c, g, or t
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccacagtgatgttggagttttagtttgtctctggtaccaacaacacccggacgaacgaccccaaactaatctatttanaggacactaagcggcctcggggttcaagtcgcttctctggctccaagtctggcaacgacggcctccctgacaactctcgtggctccgaggtctcgaggacgagctgtatttatttctgttgcttctattatcgacgacgggaccaggtcgtacgtttgggtacggttcggggacgggtaacgggtaccgtagggttacggaaccccgttcggttacggtccgaacggtaccccgaacggtccgtacccggtcccccgtcgggtaccctaccgttcccgtccggtttacccccgccccttcccgtccgtcccgg

SEQ ID NO: 289723 - DNA, 248 bp, Homo sapiens
  misc_feature: GYAE6OF01DC491.45.38.D05.1.454.CMB.1.raw
  modified_base (246)..(248): a, c, t, g, unknown or other
  misc_feature (246)..(248): n is a, c, g, or t
tcagacgcgatcgacacgaccggtgctcgatttagtatctgatagttgggtttgggggtgtggtggtctccactcccgccttgacgaggctgattatttctgttgctcatatgcagggaccagcacttgggtgttcggcggagggaccaggttgaccgtcctaggtcagcccaaggctgccccctcggtcactctgttcccgccctcctctcgatcgcgtctgagcgggctggcaaggcgcatagnnn

SEQ ID NO: 289724 - DNA, 643 bp, Homo sapiens
  misc_feature: GYAE6OF01DL5ZM.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagacccctgtccctcacttgcagtgtctctggtgacctccatcagtagtagtcaataaagttttggggctgggtccgccagccccaggggaaggggctggagtggagttgggactggtctactctagtgggaccacctattacacgcccgtccctcaacgactcgactggtgatctcaataaacacgtccaagaaccaattctcctgaggctagaactctgtcgaccgccgcggacacggaccaaatattactgtgacaagaggacgggtcctagggtaacttacgttcccgttttagacccgtaacgtcgggggtacccttcgggggtaaaccccttcggggtaccctaacccgggttcccttccccgtaccgtaaccggtccccgttaccccgaaaccccggtaaaccggggtccccctaacggttccccgggtttaccccccg

SEQ ID NO: 289725 - DNA, 582 bp, Homo sapiens
  misc_feature: GYAE6OF01DGCKT.45.38.D05.1.454.CMB.1.raw
  modified_base (392)..(392): a, c, t, g, unknown or other
  misc_feature (392)..(392): n is a, c, g, or t
  modified_base (572)..(572): a, c, t, g, unknown or other
  misc_feature (572)..(572): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccagtcggcctgcacgtggaaaccacagtgattggttaggtagttttagtttgtctcgtacggtaccaacaaccgacccggacgaaccgaccccaaactaactactaatttacgaggacacgtaacggccggtcccgttcggggttcaacgtcgtcttcgtcgtcgctacgagtctggaccaacnccgtcctcctgactatctcgtggctcgagtctacgaggacgagctagtatttgttcgtagtcgtctcatagtgcgacggacagcgtacgttgggtcgtccgggacggtacggacgtaggtcgaccgtcgtacgcgtaccgccggtacgtccgccgtcccgtcgctccgtcgtcgtccccnctcctcgtcg

SEQ ID NO: 289726 - DNA, 660 bp, Homo sapiens
  misc_feature: GYAE6OF01B7NND.45.38.D05.1.454.CMB.1.raw
  modified_base (208)..(208): a, c, t, g, unknown or other
  misc_feature (208)..(208): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctccggatgcgtcctgtcccagctgcacctgcaggagtcgggcccaggactggtgaagccttcggagaccctgtccctnacttgcagtgtctctggtgactccatcagtagtagtcataaagttttgggctgggtccgcagccccagggaagggctggagtggattgggactgtctactctagtgggaccactattacgacgcccgtcctcaagactcgactggtgatcgtacaactaaacacgtacaaagaacctaattcctacccgtagacggtctacgaaacttcgtacgtacgaccccggtaccggacggaaccgaacgggaccctaaaagttactttaaccgtggtacgacgtaaaggacggaacggggtccctagggtaaactttacgttacccgtttacgaacccgtacggttcggggacccgttacggggaaacccctgggtacctacccggtcctcccgtacgaccgtccctacccaaccgtaacgggccccaaggttcccggtacccttcccccgtaccgg

SEQ ID NO: 289727 - DNA, 564 bp, Homo sapiens
  misc_feature: GYAE6OF01CI4JY.45.38.D05.1.454.CMB.1.raw
  modified_base (420)..(420): a, c, t, g, unknown or other
  misc_feature (420)..(420): n is a, c, g, or t
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagttttgtctcctggtaccaacaacaccccggcgaagcccccaaactaatcatttataggacactaagcggcctcggggtttcaagtcgcttctctggctcaagtctggcaacacggcctcctgacaatctctggctccaggctcaggacgaggctgattatttctgttgctnatatgcagggaccagctacgttgggtgttcgggcggagggacctagggttcgacccgttccgtaggtccaggccccgaagggcctcggccccccgttcgggtcccaccgttccgttccgttcccccaccccttccgtccgtccg

SEQ ID NO: 289728 - DNA, 674 bp, Homo sapiens
  misc_feature: GYAE6OF01D8FHH.45.38.D05.1.454.CMB.1.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgattggttgggtatttttagtttgtctcctaggtaccaacaaccacccggcgaacgaccccaaataactctaatttagaggactacgtaacgccggtcccgtcggggtttcaagttcgcttctctggcctacaagtcgtaggacaacgaccggcctcccgtagactaatctacgtggcctccaggtctcgacggacgagtctgtatttattcgtgttgctactatagtgacgtacgggtacagcgtacgtttggggtcggttaccggggacgggtaacgggtaccgtaggggttccgaacccggttacgtacggttaccgaacggtaccccggtaaacgggtcccgttacccggtcccccccggttacgggtaccctaccccggtttacccgttcccggtttaccccccctaacccccgtttcccgttcccgttaacccgg

SEQ ID NO: 289729 - DNA, 247 bp, Homo sapiens
  misc_feature: GYAE6OF01A9IVT.45.38.D05.1.454.CMB.1.raw
  modified_base (244)..(247): a, c, t, g, unknown or other
  misc_feature (244)..(247): n is a, c, g, or t
tcagacgcgatcgacacgaccggtgctcgatttagtatctgatagttgggtttgggggtgtggtggtctccactcccgccttgacgaggctgattatttctgttgctcatatgcagggaccagcacttgggtgttcggcggagggaccaggttgaccgtcctaggtcagcccaaggcttccccctggtcactctgttcccaccctctctcgatcgcgtctgagcgggctggcaaggcgcatagnnnn

SEQ ID NO: 289730 - DNA, 545 bp, Homo sapiens
  misc_feature: GYAE6OF01CX61B.45.38.D05.1.454.CMB.1.raw
  modified_base (231)..(231): a, c, t, g, unknown or other
  misc_feature (231)..(231): n is a, c, g, or t
  modified_base (306)..(306): a, c, t, g, unknown or other
  misc_feature (306)..(306): n is a, c, g, or t
  modified_base (424)..(424): a, c, t, g, unknown or other
  misc_feature (424)..(424): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacngtgatggttgggtatttttagttttgtctcctggtaccaacaacacccggacgaacgccccaaactatcatttanaggacactaagcgcctcggggtttcaagtcgcttctctggctcaagtctgcaacaccggcctccctgacaatctctggctccgaggctcaggacgaggctgatttatttctgttgctnactatgcaggacagctaacgttgggtgttcggcggaggactaggttcgaccgtctacggtcacgcccgaaggcctcgccccctcggtccactcccgtacgttccccgccctccgtcgtccg

SEQ ID NO: 289731 - DNA, 554 bp, Homo sapiens
  misc_feature: GYAE6OF01BLW29.45.38.D05.1.454.CMB.1.raw
tcagacgcgatcgacacgaccggtgctcgatttagtatctgatagttggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagttttgtctcctggtaccaacaacacccggcgaacgcccccaaactaatcatttatagggacactaagcggccctcgggggtttcaagtcgcttctctggctccaagtctggcaacacggcctccctgacaactctctggctccgaggctcaggacgagctagattatttctgttgctcatatgcagggacagcacgttgggtgtcgggcggaggaccgaggttgacccgtcgtaggtcacggcccgaaggtcctcgcccccgtcggtccaccgttcttcgttaccccaccccttccgtcctccgg

SEQ ID NO: 289732 - DNA, 584 bp, Homo sapiens
  misc_feature: GYAE6OF01CVKMM.45.38.D05.1.454.CMB.1.raw
  modified_base (448)..(448): a, c, t, g, unknown or other
  misc_feature (448)..(448): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacgggatcgtgggccctttctgccctgactcagcctgcctccgtgtctgggtctcctggacaggtcgatcaccatggcctgcactggaaccaacagtgatggttgggatttttagtttgtcttcctggtaccaacaaccaccccggcgaacgccccaaactaatcattatagggacactaagcggcccgtcgggggtttcaagtcgcttctctggctccaagtctggcaacacggccctcctgacaatctcgtgggctccaggctcgaggacgaggctagatttatttctgttgctcatatgcagggaccngactacgttgggtcggttacgggcgggtagggaccgtagggttcgtaccgtaccgtaggtcacggaccgaacggtccgtacgcccccgtcggtcctaccgttccgtccgttccccgtcccttccctcgtccgtacg

SEQ ID NO: 289733 - DNA, 711 bp, Homo sapiens
  misc_feature: GYAE6OF01CXTDK.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctccggatgcgtcctgtcccagctgcacctgcaggagtccgggcccaggactgggtgaacgccttcgggagaccctgtccctcacttgctagttgtctcgtggtcacctcatcagtagtagtcaattaaagttttggggctgggtccgcacgcccgagggacgggctggagtggagttggacgtgtctacgtcgtaggtcggacctactattaccgacgtcccgtccctacgtaacgacctcgacgttggtgtacttaccgtaacgtaaactaaaccgacgtaccaaaacgtaaaccctaactttcccgtacccgtaggacggtactacgtaaaccttcgtacggtaccggaacccgcccgggtaaccggaccgaaccgggtaacctaaacgttacttaaccgtgttacgacgtaaggacggacgggtaccgtaagggttaactttacgttaccgtttacggaccgtacggttccggggcccgttaaccgggtaaccccttcgggtaccctacccggtccttcccgtaccgacgtcccctacccgaaccgtaccgggcccctaggtcccggttacccccg

SEQ ID NO: 289734 - DNA, 708 bp, Homo sapiens
  misc_feature: GYAE6OF01CQ40D.45.38.D05.1.454.CMB.1.raw
  modified_base (221)..(221): a, c, t, g, unknown or other
  misc_feature (221)..(221): n is a, c, g, or t
tcagacgcgatcgacacgaccggtgctcgatttagtatctgatagttgggtttgggggctttctgagagtcacggacctcctgtagcaggaacatgaagcacctgtggttcctcctcctgctggtggcggctcccggatgcgtcctgtcccagctgcacctgcaggacgtcgggcccagggactggtagaagtcccgttcgggacgaccccgtgtcccctnacgttgcgagttgtctcgtggttcactccagtcagtagtagtcaagttaagtttgggctgggtcctcgacgtccccgaggggaacgggctggacgtggagttgggactgtcgtacgtcgtaggtcgggacctacctattacgacgtcccgtccacgaacgactcgtacgtcggtagtatctaacaaagtaaacaccggtaccaaacggaaccctaaattcccgtaccgtagaacgtctacgtaaactccgtgtaccggaccgccggacgaaccgacggacctaaattactacgtgtacgacgaagacggacggccgtagttaacttacgtccgttacgaccgtacggtacgggtcccgttacgggtaacccttcggtacccgttaccggtcccgttcccttaccggtacccgtaccccttacccgaaacccggtacccgggacccttaaccggttcccggttacccccgtttcccccgtaccccggg

SEQ ID NO: 289735 - DNA, 574 bp, Homo sapiens
  misc_feature: GYAE6OF01B2H9N.45.38.D05.1.454.CMB.1.raw
  modified_base (230)..(230): a, c, t, g, unknown or other
  misc_feature (230)..(230): n is a, c, g, or t
  modified_base (556)..(556): a, c, t, g, unknown or other
  misc_feature (556)..(556): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcacatggcctgcactggaaccaacngtgattggttggggtagtttttagttttgtctcctggtaccaacaacaccccggcgaacgcccccaaactaactcatttatagggacactaagcggccctcggggtttcaagtcgcttctctggctccaagtctggcaacacggcctccctgacaatctctggctccaggctcgacggacgagctgattatttctgttcgcttcatatgcgacgggaccagcacgttgggtcggtcggcgggaggaccgtaggttcgacccgtcgtaggtcacggcccgaaggtctccggtcccccgtcggtcccaccttccgttccgttaccccncccgttccctccgtaccg

SEQ ID NO: 289736 - DNA, 619 bp, Homo sapiens
  misc_feature: GYAE6OF01AO5FF.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcaattaaagttttggggctgggtccgccacgcccccgagggaaggggctggagtggattgggactgtctactcgtaggtcgggaccacctattacagcccgtcctcaagactcgactggtgactctacaataaacacgtaccaaagaacctaaacttctaccctgacgctagaactctgtcgaccgccgacgacacggacctaaatacttactgcgacaagagaacggctaggtaattacttccgttagaccctacgtcgggacccgtacgggaacccttggtacccgtaccggttcctcccgtaccgccgtaccctaccccgaacccgtaacgggacccctaggtccccgggttcccttcccccggtacccgg

SEQ ID NO: 289737 - DNA, 633 bp, Homo sapiens
  misc_feature: GYAE6OF01EJ8BZ.45.38.D05.1.454.CMB.1.raw
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
  modified_base (390)..(390): a, c, t, g, unknown or other
  misc_feature (390)..(390): n is a, c, g, or t
  modified_base (404)..(404): a, c, t, g, unknown or other
  misc_feature (404)..(404): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgattggttgggtagttttagttttgtctcctggtaccaacaaccacccggcgaacgacccccaaactatctattagtaggacactaacgcggcccgtcggggttcagtcgcttctctgctcagtcngcacncgcctccnacatctcgtcggctccgnggctcgacggacgnggctgtatttagttctgttcgtctctatatcgcgacgggaccaggtccgtacggttggggttcggttcggggacgggacgggtaaccgtaggggttaccggacccggttccgtaacgggtccgaaccggacccggtaacgggtcccgttcccggtccccccggttccgggtaccctacccgttcccgttacccggttccccccgtccccgttccccgttcccgtcccgg

SEQ ID NO: 289738 - DNA, 573 bp, Homo sapiens
  misc_feature: GYAE6OF01D1S3Z.45.38.D05.1.454.CMB.1.raw
  modified_base (431)..(431): a, c, t, g, unknown or other
  misc_feature (431)..(431): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggagttttagtttgtctcctggtaccaacaaccaccccggcgaacgcccccaaactaatctatttatagggacactaagcggccctcggggtttcaagtcgcttctctggctcaagtctggcaacacggcctccctgacaactctctggctccgaggctcgaggacgaggctagatttattctgttgctntatatgcgagggaccagctacgttgggttcggttcgggcgggtagggacctagggttcgaccgtccgtaggtccagccccgaaggcctccggtccccctcggtccaccgttccgtccgttccccgcccttccgtccgtaccg

SEQ ID NO: 289739 - DNA, 657 bp, Homo sapiens
  misc_feature: GYAE6OF01BR8Z6.45.38.D05.1.454.CMB.1.raw
  modified_base (230)..(230): a, c, t, g, unknown or other
  misc_feature (230)..(230): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtnactccatcagtagtagtcataaattttggggctgggtccgccacgccccgaggggaagggcgtgggagtggagttgggactgtctactcgtagtgggaccactattacagcccgtcctacaagactcgactggtgatctacaaataaacacgtaccaaagaacctaacttactcccgtagacggtctacgaactctgtcgaccggccgacggacacggacctaaatacttaccgtgtacgacgaaggacggacggggcccgttagggaaacttttagttcccgtttagacccgtaacggtcgggggtacccgttacgggggaacccctttgggtcccctacccggtttcccttacccgtccgtacggtcccccttaccccgaaccccggtaaaccggggccccctacgttcccgggtttcccccccg

SEQ ID NO: 289740 - DNA, 929 bp, Homo sapiens
  misc_feature: GYAE6OF01B7TJ1.45.38.D05.1.454.CMB.1.raw
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtggccctttctgccctgactcagcctgcctccgtgtctgggtctccgtggacagtcgatcaccagtggcctgccacgtggaaaccacaggtgagtggtttgggtagtttttgttttgtctccgtggtaccaacaaccgacccggacgaaccgaccccctaaactaactactaatttagtaacggactaacgtaacgccggtacccgttacgggggttttacaacggtcgtcctttcgtcgtcggacctaccgtaacgtcgtacggaccgtaaccgaccggtccctaccccgttaggaacctaacgttccgtaccgttcgggtacccttacccggacggtccgtacggaacggggtaaccggacgggtccgttaaggtaacgtttaacgtttaacgtcgtaccgttacggtcctttacgtaaactttaacgttcggtaaccggttaagggttttaacgttaacggtttttacccggttttttagggggtttaccggggtttacccgggggggttaaccgggggaaacccgggggttaaacccgtaaaccggggttcccgttaacccgggggttaacccccgggtttaacccgttaaaccggggggtttaaccccaaacccggggtacccccccggttaaaaggggtccccccggtttacccccgggttaccccccccccgggtttaccggggttacccccttaaacccccgttttccccggtttacccccccggtttttaccccccctaaaccccccccggttttcccccgttttaacccccggg

SEQ ID NO: 289741 - DNA, 722 bp, Homo sapiens
  misc_feature: GYAE6OF01CQ9LE.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagcctttcggagaccctgtccctcacttgcagtgtctctggtgactccatcagtagtagtcataaatttggggctgggtccgccacgccccgagggaagggctggagtggattgggactgtctactcgtaggtacggacctactacttacacgcccgtcctacaacgctcgacgtggtgactctacaaactaaacacgtaccaaacgtaaacctaacttcctacccgtagacggtacctacgaacttccgtagtacggaccccggtccggaccggaaccaccggaacctaaaattaacgtttacgtacggtcgtaacgaacggaacgggtacgggtacccgtagggtaaattttaccgttccgtttacgaaccccgtacgggtaccggggtacccgttaccgggggtaaacccgttccggggttaccctaccccggttcccttacccgttaccgaccgttaccccctaccccggaacccgtaacccggggtacccctaggttacccccggttccccgttccccccggtaaccccgg

SEQ ID NO: 289742 - DNA, 713 bp, Homo sapiens
  misc_feature: GYAE6OF01DLBS4.45.38.D05.1.454.CMB.1.raw
  modified_base (209)..(209): a, c, t, g, unknown or other
  misc_feature (209)..(209): n is a, c, g, or t
  modified_base (391)..(391): a, c, t, g, unknown or other
  misc_feature (391)..(391): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctccggatgcgtcctgtcccagctgcacctgcaggagtcgggcccaggactggtgaagcctttcggagaccctgtccctnacttgcagtgtctcgtggtcactccatcagttagtagtactaagttaaagtttgggcgtcggtccgccacgccccgaggggaacgggctggagtggagttgggactgtctacgtcgtaggtcgggaccaccgttaattacgacgtccccgtaccctacgaacgtaccgtcgaacgtgggtanacttacctaactaaaactaaaccgaaccgtaaccgaaaacgaaaccctaaactttcctacccgtaggaacggcttaacgaaccttcgtcgtaccggacccgccggacggaacgaaccggaacctaaaagttacttaacgtgtagacgaaggtacggacgggtacgtaggtaactttacttaccgtttacgaccgtacggtcgggtaccgtacgggacccgttcggtaccgtacccgttcgtaccgtacgtacccgtacccgtacccgaacccgtaaccgggtacccctaacgttccccggttcccgttcccccgtacccggg

SEQ ID NO: 289743 - DNA, 722 bp, Homo sapiens
  misc_feature: GYAE6OF01CVSCA.45.38.D05.1.454.CMB.1.raw
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtggccctttctgccctgactcagcctgcctccgtgtctgggtctcctggacagtcgatcacntggcctgcacnggaacaacagtgagttggttggtattttagtttcgtctctaggtaccaacaacacccggacgaacgaccccaaactaatctatttaagtaggacactaacgcgccgtcggggtttacaacgtcgtcttctcgtcggctccgaagtcgtaggacaacgaccggtccctccctagtaacctaaacttccgtaccggtcggggtcccttacccgacgggtaccctaccgaacggggaaccggaacgggtccgttaagggttaacttttaacgttttcgttaggtttcgtaccttaccgtatagtcggaaccgaggggtaccaacgtccgtaacggtttggggtacggttccgggacggaacgggtaccgttacggggttaccgacccgttacggttaaccgggcctaacggaccccggtaacgggtcccgtacccggtcccccgttccggtcccctaacgttcccgtttcccggttacccccgtcccccttcccgttcgttaccccgg

SEQ ID NO: 289744 - DNA, 708 bp, Homo sapiens
  misc_feature: GYAE6OF01BXI1O.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtctaattaagttttgggcgtcgggtccgccgaccgcccccgaaggggaacggggcgtggaggtggagttcgggacgtgtcttactcgtaggtcgggacctaccttattacgacgtccccgtccctacaacgactcgacgtggtgatctacaaactaaacacgtaccaaacgaacctaattcctcccgtaggacggtctagtaacctcgttcgtacggaccccgccggccggaaccgaccggaacctaaattacttacgtgtcgactaaggaggacgggccgtagggtaactttacgttaccgtttacgacccgtacggttcggggtacccgttacggggtaaccccgttcgggtaccctacccggttcccttcccgtaccgtccgtcccccttacccgaaaccccggtaaccgggtcccccttaacggttcccccggtttcccccgttccccccggtacccggg

SEQ ID NO: 289745 - DNA, 517 bp, Homo sapiens
  misc_feature: GYAE6OF01B6D37.45.38.D05.1.454.CMB.1.raw
  modified_base (228)..(228): a, c, t, g, unknown or other
  misc_feature (228)..(228): n is a, c, g, or t
  modified_base (419)..(419): a, c, t, g, unknown or other
  misc_feature (419)..(419): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatctcctgcactggaaccngcagtgatgttggagttataaccttgtctcctggtaccaacagcacccaggcaaacgcccccaaatcatgattatgaggcagtagcgcctcgagggttctaatcgcttctctgctccaagtctggcacacgcctccctgacaatctcgtcggctccgaggctgaggacgagctagtattatactgctgctnatatgactaggtatagttcgtttggtcggttcggacggtacggaccaagcgtagaccgtcgtaggtcacgtcccgaaggcctccgtccccgtggtacc

SEQ ID NO: 289746 - DNA, 659 bp, Homo sapiens
  misc_feature: GYAE6OF01C0LJC.45.38.D05.1.454.CMB.1.raw
  modified_base (157)..(157): a, c, t, g, unknown or other
  misc_feature (157)..(157): n is a, c, g, or t
  modified_base (198)..(198): a, c, t, g, unknown or other
  misc_feature (198)..(198): n is a, c, g, or t
  modified_base (228)..(228): a, c, t, g, unknown or other
  misc_feature (228)..(228): n is a, c, g, or t
  modified_base (338)..(338): a, c, t, g, unknown or other
  misc_feature (338)..(338): n is a, c, g, or t
  modified_base (362)..(362): a, c, t, g, unknown or other
  misc_feature (362)..(362): n is a, c, g, or t
  modified_base (401)..(401): a, c, t, g, unknown or other
  misc_feature (401)..(401): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttntgccctgactcagcctgcctcgtgtctgggtctcctggacngtcgatcaccatggcctgcactggaaccanagtgatggttggtagttttagtttgtctctggtaccaacaacacccggacgaacgaccccaaactaatctattatacggacactaagccggccgtcggggtttacagtcncttctctggctcaagtctgcaacncgcctcctgacaatctcgcggctcgagtctcgaggacgngctagatttattcgtgttgctactattatcgacgtacgggacctacggtacgttaacggtttggggttcgggtttccggggaccggggtaacggggtacccgttaacggggttccggaacccggtttacccggtaacgggttacccgaccgggtaaccccgaacgggttcccggtaccccggtccccccggttacggttacccgttaccgttcccgttacccggttcccccctccccttcccgtccgtttaccccggg

SEQ ID NO: 289747 - DNA, 761 bp, Homo sapiens
  misc_feature: GYAE6OF01CYX1T.45.38.D05.1.454.CMB.1.raw
  modified_base (355)..(355): a, c, t, g, unknown or other
  misc_feature (355)..(355): n is a, c, g, or t
  modified_base (436)..(436): a, c, t, g, unknown or other
  misc_feature (436)..(436): n is a, c, g, or t
  modified_base (754)..(754): a, c, t, g, unknown or other
  misc_feature (754)..(754): n is a, c, g, or t
  modified_base (757)..(758): a, c, t, g, unknown or other
  misc_feature (757)..(758): n is a, c, g, or t
  modified_base (760)..(761): a, c, t, g, unknown or other
  misc_feature (760)..(761): n is a, c, g, or t
tcagacgcgatcgacacgaccggtgctcgatttagtatctgatagttgggtttgggtttagaacctatgaacattctgtaggggccactgtcttctccacggtgccttccctttctgccctgactcagcctgcctccgtgtctgggtctcctggacagtcgatcaccatggcctgcactggaaccaacagtgatggttggggtagtttttagttttgtctccgtaggtaacccaaacaaaccgaccccggacgaaacgacccccaaaataatcaattttaagaagggaacaacgtaaggccggtcccgttcgggggtttacaagtcgcttctctggctaccaagtctggacaacncggcctcctgacaatctcgtggcctccgaggcctgaggacgaggtctaggtaatttatttcgtgtttcgcttacaattagnggacgaacggggtaacccaaggccgtaacggtttgggggttacggtttccgggggacggggtaaacgggggtaaccccgtaaggggttttaccggaaaccccgggtttccggttaaacgggttcccgaaacgggtacccccgaaaacgggtcccgtacccgggtcccccccgttcgggtaccctaaccgttccgttcccgggttccccccgtacccctttccctccgttaccgacgtttcccgggccgtttccggtacggtaaccgggtccgggggccgttacggggaccgtaaacggggtcccgacaacgttacggnganngnn

SEQ ID NO: 289748 - DNA, 288 bp, Homo sapiens
  misc_feature: GYAE6OF01BIACQ.45.38.D05.1.454.CMB.1.raw
  modified_base (282)..(288): a, c, t, g, unknown or other
  misc_feature (282)..(288): n is a, c, g, or t
tcagacgcgatcgacacgaccggtgctcgatttagtatctgatagttgggtttcaagtcgcttctctggctccaagtctggcaacacggcctccctgacaatctctgggctccaggctcaggacgaggctgattatttctgttgctcatatgcagggaccagcacttgggtgttcggcggagggaccaggttgaccgtcctaggtcagcccaaggctgccccctggtcactctgttcccgcctctctcgatcgcgtctgagcgggctggcaaggcgcatagnnnnnnn

SEQ ID NO: 289749 - DNA, 647 bp, Homo sapiens
  misc_feature: GYAE6OF01CMHP6.45.38.D05.1.454.CMB.1.raw
  modified_base (209)..(209): a, c, t, g, unknown or other
  misc_feature (209)..(209): n is a, c, g, or t
  modified_base (228)..(228): a, c, t, g, unknown or other
  misc_feature (228)..(228): n is a, c, g, or t
  modified_base (488)..(488): a, c, t, g, unknown or other
  misc_feature (488)..(488): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctccggatgcgtcctgtcccagctgcacctgcaggagtcgggcccaggactgggtgaagccttcggagaccctgtccctnacttgcagtgtctctggtnactccatcagtagtagtcattaaagttttggggctcggggtccgccacgcccccgaggggaagggcgtggaggtggattgggactgtctactcgtagtcgggaccactattacacgcccgtcctacgaacgactcgactggtgtactctacgaaactaaacacgtacaaacgaacctaacttcctcctaggacgtctacgtaactcgtgtacgacccgtccggacggaaccgacggacctaaagttacttaacgtggtanacgaaggaaggacgggtactaggtaatttacgttcctttacggaaccctacggtcggggtcctacgggaaccccgttgggtacctaccgtcctaccctctacgcccctaccgaacccgtaaccgggcccctaggttcccggtcccttcccccgtaccgg

SEQ ID NO: 289750 - DNA, 744 bp, Homo sapiens
  misc_feature: GYAE6OF01EP28W.45.38.D05.1.454.CMB.1.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtggccctttctcgccctgactcagcctgcctccgtgtcgtggtctccgtggacagtcgatcaccagtcggcctgcactaggaaccaacgagtgattggttgggtagtttttagtttgtctccgtaggtaaccaacaaccgaccccggacgaaaccgaccccctaaaattaactactaatttaagtaacgggaactaacgtaaacggccggtacccggttcgggggtttacaaggttccgtctttaccgtccgtcggtcctacccaaggttccgtaggaccctaaaccgacccggtcccttaccccgtaggaacctaacgtttccgtccgtacgggccttaccgacggtccgtacgaacgggacggagtcgttagtattttagtttcgtagttcgtacctctaattcgtacgacgtagggaccctagtcgtaccggttgggttcggtacgggtcgggacggtaccgtaggttaccggaccggttaccgtacggtaccgacggtacccgtaacggtcccgttcccggtccccccgttacggtacccttaccgttccccgtttacccgttacccccgtaccccctttccgcccgttacccg

SEQ ID NO: 289751 - DNA, 726 bp, Homo sapiens
  misc_feature: GYAE6OF01DULYO.45.38.D05.1.454.CMB.1.raw
tcagacgcgatcgacacgaccggtgctcgatttagtatctgatagttgggtttgggggacctcctgtgcaggaacatgaagcacctgtggttcctcctcctgctggtggcggctcccggatgcgtcctgtcccagctgcacctgcaggagtcgggcccaggactggtgaagcctttcgggagacccctgtcccctcactttgcagtgtctctggtgactccatcagtagtagtctaattaaagtttttggggcttgggtcccgccacggcccccgaggggaaggggctgggagtggattgggactggtctactctaggtgggaccacgtattacacgcccgtccctcaagactcgactggtgatctacaaataaaccacgtaccaaacgaaacctaactttcctaccccgtagacggtcctagaaaccttcgttggtacgacccgggcccggtacgggaaccgaccgggaaccctaaaagttacttacgtggtagaccaaagggaggacgggtcctagggttaattacttcccttttacggacctaacggttcggggggccccttagggggaacccctttggggtaccctacccgggttccttcccgtccgaaccgtccccttaccgaacccggaaacggggtcccctacggttccccgggttacccctttccccccgacggtcccctaacccccgttccctaacccgaaacggtccgtaacccgg

SEQ ID NO: 289752 - DNA, 758 bp, Homo sapiens
  misc_feature: GYAE6OF01C4W50.45.38.D05.1.454.CMB.1.raw
tcagacgcgatcgacacgaccggtgctcgatttagtatctgatagttgggtttgggggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcaattaaagttttggggctgggtccgccacgccccgagggaagggctggagtggagttgggactgtctactctagtcgggaccacgtattacacgcccgtcctcgaacgctcgactggtgactctacaactaaacacgtaccaaagaaccctaactttcctaccccgtgtacgggtactacgtaactcgtagtcgacccggcccggacggtaaccgaccgggtaacctaaaagttactttaaccgtggtacgaacgaaagggacggtacgggtacccgttaagggtaaattttacgttaccgttttaacgaccgtaaccgggttcgggggaccccgtttacgggggtaaacccccttgggttaccccgtaacccggttccgttaccccgttcgaacccggtcccccgtaaccccgtaacccgggaaacccggggtcccccttaacggttccccgggtttaccccctttccccccggacgggtaccccctacccccgttacccctacccggtaaacgcccggtacccccgg

SEQ ID NO: 289753 - DNA, 664 bp, Homo sapiens
  misc_feature: GYAE6OF01EBSM9.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccagggactgggtgaagccttcgggagacccctgtcccctcacttgcagtgtctctggtgacctccatcagttagtagtcattaaagtttggggctgggtccgccacgccccgagggagggctggagtggagttgggactgtctactcgtagtcgggacctacctattacgacgtcccgtcctacaacgactcgacgtggtgatcgtacaactaaacacgtaccaagaacctaattcctcctagacggtctagaacttcgtgtacgacccgccgacggaacaccggacctaaaagttacgttaacctgtacgacgaaggacggtacgggccgtagggtaactttacgttcccgtttacgacccgtacggttacggggtccgtaccggggtaaccccttcgggtacccgtacccggttccctacccgtaccgtaccggtcccctacccgaacccggaaccgggtcccctaacggttcccggttacccccg

SEQ ID NO: 289754 - DNA, 175 bp, Homo sapiens
  misc_feature: GYAE6OF01ETPNF.45.38.D05.1.454.CMB.1.raw
  modified_base (174)..(175): a, c, t, g, unknown or other
  misc_feature (174)..(175): n is a, c, g, or t
tcagacgcgatcgacacgaccggtgctcgatttagtatctgatagttgggtttgggggaagaggaagactgacggtccccccaggagttcaggtgctgggcacagcggccctgggctgcctggtcaaggactacttcctcgatcgcgtctgagcgggctggcaaggcgcatagnn

SEQ ID NO: 289755 - DNA, 622 bp, Homo sapiens
  misc_feature: GYAE6OF01D4ORK.45.38.D05.1.454.CMB.1.raw
  modified_base (229)..(229): a, c, t, g, unknown or other
  misc_feature (229)..(229): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactgggtgaagccttcggagaccctgtccctcacttgcagtgtctctggtnactccatcagtagtagtcaattaaagttttggggctgggtccgccacgcccccgaggggaaggggctggagtggagttgggactgtctactctaggtcgggaccacctattacacgcccgtccctcaacgactcgactggtgatctacaaataaacacgtaccaaagaacctaattcctcctagacgctagaactctgtcgaccgccgacggacacgacaaattattactgtgacgaagacgggacgggcctaggtaactttacgttacctttacgaccctacggtcggggtcccgtacgggaacccgttcgggtacctacccggttcctcccgtcacgccctacccgacccgtaacgggcccctagtcccggttcccgttcccccgtaccgg

SEQ ID NO: 289756 - DNA, 584 bp, Homo sapiens
  misc_feature: GYAE6OF01BJB3J.45.38.D05.1.454.CMB.1.raw
  modified_base (227)..(227): a, c, t, g, unknown or other
  misc_feature (227)..(227): n is a, c, g, or t
  modified_base (261)..(261): a, c, t, g, unknown or other
  misc_feature (261)..(261): n is a, c, g, or t
  modified_base (295)..(295): a, c, t, g, unknown or other
  misc_feature (295)..(295): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctctgcactggaaccngcagtgatgtggattatacttgtctctgtacacngcaccagacaaacgccccaaatcatagatttagngaggcagtaacgcggcctgtacgggtttacatcgcttcgtctgctacagtcgtggaccaacgaccggtccctcctagacctaactctcgtcggcctccgaggctaggacgacggagtctagtaatttacgtactgcttcgctacgatagtcggacgtaagggttagttagttacgtttgggttcggtcgggacgggtacgggtaacctaaggtccgttacggacccgttccgtagggtacccaccggtacccgaacgggtccgtccccggtcccccgttcgggtacccc

SEQ ID NO: 289757 - DNA, 740 bp, Homo sapiens
  misc_feature: GYAE6OF01DYXYF.45.38.D05.1.454.CMB.1.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgattggttgggttagtttttagttttgtcttctaggtaaccaacaaccgacccggacgaaccgaccccaaaactaactactaatttaagtacgggactacgtaacggccggtcccggttacgggggtttacaacggttcgtctttctcgttcggcctaccgaacgttcgtacggaccaaccgaccggtccctacccgtacgacctaacttccgtacggtcgggccttaccgagggtccttacgaacgggaccgacggtcttagtattttactttcgttgttcgtacctactagtacgtcggacgaacgggaccctaggtacgttacgggtttcggggttccggttacgggggaccgggtaacggggtaccgtaacggggtttccgaacccgggtttccgtaacggtccgaacccgggtaccccgaacggtcccgtcccggtcccccgttacgggtccctaccgttccgttacccgttccccctaccccgttccgtaccgttacccgg

SEQ ID NO: 289758 - DNA, 662 bp, Homo sapiens
  misc_feature: GYAE6OF01BLMUM.45.38.D05.1.454.CMB.1.raw
  modified_base (220)..(220): a, c, t, g, unknown or other
  misc_feature (220)..(220): n is a, c, g, or t
  modified_base (229)..(229): a, c, t, g, unknown or other
  misc_feature (229)..(229): n is a, c, g, or t
  modified_base (344)..(344): a, c, t, g, unknown or other
  misc_feature (344)..(344): n is a, c, g, or t
  modified_base (369)..(369): a, c, t, g, unknown or other
  misc_feature (369)..(369): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggacgaccctgtccctcacttgcagtntctctggtnactccatcagtagtagtcaattaaagtttgggctgggtccgccgacgcccccgaggggaacggggctaggaggtggagttgggactgtctactcgtaggtcggacctactatacncgcccgtcctacagctcgacgtggnactctacaaactaacacgtaccaaacgaacctaacttcctacctagacgtctacgtaactcgtcgtcgacccggcgacggaccacggactaaatattacgtgtagacgtaaggacgacggtccgtaggtaactttacgttcctttacggacccgtacggtcggggtacccgtacggggtaacccgttcgggtaccctaccggttccctcccgtaccgaacccggtcccctaaccccggaaaccggtacccgggtacccctacggttcccggttccccgttccccccggtacgg

SEQ ID NO: 289759 - DNA, 712 bp, Homo sapiens
  misc_feature: GYAE6OF01EFMXY.45.38.D05.1.454.CMB.1.raw
  modified_base (236)..(236): a, c, t, g, unknown or other
  misc_feature (236)..(236): n is a, c, g, or t
tcagacgcgatcgacacgaccggtgctcgatttagtatctgatagttgggtttggggggggtcacaagaggcagcgctctcgggacgtctccaccatggccttggctctgctgctcctcactctcctcactcaggacacaggatcgtgggccctttctgccctgactcagcctgcctcgtgtctgggtctccgtggacagtcgatccaccatcggcctgacacgtacggaaccaangtgagttggttaggggttatttttagttttcgtcttccgttacggtaaccctaaacgaacccgaaccccggacgaaaccgaaccccctaaaactaactactaatttaagaacgggacctaacgtaaacgccggtaccctaggtaacgggtttactaagtccgtctttactcgtcggccttacgaacgttcgtaggaccaaccgaccggtccctcccgtagaactaacgtccgttccgtcgggacttacccgaggcgtagacggtacggaggtctagtatttaacgttacgtcgtccttagctacgtatagtcggtactagggtaagttacgttacggtttggtcggttacgggaacggttacggaactaggtccgtacgtaccggtacttacgggaccgaccggtacccgaaggtccctacccgtcccccggttacggtcccacgttccccttcccgttcccctccccgttacccg

SEQ ID NO: 289760 - DNA, 649 bp, Homo sapiens
  misc_feature: GYAE6OF01DWJMV.45.38.D05.1.454.CMB.1.raw
  modified_base (157)..(157): a, c, t, g, unknown or other
  misc_feature (157)..(157): n is a, c, g, or t
  modified_base (232)..(232): a, c, t, g, unknown or other
  misc_feature (232)..(232): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttntgccctgactcagcctgcctcgtgtctgggtctcctggacagtcgatccacatcggcctgcactaggaaccaacngtgatggttgggtatttttagttttgtctccgtaggtaaccaacaaccgaccccggcaacgacccccaaatactctaatttagaggacacgtaacggccggtcccgtcgggggtttacaacgtcgtcttctcgtcggcctacaagtctggaccaacgaccggtccctcctagactacgtctcgtggcctcgaggctacgacggacgacggctagtatttactttacgttgttctctactaattagtcgacgacgggaccctagtcgtaacggtttgggtacggtcgggcgggacgggtaccgtagggttacgaccgttaccggtaggtaccgaccgacccgtaacggtcccgttacccgtccccgtaccgtccaccgttccgttacccgttccccctaccctcccgttcgtacccgg

SEQ ID NO: 289761 - DNA, 610 bp, Homo sapiens
  misc_feature: GYAE6OF01E1B40.45.38.D05.1.454.CMB.1.raw
  modified_base (229)..(229): a, c, t, g, unknown or other
  misc_feature (229)..(229): n is a, c, g, or t
  modified_base (464)..(464): a, c, t, g, unknown or other
  misc_feature (464)..(464): n is a, c, g, or t
  modified_base (477)..(477): a, c, t, g, unknown or other
  misc_feature (477)..(477): n is a, c, g, or t
  modified_base (493)..(493): a, c, t, g, unknown or other
  misc_feature (493)..(493): n is a, c, g, or t
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgattggttgggtagtttttagtttgtctcctggtaaccaacaacgaccccggcgaaaccgacccccaaaactaatacctaatttactaaggggaaccaacgtaaacggccgggtcccgttacggggggtttccaaacggttcgtcgtttctctcgggcttaccaagttctggacaacgacggccctccctgacaatctcgtggctccaggctcgaggacgaggctgtatttntttcttgttgctntatatggacacggacngtctacgttgggtcgttcgggacgggtaggacgtaggtcgaccgtcgtaggtccacgcccgaggtcctcggtccccctgtccaccgttccgtcttacccgcccttccgtcgtcccgg

SEQ ID NO: 289762 - DNA, 561 bp, Homo sapiens
  misc_feature: GYAE6OF01A2WIK.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcattaaattttggggctgggtccgccagcccccgaggggaaggggctgggagtggattggggactgtctactctagtcgggaccacctattacagccccgtcctcaagactcgactggtgatctacaataaacacgtaccaaagaaccaattctccctgagctgaactctgtcgaccgccgcggacacggaccaaatattactgtgcgaagagagggacctaggtaacttactcctttgaccctagtcggggccgtacgggacccgtggtccaccgtcctcctcacgcctccaccgaggcccagtccgtccccg

SEQ ID NO: 289763 - DNA, 616 bp, Homo sapiens
  misc_feature: GYAE6OF01BV19X.45.38.D05.1.454.CMB.1.raw
  modified_base (233)..(233): a, c, t, g, unknown or other
  misc_feature (233)..(233): n is a, c, g, or t
tcagacgcgatcgacacgaccggtgctcgatttagtatctgatagttgggtttggggggtcacaagaggcagcgctctcgggacgtctccaccatggcctggctctgctgctcctcactctcctcactcgaggacacaggatcggtgggtccctttctgccctgtactcagcctgcctccgtgtctggtctcctggacagtcgatcgaccatggcctgctacgtggaaccaangtgatggttggtagttttgtttgtctcctggtacctaacaacgtacccggacgaacgaccccaaataactctatttagtacggacaacgtaacgccggtacccgtaggggtatttcgaagtcgtcttctcgtggctaccaagtctacggacaaacgacggtcctaccgtagactaactcgtacgtacgggctaccgacggtcctacgaacggacgaggtactaggtaactttaatttccgtgttcgtctactatagtcgacgtaaggacctagctaagttcgggtcgttaccgggacggtacggacgtaggttacgacgtcgtagtcgacgtccgaggctccgaccccgtcgtactaccgttctacgtccctccgtcgtaccg

SEQ ID NO: 289764 - DNA, 615 bp, Homo sapiens
  misc_feature: GYAE6OF01EJO2J.45.38.D05.1.454.CMB.1.raw
  modified_base (573)..(573): a, c, t, g, unknown or other
  misc_feature (573)..(573): n is a, c, g, or t
tcagacgcgatcgacacgaccggtgctcgatttagtatctgatagttgggtttgggggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcaattaaagttttggggctgggtccgccacgccccgagggaaggggctgggagtggattgggactgtctactctagtgggaccacctattacagcccgtcctcaagactcgactggtgatctacaataaacacgtaccaagaaccaattctacctgagctagaactctgtcgaccgccgacggacacggccaaatacttactgtcgacaagagagggcctaggaatttactcctttacgaccacgtcggggcctacggggaacccttgggtacctacccggtcttcccgtcacgtccctaccacccgaacgggtcccctagttcccggttccctttcccccccgngggtaccctacccccgttaccctacccaaacggcgtaccccg

SEQ ID NO: 289765 - DNA, 651 bp, Homo sapiens
  misc_feature: GYAE6OF01EUFPK.45.38.D05.1.454.CMB.1.raw
  modified_base (158)..(158): a, c, t, g, unknown or other
  misc_feature (158)..(158): n is a, c, g, or t
  modified_base (231)..(231): a, c, t, g, unknown or other
  misc_feature (231)..(231): n is a, c, g, or t
  modified_base (460)..(460): a, c, t, g, unknown or other
  misc_feature (460)..(460): n is a, c, g, or t
tcagacgcgatcgacacgaccggtgctcgatttagtatctgatagttgggtttgggggggggtcacaagaggcagcgctctcgggacgtctccaccatggcctgggctctgctgctcctcactctcctcactcaggacacaggatcgtgggccctttntgccctgactcagcctgcctccgtgtctgggtctcctggacagtcgatcaccatggcctgcactggaaccaanagtgattggttagggtagtttttagttttgtctcctggtaaccaacaacaccccggcgaacgacccccaaaactactctaatttatacggggacaactaaggccggtcccgtcggggggtttacaaggttcgctttctctcggctccaagtctggcaacacggcctcctgacatctctcgggctccgacggctcgacggacgaggctgtatttatttcgtgttcgactntatatcggcgtacgggtacccagtcgtacggtttcggggtcggttccggggagggtacggggaccgtagggttcggacccggttcgtaacgggtcaaccggccccgaaagggtcccttccggtccccccgttcgggttacctacccgttccgttcccggtttaccccccgccctttcccgtccgtacccgg

SEQ ID NO: 289766 - DNA, 611 bp, Homo sapiens
  misc_feature: GYAE6OF01A98TA.45.38.D05.1.454.CMB.1.raw
  modified_base (595)..(595): a, c, t, g, unknown or other
  misc_feature (595)..(595): n is a, c, g, or t
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaaccaacagtgatggttgggtagtttttagtttgtctcctggtaccaacaacaccccggcaacgacccccaaactaatctatttaagagggacactaagccggcccgtcggggtttcaagtcgtcttctctggctccaagtctggcaacgcgcctccgtgacaactctcgtggcctccgaggtctacgacggacgacggtcttggtaatttactttcgttgttcgacttctaattacgtgcgaacgggtaccaggcgtacgttgggtcggttcgggcggtaacgggccgtaggtacgaccgtcgtaggtcgaacggtcccgaaggtcctccggcccccgttggtaccctacgttcccgttaccggttcccccncccttcccgttctccg

SEQ ID NO: 289767 - DNA, 572 bp, Homo sapiens
  misc_feature: GYAE6OF01E4RX4.45.38.D05.1.454.CMB.1.raw
  modified_base (368)..(368): a, c, t, g, unknown or other
  misc_feature (368)..(368): n is a, c, g, or t
  modified_base (427)..(427): a, c, t, g, unknown or other
  misc_feature (427)..(427): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagtttttagttttgtctcctggtaccaacaacaccccggcgaacgcccccaaactaatcatttatagggacactaagcggccctcgggggtttcaagtcgcttctctggctccaagtctggcaacncggcctccctgacaatctctgggctccaggctcaggacgaggctgatttatttctgttnctcatatgcagggaccagcacgtttggggtgttcgggcggagggacctagggttcgaccgttcctaggtccacggcccgaaggtcctcggccccccgtcggtccaccgttcctcgttcccccgccccttcccgtccgttacccgg

SEQ ID NO: 289768 - DNA, 587 bp, Homo sapiens
  misc_feature: GYAE6OF01BY2U8.45.38.D05.1.454.CMB.1.raw
  modified_base (228)..(228): a, c, t, g, unknown or other
  misc_feature (228)..(228): n is a, c, g, or t
  modified_base (333)..(333): a, c, t, g, unknown or other
  misc_feature (333)..(333): n is a, c, g, or t
  modified_base (358)..(358): a, c, t, g, unknown or other
  misc_feature (358)..(358): n is a, c, g, or t
  modified_base (405)..(405): a, c, t, g, unknown or other
  misc_feature (405)..(405): n is a, c, g, or t
  modified_base (435)..(435): a, c, t, g, unknown or other
  misc_feature (435)..(435): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtnactccatcagtagtagtcaattaaagttttggggctgggtccgccagcccccagggaggggctggagtggattgggactgtctactctagtgggaccactatacngcccgtcctcaagactcgactggtnatctcaataaacacgtacaagaaccaattcctcctagagctgactcngtcacccgcgcgacacggcaatatacgtgngacaagagaggctaggaatttatccttagacctacgtcgggtccgtcgggtaaccctgggtaccctaccgtaccgtccgtacccgacggtcccctacccgaacccgtaaccggggcccctaagttccccggttcccgttccccccgtccggg

SEQ ID NO: 289769 - DNA, 673 bp, Homo sapiens
  misc_feature: GYAE6OF01C6MFI.45.38.D05.1.454.CMB.1.raw
  modified_base (212)..(212): a, c, t, g, unknown or other
  misc_feature (212)..(212): n is a, c, g, or t
  modified_base (231)..(231): a, c, t, g, unknown or other
  misc_feature (231)..(231): n is a, c, g, or t
  modified_base (323)..(323): a, c, t, g, unknown or other
  misc_feature (323)..(323): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaaagcctttcggagaccctgtcccctnacttgcagtgtctctggtnactccatcagtagtagtcagttaaagttttgggctgggtccgccgacgcccccgaggggaaggggctggagtggagttgggactgtctactntagtcgggacctactattacacgcccgtcctacaagactcgacgtggtgtatctacaaactaaacacgtaccaacgtaaacctaattcctacccgtgacggctacgaacttcgtcgtacgacccgccggacggtaaccaccggtacctaaagttactttacgtgtacgacaaaggaggaacgggtcctagggtaactttacgttacctttcggaaccgtacggtcggggtccgttaccggggtaacccgtcgggtacctacccggtcctacccgtacgtacccggccccttaacccgaacccgaaacgggtacccctacggttaccccggtcccttccccccggtaccgg

SEQ ID NO: 289770 - DNA, 647 bp, Homo sapiens
  misc_feature: GYAE6OF01ELP5J.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctcgtggtgactccatcagtagtagtcaattaaagttttggggctgggtccgccacgcccccgagggaaggggctggagtggattgggactgtctactcgtaggtggaccactattacacgcccgtcctacaagtactcgacgtggtgatctacaataaacacgtaccaagaacctaattcctccgtagacggtctagaactctgtcgaccgcgacgacaccggactaaatacttactgtacgacaaggacgacgggtacctaggtaaatttacgttccgtttacgacccgtacggttcggggaccgttaccggggtaaccccttgggtacccgtaacccggttcccttacctaccgtacgtcccctacccgaaccgtaaacccgggtccctacggttccccggttccccgttcccccgtacccggg

SEQ ID NO: 289771 - DNA, 833 bp, Homo sapiens
  misc_feature: GYAE6OF01DDJBH.45.38.D05.1.454.CMB.1.raw
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggtccctttctcgccctgactcacgcctgcctccgtgtcgtgggtctcctggacagtcgatcaccatcggcctgcacgtacggaaaccaagagtgagttggtttaggggttagttttttaggttttcgtccttaccgtacggtaacccaaaccgaaccgaccccgggacgaaaccgaccccctaaaactaactactaatttaacgtaacggaactaacgtaaacggccggtcccggttacgggggtttacaacggttccgtctttcctcgtcggtcctacgtaacggtcgtacggaccaaccgtaccggtcccgttacccgtaggaaacctaacgtttccgtaccggttacggggacccttaccggacggttaccgtaaccggaacgggtaaccggacgggttccttaaggtttaacttttaacgtttcgttggtttacgcttacgtaattacgttcggtaacgtaagggttacgtttaacggtttacgttttgggttacggtttaccgggtacggggtaacgggaaccttaacggtccggttaccggtaacccggtttacgtaacgggtaccgaaccggtaccccggtaaacggtccccgttaccccggtccccccggttaagggtcccccttaacgtttcccctaacccggtttccccccaacccctttccgtcccgttacccgg

SEQ ID NO: 289772 - DNA, 702 bp, Homo sapiens
  misc_feature: GYAE6OF01DOMQA.45.38.D05.1.454.CMB.1.raw
  modified_base (230)..(230): a, c, t, g, unknown or other
  misc_feature (230)..(230): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggacgaccctgtccctcacttgcagtgtctcgtggtnactccatcagtagtacgtctaagttaaagttttgggcgtcgggtcccgccgaccggcccccggaggggaacggggtcgtgggagtggtagttgggacgttcgtactacgtcgtaggtcggacctacgttactacgaccgcccgtaccctacgacgaccgtcgacgtggtcgtactctactaaactaaccaccgtaaccaaagaaccctacttcctaccgtaggtacgtactacgtaacttcgtcggtaccgacccggccggacggaacgacccggactaaagttcgtaacgtgttacgaacgaacggacggacggtaccgtaggtaacttacgttccgttacggacctacggtcgggtaccgtaccgggtacccgttcggtccctaacccgttcctacccgtccgaccgtccccgtacccgaaccggtacccggtacccgtacgttccccggttccccttccccgtacccgg

SEQ ID NO: 289773 - DNA, 252 bp, Homo sapiens
  misc_feature: GYAE6OF01DOY1E.45.38.D05.1.454.CMB.1.raw
  modified_base (247)..(252): a, c, t, g, unknown or other
  misc_feature (247)..(252): n is a, c, g, or t
tcagacgcgatcgacacgaccggtgctcgatttagtatctgatagttgggtttgggggtgtggtggtctccactcccgccttgacgaggctgattatttctgttgctcatatgcagggaccagcacttgggtgttcggcggagggaccaggttgaccgtcctaggtcagcccaaggctgccccctcggtcactctcgttcccgccctcctctcgatcgcgtctgagcgggctggcaaggcgcatagnnnnnn

SEQ ID NO: 289774 - DNA, 707 bp, Homo sapiens
  misc_feature: GYAE6OF01CGNZG.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcaattaagttttgggctggtccgccgacggccccgagggaacgggcgtggaggtcggtagttgggactgtctacgtcgtaggtcgggaacctaccgttattaccgacgtccccgtaccctacgaaacgtaccgtcgaacgtgggtacgtattaccgtacaaaactaaacgaccgtaacaaacgaaaccctaaacgtttccctaccgtacgtaacggtccttacgaaaccttcgttcgtacggaacccggtcccggacggaccgaaccggtaacctaaaagttacgttaaccgttgtacgtaccgaaacggtaggaacggttaccgtaggttaacttaacgttccgtttacggacccgtaacggtcggggcccttacggggtaaccccttggtcccgtaaccgtccttcccgtacaccgtcccctaccgaaccggtaccgggccctagtcccggttacccc

SEQ ID NO: 289775 - DNA, 609 bp, Homo sapiens
  misc_feature: GYAE6OF01DSK87.45.38.D05.1.454.CMB.1.raw
  modified_base (378)..(378): a, c, t, g, unknown or other
  misc_feature (378)..(378): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactgggtgaagccttcggagaccctgtccctcacttgcagtgtctctggtgactccatcagtagtagtcattaaattttggggctgggtccgccacgcccccgagggaaggggctgggagtggagttggggacttggtctacttcgtaggtcgggacctaccttattacacgtccccgtccctcaacgactcgactggtnatctacaaactaaacacgtaccaagaaccaattcctccctgagtctagactcgtgtcgacccgccgacggacacggaccaaattactactgtgacaaggagacgggtacctaggtaactttacttccgttgaccgtacgtcggggacctcgggaacctggtaccgaccgtcctccgtcacgccctaccgaacccgtacgggaccctacgttccgtcccgttcccctacggg

SEQ ID NO: 289776 - DNA, 639 bp, Homo sapiens
  misc_feature: GYAE6OF01EKS45.45.38.D05.1.454.CMB.1.raw
  modified_base (242)..(242): a, c, t, g, unknown or other
  misc_feature (242)..(242): n is a, c, g, or t
  modified_base (394)..(394): a, c, t, g, unknown or other
  misc_feature (394)..(394): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
  modified_base (447)..(447): a, c, t, g, unknown or other
  misc_feature (447)..(447): n is a, c, g, or t
  modified_base (466)..(466): a, c, t, g, unknown or other
  misc_feature (466)..(466): n is a, c, g, or t
tcagacgcgatcgacacgaccggtgctcgatttagtatctgatagttggggtttggggggggtcacaagaggcagcgctctcgggacgtctccaccatggcctgggctctgctgctcctcactctcctcactcaggacacgaggatcggtcggtccctttctcgccctgactcagtcctcgcctccgtgtcgtggtctcgtggacagtcgatcactagtcggctgacacgtacggaaccaangtgtagttggttcgggttagtttttagttcgtctccgtacgtaaccaaccaaccgacccggacgaaccgtaacccctaaactatactattagacggactacgtacggcgtccggttagggttacacgttcgtcttctcgtcgctacgagtcncggacaacgccgcctacctgaactagtcngtcggtcncgagctagacggacgngtctagtattatcgtgtcnctagtatagtcgacggagtacgtagtcgtacggttcgggttcgtcgggtacgacgggtacgtaccggttacggtcgtaccggtccgtacggacaccggtaccgaacggtccgtcccgttaccccggtcgtacccgtacccttccgttacccttccccttcccgtccgttaccg

SEQ ID NO: 289777 - DNA, 722 bp, Homo sapiens
  misc_feature: GYAE6OF01CWX1U.45.38.D05.1.454.CMB.1.raw
  modified_base (157)..(157): a, c, t, g, unknown or other
  misc_feature (157)..(157): n is a, c, g, or t
  modified_base (232)..(232): a, c, t, g, unknown or other
  misc_feature (232)..(232): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttntcgccctgactcagcctgcctccgtgtctgggtctccgtggacagtcgatcaccatggcctgcactggaaccaanagtgatggttgggtatttttagttttgtcttcctggtaaccaacaaccgacccggacgaacgaccccaaactaatactaatttaagaggactacgtaagccggacccgttggggtttacaacgtcgtcttctcgtcggtacctacgtaacgtcgtaggaccgtaaaccgaccggtcccttacccgtacgaaccgtaaacttccgttaccggttcggggtaccttaccccggagggtacccgttaccggaacgggaccgggtaacggtacgtacggtattttaacgttttccgttggtttacgcttactagtagtcgacgaacgggacagtacgtaacgttggggttcggttcgggcgggtaagggaccgtagggttacgtacccggtacgttacggtccgaacgtaccgaacggtccgtaccggtccccccgtcggtacccgttaccttcccgttaccgttcccccgaaccccttcccgtcgttacccgg

SEQ ID NO: 289778 - DNA, 626 bp, Homo sapiens
  misc_feature: GYAE6OF01CRYM0.45.38.D05.1.454.CMB.1.raw
  modified_base (157)..(157): a, c, t, g, unknown or other
  misc_feature (157)..(157): n is a, c, g, or t
  modified_base (229)..(229): a, c, t, g, unknown or other
  misc_feature (229)..(229): n is a, c, g, or t
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttngccctgactcagcctgcctcgtgtctgggtctcctggaacagtcatcaccatcggcctgcactggaaccaangtgatggttgggtattttagtttgtctcctggtaccaacacgcaccaggacaaacgccccaaatcatntattanggaggctagtaagccggtcctacgtagggtttctaagtcgtcttctcgtcgctcctaagtcgtcggaaccaacgaccggccctacctacgtactaactctcgcggtacctccgaggtctagggaggacgaagtctagtattactacgtcgtctcgactctaatagtagacgttaaggttagttacggtttacgtttgggtacgggttacgggaccgggtaacgggtaaaccgacgttaccggtaccggtacccggttacgtacggtaccaccgtacccgaacggtcccgtacccgtccccgttaccggtcctaccgttcccgg

SEQ ID NO: 289779 - DNA, 621 bp, Homo sapiens
  misc_feature: GYAE6OF01A9SJL.45.38.D05.1.454.CMB.1.raw
  modified_base (229)..(229): a, c, t, g, unknown or other
  misc_feature (229)..(229): n is a, c, g, or t
  modified_base (448)..(448): a, c, t, g, unknown or other
  misc_feature (448)..(448): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactgggtgaagccttcggagaccctgtccctcacttgcagtgtctctggtnactccatcagtagtagtcattaaagttttggggctgggtccgccagcccccgagggaaggggctggagtggattgggactgtctacgtctaggtgggaccacctattacacgcccgtcctacaagactcgactggtgatctacaaactaaacacgtaccaaagaacctaattctcctgagtctagaactctgtcgacccgcgcggacacggacaaattnttacgtgtagacaaggagagggcctaggtaattacgttccttacgaacctacggtcggggaccgtacggggaaccccttgggtccgacccggttccttacccgtacgtaccgtccctacccgaacccgtaaccgggcccctaaggttcccggttcccttcccccgtacccggg

SEQ ID NO: 289780 - DNA, 658 bp, Homo sapiens
  misc_feature: GYAE6OF01B6O67.45.38.D05.1.454.CMB.1.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgacactggaaaccaacagtgagtggttggggttagtttttagttttgttctctacggtaaccaactaaccgaccccggacgaaccgacccccaaactaactctaatttaagtaggaacacgtaagccggtcccgtcggggtttacaagtcgtcttcgtcgtggctccgaacgtcgtgactaaccgtacgccctaccgagaacctaacttctcgtggcctccgacgtctacgagggacgagtctagtatttagttctgttcgtctactatactgcgtaacgggaccagtcgtacggtttgggtcggtcgggtacgggacggtaccgtaagggttccacccggttcgtacggtacaccggcccgtacggtacctcccggtcccccgtcgggttacccaccgtttccgttccccgttaccccaccccgtttcccgcgttacccgg

SEQ ID NO: 289781 - DNA, 646 bp, Homo sapiens
  misc_feature: GYAE6OF01EO2FS.45.38.D05.1.454.CMB.1.raw
  modified_base (311)..(311): a, c, t, g, unknown or other
  misc_feature (311)..(311): n is a, c, g, or t
  modified_base (376)..(376): a, c, t, g, unknown or other
  misc_feature (376)..(376): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggtttgggagtttttagttttgtctcctggtaccaacaaccgacccggcgaacgcccccaaactaatctatttanagggacactaaggccggtcccgtcgggggtttcaagttcgcttctctggctccaagtctgcaacncggccctcctgactaatctctcgggctccgaggtcctcgaaggacgaggctgtatttagtttctgttcgctctatacgtgaccgagggtacccaggtaccgtacggtttaggggtcggttccggggtacgggtaacgggtaccgtaggggttccgaacccggttccgtaacgggtccgacggtaccccgaacgggtccctccggtccccccgttcggtacctacccgttccgttcccgttaccccctacccccgttcccgtcccgtaccg

SEQ ID NO: 289782 - DNA, 585 bp, Homo sapiens
  misc_feature: GYAE6OF01AJTIF.45.38.D05.1.454.CMB.1.raw
  modified_base (369)..(369): a, c, t, g, unknown or other
  misc_feature (369)..(369): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctaaaagctcagcctgcctccgtgtctgggtctcctggacagtcgatcaccatggcctgcactggaaccaacagtgatgttgggtagtttttagttttgtctcctggtaccaacaacaccccggcgaacgcccccaaactaactcatttataggacactaagcggccgtcggggtttcaagtcgtcttctctgctcaagtctggcacncgcctcctgacatctctggctccgagctcgaggacgaggctgattatttctgttnctctatntgcgacggacagctacgttgggtcgttcgggcgggaggaccgtaggttcgaccggttcgtacgggtccaacggcccgtaacggtccgttaccggtcccccgtcggtccaccgttcccgttccgtttacccccgccccttcccgtccgtacccgg

SEQ ID NO: 289783 - DNA, 880 bp, Homo sapiens
  misc_feature: GYAE6OF01DEHBV.45.38.D05.1.454.CMB.1.raw
tcagacgcgatcgacacgaccggtgctcgatttagtatctgatagttgggtttgggggacctcctgtgcaggaacatgaagcacctgtggttcctcctcctgctggtggcggctcccggatgcgtcctcgtcccagctgccaccgtgcgaggacgtccgggcccgaggacgtggtacgaacgtccgttacggacgtacccttcgtccctacgtacgttgcgtagtcgttcgtcgtcggtcgactccagttacgaagtagtagttacttaaggttaacgttttgggcctcgggtaccgccccgacggaccccgggagggtaacggggcttggggtaaggttgggtaacgtttggggtaacctttacgttaccgtttaaccgtacggttaacggttaaccgggaaccctttaaccgttaacgttaacccgtaccccggttccccgttaaccccgtaacgtaaccggtaacgttaccggtacgttagggtacgtaacttacgtaaaaccaaacgttaaaacccgaacgtaaacccaaacgttaaccctaaccgtttccgtaccgtacgtacggtactacgtacgttcgtacgtaccgaaccggtaccgaacgtacccgaaacgtaccttaaagttacgttaacgtcgaggtaacgaagggtacgtacggaccgtttagtaacgtttcgttacccgtacgtaccgggtacggtccgggtaacccgttcgggtaacccctacggtacccgtaccgtaccgtacccgtccgtacccgtacccgtaaccggaacccgtacggttccccgttaacgttccccccggttacccgtacccccgtacccgtacctaacccccgtacgtaccgaacgtcccgttaccccggg

SEQ ID NO: 289784 - DNA, 581 bp, Homo sapiens
  misc_feature: GYAE6OF01CRJ3F.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcagggagtcgggcccaggactgggtgaagccttcggagaccctgtccctcacttgcagtgtctctggtgactccatcagtagtagtcaattaaagttttggggctgggtccgccagcccccgagggaaggggctggagtggattgggactgtctactcgtagtcggacctacctattaccagcccgtccctcaacgactcgactggtgatctacaaataaacacgtaccaagaaccaattctccctgacgtctagaactcgtgtcgacccgcgcgacaccggcaaatattactgtgacgaagagagggctaggaactttacgtcctttagaccctacgtcgggccttcgggaccctggtcctaccggtctcctcacgccctaccgaccgaacggcccctatccggtccttccccgtccgg

SEQ ID NO: 289785 - DNA, 587 bp, Homo sapiens
  misc_feature: GYAE6OF01E2EV3.45.38.D05.1.454.CMB.1.raw
  modified_base (229)..(229): a, c, t, g, unknown or other
  misc_feature (229)..(229): n is a, c, g, or t
  modified_base (543)..(543): a, c, t, g, unknown or other
  misc_feature (543)..(543): n is a, c, g, or t
  modified_base (545)..(545): a, c, t, g, unknown or other
  misc_feature (545)..(545): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactgggtgaagccttcggagaccctgtccctcacttgcagtgtctctggtnactccatcagtagtagtcattaaattttggggctgggtccgccacgcccccgaggggaaggggctgggagtggattgggacttttgtctactctagtgggaccacctattacacgcccgtcctcaacgactcgactggtgatctacaataaacacgtaccaaagaaccaattcctccctagacggctagaacctctgtacgaacgccgacggacaccggaccaaatacttactgtgacaagaggacgggcctaggaatttactacctttagaccacgtcggggcctcgggaaccctggtcctacccgtctcccncncgccctccaaccgacgggcccagtcccgtccttccccgtcgg

SEQ ID NO: 289786 - DNA, 624 bp, Homo sapiens
  misc_feature: GYAE6OF01D8J3F.45.38.D05.1.454.CMB.1.raw
  modified_base (305)..(305): a, c, t, g, unknown or other
  misc_feature (305)..(305): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcacatggcctgcactggaaccaacgagtgatggttgggattataaccttgtctcctgtaccaacagcacccagacaaacgcccccaaactcatgtattangaggcagtaacgcggccctcgtacgggtttactaatcgctttctcgtggctccgaagtctggctaacgccgccctccgtagactaactctcgtcgggtcctccgaggcgtaggaacgggacgacgggacttagtatttaagttaccgtgtcctgtacctactattatacgtacgtaagggttaagttacgtttacgtttcgggttcggttacggggtcggggaacgggtacccgaaggtccgtacggacccgttaccggtacgggtaccgacggaccccgtaacggcccgttacccgtcccccgttcggtccctacccg

SEQ ID NO: 289787 - DNA, 699 bp, Homo sapiens
  misc_feature: GYAE6OF01DF2T8.45.38.D05.1.454.CMB.1.raw
  modified_base (215)..(215): a, c, t, g, unknown or other
  misc_feature (215)..(215): n is a, c, g, or t
  modified_base (570)..(570): a, c, t, g, unknown or other
  misc_feature (570)..(570): n is a, c, g, or t
  modified_base (635)..(635): a, c, t, g, unknown or other
  misc_feature (635)..(635): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctccggatgcgtcctgtccagctgcacctgcagggagtccgggcccaggactgggtgaacgtccttcggacgacccttcgtccctnacttgctagtcgtctctggtgactccatcgaggtagtagtactaagttaaggttttcggggcgtcggggtccgaccgacggaccccggagggggaacggggtcgtagggaggtggtagttcggactgtctactcgtaggtcggacctactacttacacgccccgtacctacgaacgtctacgtagtcggtatactactaacaaataaaccacgtacgaaacaacctaacttccctaccgtaggtacgtaccgtacgtaccttcgtcgtaccggacccggccggtaccggaacggaaccgaacctaaattacgttacgtgtacgacgaaggacggacggtaccgtaggtaactttnttacccgttacgaccgtcggtcggaccggttacggaccgtcggtacctaccggttcctcgtaccnccgtaccccgtaccgaacccggtaccggtcccgtaccgttccccgttcccgtccccggtacccg

SEQ ID NO: 289788 - DNA, 841 bp, Homo sapiens
  misc_feature: GYAE6OF01EA341.45.38.D05.1.454.CMB.1.raw
  modified_base (231)..(231): a, c, t, g, unknown or other
  misc_feature (231)..(231): n is a, c, g, or t
tcagacgcgatcgacacgaccggtgctcgatttagtatctgatagttggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatcggcctgcactaggaaccaanagtgattggttgggtagtttttagtttgtccttccgtaggtaaccaacaaccgaccccggacgaaaccgacccccaaaactaactcctaattttaacgaacggggaacctaacgtaacggccgggtaccccggttacggggggttttaccaaacggttccgtccttttccgtccgttcgggcccttacccgaaaggttccgtacgggacctaaaccgacccgggtcccctacccgttagaacctaaacgttcccgtacggtcggggtcccttacccggacgggtccgttaccggaacgggtaaccggtacgggtaccgttaggttaacttttaacgtttaccgttcgtaccgttacggtaccttacgtaacgttacgtcggtacgttaagggtttacggttaacggtttaaccggttttcggggttcgggtttaccggggacggggtaacgggtaacccgtaaggtacccggttaccgggtaaccccgttaccggttaacgggtaccgaaccggtaccccggtaacgggtcccgttccccggtaccccccgttcggtaccctaccgtttcccgttcccggttaccccccgtccccgttcccgttacccgg

SEQ ID NO: 289789 - DNA, 700 bp, Homo sapiens
  misc_feature: GYAE6OF01CPSD4.45.38.D05.1.454.CMB.1.raw
  modified_base (158)..(158): a, c, t, g, unknown or other
  misc_feature (158)..(158): n is a, c, g, or t
  modified_base (415)..(415): a, c, t, g, unknown or other
  misc_feature (415)..(415): n is a, c, g, or t
tcagacgcgatcgacacgaccggtgctcgatttagtatctgatagttgggtttgggggggggtcacaagaggcagcgctctcgggacgtctccaccatggcctgggctctgctgctcctcactctcctcactcaggacacaggatcgtgggccctttngccctgactcagcctgcctcgtgtctgggtctcctggacagtcgatcaccatcggcctgcacgtcggaaaccaacagtgagttggttggggttagtttttagtttgtcttccgtcggtaacctaacaaccgaccccggacgaaccgacccccaaaacttaactctaatttaacgtaacgggaacctacgtaaacggccggtcccgttcgggggtttacaacgtccgtcttctcgtggctccgaagtctcggacaacnccggcctcccgtagactaactccgtacgtcgggcctccgaggtcctacgaggacggaggtctagtatttattcgtgttctcgtctatagtcgcgaacggacctagacgttacggttcggggttcggttacggggtcgggtacgggtaccggtagggttccggtacccggttaccgtaggtaccgaccggtacccggtaacggtcccgtacccggtcccccgttaccgggtacctacccgttcccgttacccgttccccctacccccgttccgttcccgtacccgg

SEQ ID NO: 289790 - DNA, 582 bp, Homo sapiens
  misc_feature: GYAE6OF01BTTKH.45.38.D05.1.454.CMB.1.raw
  modified_base (312)..(312): a, c, t, g, unknown or other
  misc_feature (312)..(312): n is a, c, g, or t
  modified_base (377)..(377): a, c, t, g, unknown or other
  misc_feature (377)..(377): n is a, c, g, or t
  modified_base (433)..(433): a, c, t, g, unknown or other
  misc_feature (433)..(433): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggtagtttttagttttgtctcctggtacccaacaaccaccccggcgaacgacccccaaataatctatttanagggacactaagcggtcccgtggggtttcaagtcgcttctctgctcagtctggcacacgcctccngacatctctggctccgagcctacgaggacgaggctagtatttagtttctgttgctnattatgcagggaccagtctacgttgggtcggttcgggacgggtagggactagggttcgaccgtccgtaggtccacggcccgtaacggtccgtccggtcccccgtcggtcctaccgtccgttccgttcccccgtccctccgtccgtaccg

SEQ ID NO: 289791 - DNA, 648 bp, Homo sapiens
  misc_feature: GYAE6OF01EEWNI.45.38.D05.1.454.CMB.1.raw
  modified_base (233)..(233): a, c, t, g, unknown or other
  misc_feature (233)..(233): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggacgaccctgtcccctcacttgccagtgtctctggtnactccatcagtagtagtctattaaagttttggggcgttgggtcccgccacgccccgaggggaacggggctggagtggagttgggacttggtctactctaggtcggaccacttattacacgcccgtcctacaacgactcgactggtgatctacaactaaacacgtaccaaagaacctaattcctccgtagacggtctacgtaactctgtacgaccgccgcggacgaccggacctaaattacttacgtgtacgacgaaggacggtacgggtaccgtaggtaactttaccttccgtttacgaccgtacggtcggggtaccgttaccgggtaacccgttgggtccctaccggttccctcccggtaccaccgtaccctacccgaacccgaaccgggccctaacgttcccggttacccccg

SEQ ID NO: 289792 - DNA, 622 bp, Homo sapiens
  misc_feature: GYAE6OF01BZ16V.45.38.D05.1.454.CMB.1.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtggccctttctgccctgactcagcctgcctccgtgtctgggtctcctggacagtcgatcaccatggcctgccactggaacccaacagtgagtggttgggtatttttagtttgtctccgtggtaccaacaacaccccggacgaacgcccccaaactatcatttataggacactaacgccggccgtcggggtttcaagtcgtcttctctgctccagtctggcaacgacgcctccctgaacaatcctcgtcggcctccgagcctcgaggacgaggctgtatttactttctgtttcgtctctattagtcgacgacgggaccacgtcgtacggtttgggtcggttaccgggcgggtacgggtaccggtagggttccgaccggttccgtacggtaccgacgtaccccgaaggtccgtcccggtcccccgtcggtcctaccgttcccgttaccggttcccccgccccttcccgtccgtacccg

SEQ ID NO: 289793 - DNA, 889 bp, Homo sapiens
  misc_feature: GYAE6OF01DMKWC.45.38.D05.1.454.CMB.1.raw
  modified_base (206)..(206): a, c, t, g, unknown or other
  misc_feature (206)..(206): n is a, c, g, or t
tcagacgcgatcgacacgaccggtgctcgatttagtatctgataggttggggtttgggggggggtcacaagaggcagcgctctcgggacgtctccaccatggcctgggctctgctgctcctcactctcctcactcaggacacaggatcggtcgggtccctttctcgccctgactcagcctcgcctcgtgtcgtgggtctcgtgacngtcatcacagtcggcctgcacgtacggaaccaacgtagtgtagttggtttagggttagtttttagtttcgttcgttccttagggtaaccctaaaccgaaccgtaccccggacgtaaaccgaccccctaaaactaactactaacgtttaagtaacgggaacctaaccgttaacggccgggtcccggttacgggggtttacaacggttccgtactttccgtcgtcgggtaccttaccgaacggttcgtacggaacccgtaaccgtacccgggtcccttaccccggtaaggaaccctaagtttaccccgtcggttaccggggtccgtaccgtacgggtccgtacggaacggggtacggtacgggtacggttacgtttaacttttacgttttacggtggtttcggtaccttacgtaacgtttaagtccggtacggtaaccgggtaacgtacgggtacggttacggtttacgggggttaccggttacggggggaccgggtaacgggtaacccgggtacggggtttaccgggtaacccgggttaccggttacgggtacccggtaaccggtacccgggtaaaccggtcccggttaccccgggtccccggtttaccgggtacccgttacccggtttcccggttaccccgttacccccgttaccccgtttccccggttccttaaccccgggg

SEQ ID NO: 289794 - DNA, 606 bp, Homo sapiens
  misc_feature: GYAE6OF01A3KBG.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagacccctgtccctcacttgcagtgtctcgtggtgacctccatcagtagtagtctaattaaagttttggggcgtcgggtccgccgacgccccgaggggaagggcgtggaggtggagttgggactgtctactcgtaggtcggacctactatacgacgccccgtcctacgaacgactcgactggtgatctacaactaacgaccgtacaacgaactacttcctacctgacgtctagactcgtgtcgaccgccgacgaccgacgtacaattactacgtgtgacgaggaagtacggactagggtaacttacttccgttacgaccgtacggtcgggtccgtaccgggtacccgtcggtccctacgtccctccgcgtaccgcctacccgacgaccggccctcgtccggttcccccg

SEQ ID NO: 289795 - DNA, 1017 bp, Homo sapiens
  misc_feature: GYAE6OF01BN1K0.45.38.D05.1.454.CMB.1.raw
tcagacgcgatcgacacgaccggtgctcgatttagtatctgatagttggggttttgggggggggtccacaacgagggcagcgctcttcgggacgtctccaccatggcctgggctctgctgctcctcactctcctcactcaggacacaggattcggttgggtcccttttctcgcccttagactcagcctgccgtcgtgtcgttgggtctccgtcgggactagtcgactcaccgtagtcggcctgcctacgtacggaaaccaacgagtcgtagttgggtttaggggttagttttttacgttttcgttcccttccgttacgggttaacccaaaccgtaaaccggtacccccgggtaccgaaacccggtaccccccctaaaaaacttaaacttacccgttaaagttttaaacgggaacgggggtaacctaaaccggttaaacgggtcccggggtaccccgggttttaaccgggggggttttacctaaaacgggtttccgtaccgttttcgttaccgtcgggtacccttaacccgtaaggttccgtacggaaccgtaaaccgcccgggtaccccttacccgtacgaaaccttaactccgtccggttcggggaccttaccggaacggtaccgtaccggaacgggtaaaccgggtaacggtcctttaaggttaacttttaacgtttttcggtcgttttacgacctttaaggtaacgttacgtcggaaccggtaaccgggtaacccggaacggtacgtttaacggggttttcgggggtttacgggtttaccgggggtaacgggggttaaaccggggttaacccgggttaaacggggtttaccgggtaacccgggttttaccggtaacgggtttcccgggaaaaccgggttaccccgggttaacggggtccccgttaccccgggtccccccgggtttagggttacccccgaaccgggttttcccccggtacccccggttttaacccccccggtcccccgtttcccggttccccggtttaaacccgg

SEQ ID NO: 289796 - DNA, 719 bp, Homo sapiens
  misc_feature: GYAE6OF01CFM7I.45.38.D05.1.454.CMB.1.raw
  modified_base (157)..(157): a, c, t, g, unknown or other
  misc_feature (157)..(157): n is a, c, g, or t
  modified_base (236)..(236): a, c, t, g, unknown or other
  misc_feature (236)..(236): n is a, c, g, or t
  modified_base (430)..(430): a, c, t, g, unknown or other
  misc_feature (430)..(430): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttntcgccctgactcagcctgcctcgtgtctcgggtctccgtggacagtcgatcaccatcggcctgcacgtaggaaccaagngtgtagtggttagggtattacttaccgttgtcctacgtcggtaaccacacggacaccgagaccaacgaccccaactcatcgtattatggaggacaggtaacgccgtaccgtacggtacgggttactaacgtcgtaccgttcgtcgtcggtacctacgtaagtccgtaggaccgtaacgtccggtcccttaccgnggtaaacctacttccgttcggtacgggtccttaccgggacgttacggtacggacggggtaacgtaccgggtcgttacgttaacgtttaacgtacgtgttaccgtgtcctacgtaataggtacgtacggttaagggttacgtttagggtttcgttagggtcgggttaccgggacgggtaacggtaaccgtacggtaccggttacggtacccggttacggttaaccggtaccggaaccggtacccgtacgggtcccgtaccccggttccccgtgggtccctttaaccccgg

SEQ ID NO: 289797 - DNA, 727 bp, Homo sapiens
  misc_feature: GYAE6OF01C3Q64.45.38.D05.1.454.CMB.1.raw
  modified_base (234)..(234): a, c, t, g, unknown or other
  misc_feature (234)..(234): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtccgggcccaggactggtgaagcctttcggacgcccctgtcccctcacttgctagtgtctcgtggtnactccatcagtagtagtctaagttaaagttttgggcgtcgggtcccgccgacgcccccggaaggggaacggggtcgtgggagtcggtagttgggactcgtactacgttcgtaggtcgggacctacttattacgacgccccgtcctacaacgtactcgtacgtggtgtactctacaaataaacgacgtaaccgaacgtaacctaacttcctacccgtagtacggtactacgtaactcgttcggccgtacccgccggtacggaaccgtaccggacctaaagttacttacgtggttacgaacgaacggtaaggtacgggtaccgttaagggttaactttcgttaccgtttacgacccgtacgggtccgggtacccgttaccgggtaacccgtcggtaccgtaccgttcccttacccgtacgtaccgtacccctacccgaaccgtaacccgggtacccctaccggtttcccggtccccgtttacccccgtacccggg

SEQ ID NO: 289798 - DNA, 817 bp, Homo sapiens
  misc_feature: GYAE6OF01ES1A9.45.38.D05.1.454.CMB.1.raw
  modified_base (233)..(233): a, c, t, g, unknown or other
  misc_feature (233)..(233): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggtccctttctgccctgactcagcctgcctccgtgtctgggtctccgtggacagtcgatcaccatggcctgcactcggaaccaanagtgattggtttggggtagttttttagttttgtccttccgttaggtaaccaacctaaccgaccccggacgaaaccgacccccaaaactaactctaatttacgtaacgggaactacgtaacggccggtacccgttcgggggtttaccaaaggttccgtctttccgtcgttacgggccttaccgaagttccgtacggacctaaaccgaccggtccctcccgtagaacctaattccgtcgttcgggccttaccgacggtcctacgaacggacggacgggtcttaggtaacttttactttcgttagtttcgtacttacgtaagttagtcgggaccggggtaacccgtaacggccgttaacgggtttcgggggttacggttaccgggggaccggggttaacggggacccggttagggttacccgggtacccggttacggttaacgggtacccgtaaccgggtacccccggtaaacgggtcccggttaccccggtccccccggtttcgggtaccccgtaacccgtttccccggttacccggtttcccccccggttaccccctttacccgttcccgtcccggttaacccgg

SEQ ID NO: 289799 - DNA, 734 bp, Homo sapiens
  misc_feature: GYAE6OF01BDRHV.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctccggatgcgtcctgtcccagctgcacctgcaggagtccgggcccaggactggtgaacgcctttcgggacgaccctgtcccctcacttgcagtcgtctcgtggtgacctccatcagtagtagtactaattaaagtttgggcgtcgggtccgccgacggaccccgaggggaacggggcgtaggaggtggtagttgggacgtgttctactcgtacggtacggaacctaccgtacttagacccccccccccccccccggtagtccccgtacgaacgtaccgtcgtacgtggtacgtactactaactaaactaaacaaccgtaccaaacgaaacctaactttaccctacccgtacgacggtactacgtaactcgtacggtacggacccggccggacggaaccgaaccggaacctaaattacgttacgtagtacgacgaaggacgggacggtaccgtaggtaacttacgttaccgtttacgaaccgtacggtccgggtaccggtaccgggtaccgttccggtacccgtacccggttcccttacctaccgtccgtacccgtacccgaacccggaccggtaccctacgttcccgtcccgttccccgtccgg

SEQ ID NO: 289800 - DNA, 722 bp, Homo sapiens
  misc_feature: GYAE6OF01C053Y.45.38.D05.1.454.CMB.1.raw
  modified_base (249)..(249): a, c, t, g, unknown or other
  misc_feature (249)..(249): n is a, c, g, or t
tcagacgcgatcgacacgaccggtgctcgatttagtatctgatagttggtttggggggggtcacaagaggcagcgctctcgggacgtctccaccatggcctgggctctgctgctcctcaccctcctcactcagggcacagggtcctgggcccagtctgccctgactcagcctgcctcctgtctgggtctcctggacagtcgatcaccatcccctgcactggatccgagcggtgacgttatgttttaagntgtctctggtatcagacaacaccaggacaaacgccccaaactcatctatttatgatgtacaataacgtccggtccctacgtacgggtttctcgtacgtccgtctttcgtcttcggaccttaccgaaagttccgtaggtacctaacgttaccggccccttccgtacgacctacttccgtacgtcgggaccttccgacggtcgttaacggaacgaacggtacggtacgttaggttaactttaacgtttacgtcggtaaccaacgtacctaacttaacttaacgttttaacggttttacggtttaccgttttaccgtaacggttttaccggggtttaacggttccggggtaacggggtaaaccgggtaaccgttaacggttaccggtacccggttaccgttaacgggtcccgaaccggtaccccgtaacggtcccgttacccgtcccccgttaccggtccttaacccgtttccccg

SEQ ID NO: 289801 - DNA, 886 bp, Homo sapiens
  misc_feature: GYAE6OF01EHEFZ.45.38.D05.1.454.CMB.1.raw
  modified_base (240)..(240): a, c, t, g, unknown or other
  misc_feature (240)..(240): n is a, c, g, or t
  modified_base (804)..(804): a, c, t, g, unknown or other
  misc_feature (804)..(804): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcgaggacgtcgggcccaggactggtgaagtccgttcggacgtaccctgtcccctcacgttgctagttgtcctcgtggtnacctccatcgagttagttacgtactaagtttaagttttggggccttgggtcccgccgaaccgccccccggaaggggaacgggggtctagggtacggtagggtacggtttggggtaccgttcggttaccgttaccgttaccggttacgggtaccgggtaacccttaaccgtttaacgtttaaccgacccgtacccccggttccctaaccgaaaccgtaccgttaccggaacgttcgggttacgtacctaccgtaactaaaaacttaaacccgtaaccgttaaacccgaaaaccggtaaaacccttaaactttaccccgttaccccgttaagggtaccgggttaccttaacggtaaacccgttccgttacggtaccggtaaccccgggcccggaccgggaaaccgtaacccggaacgttaaacgtttacgttaaccgtgtacgaacgtaacggtacggtaacgggtaccttaggttaaacgtttccttaccggtttacgacccgtacggtaccgggtaccgtaccgggtaacccgttcggtacccttacccggccgtttaccccgngtaaccccgtcccgtaccggtaaaaccccggcccgggtaccccgtacccggtttccccggttccccgtacccccgtccccgg

SEQ ID NO: 289802 - DNA, 585 bp, Homo sapiens
  misc_feature: GYAE6OF01ANYPT.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttggagaccctgtccctcacttgcagtgtctctggtgactccatcagtagtagtcattaaagttttggggctgggtccgccagcccccagggaggggctggagtggattgggactgtctactctagtgggaccacctattacagcccgtccctcaagactcgactggtgatctacaaataaacacgtaccaaagaaacccaagttcctccctagaggcctggaaccttcgtgtcgacccgccgcggacaacggccaaatattactgtcgacaagagacggcctagggtaattacgttcctttagacctagtcgggcctcggggaaccctgggtaccaccgttctccctcgacgccctccaccgaacgggcccatccggtcccttcccccgtacgg

SEQ ID NO: 289803 - DNA, 707 bp, Homo sapiens
  misc_feature: GYAE6OF01CWQ5I.45.38.D05.1.454.CMB.1.raw
  modified_base (248)..(248): a, c, t, g, unknown or other
  misc_feature (248)..(248): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctccggatgcgtcctgtcccagctgcacctgcagggacgtccgggcccaggactgggtagaacgtcccgttacgggacgacccttcgtcccctctacttgctagttcgtctcgtgggtnacctccatctagtagtagtctaatttaagtttgggcgtcgggtccgccacgcccggagggaacggggcgtagggtaggtggagttggggacttcggttcctacgtacgtacggtacgggacctaaccgttattaccgaccgtcccgtaccctactaacgaccttcgacgtggtatactactactaaaagtaaaccacgtaacctaaactaaccgtaacttcccgtacctacggacgtccgtagtaacctcgtaggaccgtacccggccggacgtaaccgacggaacctaaattacgtaacgtgtacgaacgaagtaagggacggtcgtaagtacttacgtactacgaacgtcgtagggtccgtacggtaccgtcggtcctaccgtcctccgtacgaccgttccccacgacccggtaaacgggtcccttaacggtccccggtttcccttcccccggtccg

SEQ ID NO: 289804 - DNA, 783 bp, Homo sapiens
  misc_feature: GYAE6OF01CK6OM.45.38.D05.1.454.CMB.1.raw
  modified_base (234)..(234): a, c, t, g, unknown or other
  misc_feature (234)..(234): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctccggatgcgtctgtcccagctgcacctgcaggacgtccgggcccaggactggtagaagccgttcggagtaccctgtccctcacttgcagttgtctcgtggtcnctccatcagtagtagtactaagttaaagtttggggcgttcgggtccgccgacggtcccccggaaggggaacggggcgtggaggtggtagttgggactgtctacgtcgtacggtcggaacctactaacgttaccgaccggtcccccgtacctacgaaaccgtacgtacgtacgttggtacgacgttactaacgaaaactaaaccgtaccgtaacccaaaagtaaaccctaactttcccgtacccgtagaccggtctacgtaacctcgtacggtcgtaccccggacggacccggtaaccgaccggtaactaaagttacttacgtacggtacgaacggtaaaggtacgggaacgggtaccgtaagggtttaaacttttaaccgttccgttttaaccggacccgttacgggtacggggtaccccgtaccgggttaacccgttcccgggtaccgttaaccccggttccgccgttaccgacccgttacccccgtaccgaaccccggtaccggccccgtttaacgttccccggttccccgttcccccggtaaccgg

SEQ ID NO: 289805 - DNA, 568 bp, Homo sapiens
  misc_feature: GYAE6OF01CRSK2.45.38.D05.1.454.CMB.1.raw
  modified_base (228)..(228): a, c, t, g, unknown or other
  misc_feature (228)..(228): n is a, c, g, or t
  modified_base (300)..(300): a, c, t, g, unknown or other
  misc_feature (300)..(300): n is a, c, g, or t
  modified_base (307)..(307): a, c, t, g, unknown or other
  misc_feature (307)..(307): n is a, c, g, or t
  modified_base (346)..(346): a, c, t, g, unknown or other
  misc_feature (346)..(346): n is a, c, g, or t
  modified_base (357)..(357): a, c, t, g, unknown or other
  misc_feature (357)..(357): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgatgttaggagttataaccttgtctctggtaccaacagccaaccaggaccaaacgccccaaatcatntatttanggaggcagtaagccgcctgagggtttcagtcgtcttctntgctacagtcnggacacgcgcctcctcgaactactctcgtggtcctcgacgcgtaggacggacgaggctagtattacgtactgctcgactctaatatgacgtaggttagtaacgtttacggttgggtcggttcgggacgggtacggacgaggtccgtacgtaccggtacctacggtacgaccggtcccgtaaggcccgtcccggtccccgttccgggtaccc

SEQ ID NO: 289806 - DNA, 711 bp, Homo sapiens
  misc_feature: GYAE6OF01B5OMK.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccagggactggtgaagccttcggacgaccctgtccctcacttgcagtgtctctggtgactccatcgagttagtagtctaattaaagttttggggctcgggtccgccacggaccccgaggggaacggggctgggagtgggagttgggactggtctactgtagtcgggaccacctattaccgacgccccgtccctacaacgactcgactggtgtatcgtacaaactaaacgaccgtaccaaacgtaacctaacttacctcccgtaggacggtaccgtagtaaccttcgtacggtccgacccggtcccggaccggaacccgaaccgggtaaccctaaaagtttaacttaaccgttggttacgaacgtaaaggaacggacggggtacctagggtaaactttacgttaccgtttacgaacccgtacgttaccgggggtccgtaccggggaaccccttgggtacccgtacccggttccttcccgtaccgacctccccgtacccgaacccggtaacgggccccctaagtccccggttaccccg

SEQ ID NO: 289807 - DNA, 849 bp, Homo sapiens
  misc_feature: GYAE6OF01C46WR.45.38.D05.1.454.CMB.1.raw
tcagacgcgatcgacacgaccggtgctcgatttagtatctgatagttgggtttggggggggtcacaagaggcagcgctctcgggacgtctccaccatggcctggctctgctgctcctcactctcctcactcaggacacaggatcggtcggtccctttctcgccctgactcagcctcgcctccgtgtcgtcgggtctcgtggacagtcgactcacagtcggcctgacactacggaaaccaagagtgagtggtttaggtagttttttagttcgtcttcctacggtaacctaacaaccgacccggaccgaaccgaacccccaaacgttaaactactaagtttaacgaacgggtaacctaactaaacggtcccggtcccggttaccggggggttttaccaaacggttccgtcttccgttaccgtcggtacctaccgtaaagttcccgtacgggaacctaaacccggtaccccggtacccttacccccggtataaccgttaaacgtcccgttaacgttccggggaccttacccggaagggtacccttaccgggaaacggggtacgaaccggggtactttaggttatttttaaccgttttcgtagtttcgtaccttacgtaagttacgtcgggaacgtaccgggaacgtaccgtacgtttaacgggtttacggggtcggtttaccggggacggtaacggggaacgtttacgggtaccgtaacccggttaccgttaggtcccgtaaaccggaccccggaacgggttcccgtaccccggtccccccgttaccggtacccgttacccgttcccggtttacccgttacccccgttcccctaccgttccgttaaccccgg

SEQ ID NO: 289808 - DNA, 694 bp, Homo sapiens
  misc_feature: GYAE6OF01EAW58.45.38.D05.1.454.CMB.1.raw
  modified_base (209)..(209): a, c, t, g, unknown or other
  misc_feature (209)..(209): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccatcggagaccctgtccctnacttgctagtgtctcgtggtgactccatcagttagtagtacaagttaaagttttggggctcgggtccgccacgccccgaggggaagggtcgtggacgtggtagttgggactgtctacgtcgtaggtacgggaccctaccttagttacacggtaccccgttacccgtacaacgtactcgacgtcggtagactctacaaactaaacacgtaccaaacgtaacctaacttcctacccgtagacggactacgaacttcgtagttcggacccgccggacggaaccaccggtaaccctaaatacttacgtagtacgacgtaaggaggacgggtacttaggtaaactttacgttacctttaggaaccctacggtcggggtacccgtacggggtaaccccttggtacccgtaccggttcctcccgtacgccggtacccctacccgtaacccggtaacgggcccctaccggttcccggtccccgttccccccgg

SEQ ID NO: 289809 - DNA, 800 bp, Homo sapiens
  misc_feature: GYAE6OF01DLYND.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgccgtcctgtcccagctgccacctgcaggacgtccgggcccaggactggtagaacgtccgttcggacgacccttcgtcccctcacttggcagttgtccttcgtggtacgaccttccatacgtaagtagttacgttacaagttttaaaggtttttgggggccgttcggggtcccgtaccgacggcccccggaaggggaacggggccgtagggaggttagggtagttacggggtacgttcggtacgttaccgttacgttacgggtccgggtaacccttaacccgtaacgtttaccgacccggtacccccggttacccctaccgaaaccgtaaccttccggaacgttgggtacgtactacttaactaaaactaaaaccgaaccgtaaccgaaaacgtaaacctaacgttccctaccgtagtaccgtcgtacgtaactcgtggtaccgacccggaccgacggacgaacgaactaaattacgttaccgtgacgacgaagaggtaacggtccgtaaggttacttacgttccgttagacccgtaggtcgggtaccgtccggtaccgtccggtcccgtaccgttcccttcccgactacgtccccgtaacccgaaccccgggtaccggtcccctaacccgggttcccgttccccgtccccggttaccccgg

SEQ ID NO: 289810 - DNA, 945 bp, Homo sapiens
  misc_feature: GYAE6OF01AG45B.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtccgtgtccccagctgcacctgcgaggagtccggggcccaaggaccgtgggtagaacgtcccgtttcgggacgtaccccgttcgtcccctctaccgtttggccgtaggttcgttccttcgtggttagaccctttccaacgttcgtaaggttaacggttacggttaccaaaggttttaaaacggttttggggtcggtccgggggttcccgtcccgtaaccggtaccccccggtaagggggtaaacgggggtccgttacggggtacggttaggggttaacggtttacggggtaccgttcgggtttaccgttaaccgttaccggtttacggggtttacccggggaaccccttaacccgttaacgttttaaaccgtacccggtacccccggttccccttaacggtaacggtacccgttaccggaaccgttcgggttacgacttaccgttactaaaacgttaaccgaacggtaccctaaacggaaacccttacttaccgtcccttaggaacggtccgtaactaacccgttcgtacggtttaccggaccccggtaccggacccgggtaccgaaacccggtaccgtaaacttaccgtttacgttaccggtacggaaccgtaagggaacggtacgggtacctaagggtacgtttaaccgttccgttaaccgacgtacgggttaccgggtcccggttaaccgggaccgttaccggtacccgttcccgtaccgtttccccgtagccccggtacccgttacccgaacccggtaccggtaccctaaccgggttcccttacccgtcccccgtacggg

SEQ ID NO: 289811 - DNA, 798 bp, Homo sapiens
  misc_feature: GYAE6OF01CLBE3.45.38.D05.1.454.CMB.1.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcggtgggccctttctgccctgactcagcctgcctcgtgtctgggtcctcgtggacagtcgatcaccatcggcctgcactacggaaaccaaactggtagagttggttcggggttagttttttagttttgtccttaccgtacggttaaccaaaccaaccgaccccggacgaaacccgacccccctaaaaatactctaatttacgtaggaactacgtaacgcccggtcctacgttaggggtttactaacgtcctcgttacgtcgtggtccctaccgtaagtcgtacggaacaaccgtaccggcccttcccgagaacctaacttccgtcgtccggtcctaaccgtgggtaccctagggaacgggaccggtacggctttaggtaaactttaccgttaacgttggaaccttcgtaccttaactacgttaatcgggaaccgtaagggttaaggttttacgtttacggttttgggtaccggggtttacggggaccgggtaccggtaaaccgacggttacccgtaccgggtttacccgtacggtttaccggacggtaaacccgggtacccgaacgggttcccctcccccggttacccccgggtttaccgtacccttacccggtttccctcccccgggtttcccccggttaccccctttcccgg

SEQ ID NO: 289812 - DNA, 730 bp, Homo sapiens
  misc_feature: GYAE6OF01EPOUS.45.38.D05.1.454.CMB.1.raw
  modified_base (155)..(155): a, c, t, g, unknown or other
  misc_feature (155)..(155): n is a, c, g, or t
  modified_base (189)..(189): a, c, t, g, unknown or other
  misc_feature (189)..(189): n is a, c, g, or t
  modified_base (222)..(222): a, c, t, g, unknown or other
  misc_feature (222)..(222): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
tcagacgcgatcgacacgaccggtgctcgatttagtatctgatagttgggtttggggggggtcacaagaggcagcgctctcgggacgtctccaccatggcctggctctgctgctcctcactctcctcactcaggacacaggatcgtggccctttntgccctgactcagcctgcctcgtgtctggtctcngacagtcgatcaccatcgcctgcactgaaccanagtgatgtaggtacgtttttagttcgtctccgtaggtaccaacaaccacccggacgaaacgaccccccaaaacttaatccttaagttttaacgagggtaacctaacgtaaacggccggtacccgttcggggtttacaaggttaccnctttccncgttacggtcctaccgtaaggtccgtaggaccaaacgcccggtacctcccgtagaacgtaactccgtaccgttcggggaccttccggaggaccgtacgacggtaccgaggtctacgtatttaacttcgtagttcgtactacgtagtacgtacgcgtagggaacctacgacgtaacgtttcgggtcgttccggggtacgggtacgggaccgttacgggttaccggtaacccggttacgtaccggttaccgtaacggaccccgtaaacgggtcccctaccggtcccccccgtaccggtaccctacccgttacccgttcccgttaaccccctacccgttccccgttccgtaacccggg

SEQ ID NO: 289813 - DNA, 830 bp, Homo sapiens
  misc_feature: GYAE6OF01BFUQ7.45.38.D05.1.454.CMB.1.raw
tcagacgcgatcgacacgaccggtgctcgatttagtatctgatagttgggttgggggggttctacggaagaggcagcgcctactcgggacgtctccaccatggcctggctcgtcgctgcctcctcacctcgtcctcactacaggacacgagggactcggtggtccctttagcgacccgtgacttcagcctgcctccgtgtctcgggtctcctggactcgtcgactcacagtcggcctgctactcggaaccacgtagtgattggttggtagtttttcgtttcgtacctccgtaggtaaccaacgtaacccgtaccccgggtctaaaaccgtacccccttaaaagttaactacttaacgtttaaggaaccgggtaactaaccgttaaacggcccggtacccggttagggggttttaccaaacgtttcgtcctttacgtacggttaccggacttacccgaaggttccgacggaacctaaacgtccgggtcccttacccggtagtaactacgtccggttcggtacggccttaccgagggtccttaccggaacggtaccgtaagggtacctttaagtaacgtttacgtttaccggttaggtccggttacttaacgtaagttacggtttacggtacggttaaaccggtacctacggtaccgtacgggtttacgggttacggtaaccggggtcggtaacgggtaccgttacgggtcccgttaccgtaccgttacgggtaccgtacccgggacgttacgggtcccacccgggttaccccgacggttacccgaccgtttaccgtcccgttaccccggacccgttcccgttacgacccgg

SEQ ID NO: 289814 - DNA, 669 bp, Homo sapiens
  misc_feature: GYAE6OF01BU3BK.45.38.D05.1.454.CMB.1.raw
  modified_base (203)..(203): a, c, t, g, unknown or other
  misc_feature (203)..(203): n is a, c, g, or t
  modified_base (244)..(244): a, c, t, g, unknown or other
  misc_feature (244)..(244): n is a, c, g, or t
  modified_base (426)..(426): a, c, t, g, unknown or other
  misc_feature (426)..(426): n is a, c, g, or t
  modified_base (434)..(434): a, c, t, g, unknown or other
  misc_feature (434)..(434): n is a, c, g, or t
  modified_base (609)..(609): a, c, t, g, unknown or other
  misc_feature (609)..(609): n is a, c, g, or t
  modified_base (615)..(615): a, c, t, g, unknown or other
  misc_feature (615)..(615): n is a, c, g, or t
  modified_base (621)..(621): a, c, t, g, unknown or other
  misc_feature (621)..(621): n is a, c, g, or t
tcagacgcgatcgacacgaccggtgctcgatttagtatctgatagttgggtttggggctttctgagagtcacggacctcctgtgcaggaacatgaagcacctgtcggttcctcctctgctggtggcggctccggatgccgtcctgcccagctgccaccgtgcgaggacgtccgggcccaaggctggtagaagccttcggaacncccttcgtaccctgacgttcgctaggttcgtctcgtaggtnaccttccagttcaagttagtacgtactaaagttaaggttttgggacgtcgggtccaccgacggcccggaaggggacgggtactgggagtggtagttgggtaacttcgtacttacgtcgtaggtcggaacctactacgtaccgccgcccgtaccgtacacgtacgtacgtacgtggtacgtanaccgtaanaaactaacgacgtaacaaacgtaaacctagttcctaccgtaggacgtcgtacgtaacgtcgtacgtacggacccgacggtaccggaacacggaacctaaagtacgttacgtgacgacgtaagacggtacgcgtaagtactactctacgacgtcgacggcttacggaccgtcgacncccgtnccgtanccaccgtacaaaccggcgtaccgtagttccccgttccgtcccgtaccg

SEQ ID NO: 289815 - DNA, 690 bp, Homo sapiens
  misc_feature: GYAE6OF01DWYQU.45.38.D05.1.454.CMB.1.raw
  modified_base (389)..(389): a, c, t, g, unknown or other
  misc_feature (389)..(389): n is a, c, g, or t
  modified_base (479)..(479): a, c, t, g, unknown or other
  misc_feature (479)..(479): n is a, c, g, or t
tcagacgcgatcgacacgaccggtgctcgatttagtatctgatagttgggtttggggggggtcacaagaggcagcgctctcgggacgtctccaccatggcctggctctgctgctcctcactctcctcactcaggacacaggatcgtgggccctttctgccctgactcagcctgcctccgtgtctgggtctcctggacagtcgatcaccatggcctgcactacggaaaccaacagtgattggttgggtagtttttagttttgtctccgtggtaaccaactaaccgaccccggacaaacgaccccctaaactaactctaatttagtaacgggacaacgtaacgccggtcccgtacgggggtttcaacgtcgtcttctctggctcgaagtcnggtcaacgccgtcctcctagacaagtctcgtacggctaccgacggtctcgaaggaccgtaggcttagtattttagttcgtagttcgtctntaacttagtcgacgacgggaccaggtcgtacgtttaggggtcgttacggggtcgaaggggtaccttaggggttaccggaaccgttacggttaacgggtccctaaccgggacccggtaacggtcccgttaccgggtcccccccgttcggggttacccaccgttttaccccgttccgtttacccccccacccctttcccgtcccgttaccggg

SEQ ID NO: 289816 - DNA, 742 bp, Homo sapiens
  misc_feature: GYAE6OF01DZPO9.45.38.D05.1.454.CMB.1.raw
  modified_base (271)..(271): a, c, t, g, unknown or other
  misc_feature (271)..(271): n is a, c, g, or t
tcagacgcgatcgacacgaccggtgctcgatttagtatctgatagttgggtttgggggcttttctgagagtcacggacctcctgtgcaggaacatgaagcacctgtggttcctcctcctgctggtggcggctccggatgcgtcctgtcccagctgcacctgcaggagtcgggcccaggactggtgaagccttcggacgaccctgtccctcacttgcagtcgtctctggtgactccatcagtagtagtcaattaagtttggggctgggtccncacgccccgaagggagggctggagtggattgggacttcgtcttacgtcgttaggcggacctacgtattaacgccgtccccgtccctaacaacgtaccgtcgtacgttgggtagtacttactacgaaaactaaaccgtaccgttaacccaaacgtaaaccgttaattccctacccgttaggacggtactacgtaccttcggtcgtaccggacccggccgaccgggaacccaaccgggtacctaaaagtttaccgtttaacgtcggtacgtaacgaacggacggtaacgggtcgtttaagggtaaacttttccgttccgttttacgaacccgtacgggtcggggtaccgtaccggggtaacccgttcggtaccgtaccccgttcgttccctaccgcccgtaccccgtacccgaaaccccgggaccgggtacccccttagggttcccccggttccccgtttccccccggaccgg

SEQ ID NO: 289817 - DNA, 806 bp, Homo sapiens
  misc_feature: GYAE6OF01CLUXE.45.38.D05.1.454.CMB.1.raw
tcagacgcgatcgacacgaccggtgctcgatttagtatctgatagttgggtttggggggggtcacaagaggcagcgctctcgggacgtctccaccatggcctggctctgctgctcctcactctcctcactcaggacacaggatcgtgggcccagtctgccctgactcagcctgcctccgtgtctgggtctcctggacagtcgatcaccatctcctgcactggaaccagcagtgattggttggtagttactaaccttgtcctcctaggtacccaacgacgccacccgagaccaaaccgccccccaaactcatagtaatttagtggacgggcaacggtaacggcccggccctcggtacggggtttactaacgtccgtctttccgttcgtcggtcctaccgtaacgttccgtacggaccgaaccgtacccggtcccctttaccccgtacgtaacctaacgtttcccgttacgggttccggggtacccttacccggacggggtaccgttacggggtaaccgggtaaccgggtacgggtaccgttaaggtttaaacgtttacgttttaaccgttcggttaccttccggtaccctttacgtagttacggttacgtaaccggttaaggtttacggttttaaccggtttacggttttcggggttacgggtttaccggggaaccggggttaacggggtaaccccgtaacgggtacccggttacccgggttaccccggttaccggttacggttacccgaacccggtaccccgggttaacggtcccccgtccccggttaccccccggtttccccggg

SEQ ID NO: 289818 - DNA, 640 bp, Homo sapiens
  misc_feature: GYAE6OF01EB2RA.45.38.D05.1.454.CMB.1.raw
  modified_base (230)..(230): a, c, t, g, unknown or other
  misc_feature (230)..(230): n is a, c, g, or t
  modified_base (457)..(457): a, c, t, g, unknown or other
  misc_feature (457)..(457): n is a, c, g, or t
  modified_base (481)..(481): a, c, t, g, unknown or other
  misc_feature (481)..(481): n is a, c, g, or t
tcagacgcgatcgacacgaccggtgctcgatttagtatctgatagttgggtttggggggggtcacaagaggcagcgctctcgggacgtctccaccatggcctaggctctgctgctcctcactctcctcactcaggacacaggatcgtgggccctttctgccctgactcagcctgcctccgtgtctgggtctcctggacagtcgatcaccatggcctgcactggaaccaangtgatggttggtagtttttagtttgtctccgtggtaccaacaaccaccccggcgaacgacccccaaataatctattataggacacgtaagccggcccgttacggggtttcaacgtcgtcttctcgtggctaccgaagtcgtggacaacgaccgtccctcctcgacctaatccgtcgtcggccttccgacggtctacgaggacgagtctgtactttatttcgtgttcnctctattagtcgacgacggtaccngaccgtcggttgggtcggttcggggacgggtacggtaccgtgggttcgtacccgtacgttacggcctaacggaccccgtaacgggcccttacccggcccccggttcgtcctaccgttcccttacccgttaccccctacccgttcccgtccgttacccgg

SEQ ID NO: 289819 - DNA, 251 bp, Homo sapiens
  misc_feature: GYAE6OF01B1DAY.45.38.D05.1.454.CMB.1.raw
  modified_base (247)..(251): a, c, t, g, unknown or other
  misc_feature (247)..(251): n is a, c, g, or t
tcagacgcgatcgacacgaccggtgctcgatttagtatctgatagttgggtttgggggtgtggtggtctccactcccgccttgacgaggctgattatttctgttgctcatatgcagggaccagcacttgggtgttcggcggagggaccaggttgaccgtcctaggtcagcccaaggctgccccctcggtcactctcgttcccgccctcctctcgatcgcgtctgagcgggctggcaaggcgcatagnnnnn

SEQ ID NO: 289820 - DNA, 775 bp, Homo sapiens
  misc_feature: GYAE6OF01BY8D6.45.38.D05.1.454.CMB.1.raw
  modified_base (574)..(574): a, c, t, g, unknown or other
  misc_feature (574)..(574): n is a, c, g, or t
tcagacgcgatcgacacgaccggtgctcgatttagtatctgatagttgggtttgggggggggtcacaagaggcagcgctctcgggacgtctccaccatggcctgggctctgctgctcctcactctcctcactcaggacacaggatcggtgggccctttctcgccctgacctcacgtcctcgcccttccggtgttcgttcgggtcctccgtggactaggtcgaatccacctagtcggccttcgactaccgtacggaaaccaaacgagtgtagttgggtttaggggtttagtttttagttttcgtaccttccgtacggtaaacccaaccgaacccgaccccggaccgaaccgaacccccctaaaacttaactacttaagtttagacgggaactacgtaacggccggtacccggttacggggtttacacggtctcgttctcgtcgacctacacggttctaggaccaaccgccggtccctcccgtagaactacgtccgtcggacggtccctaccgacgtacgtacggacggtaaccggtaggtcgttagttaatttacgtttcgtacgttacgacttntaagtcgtacgacggacgggtacacggtcggtacggttggggtccggtcgggacgggtaaccggtcgtacgggttccggaaccgttccggtaggtaccggaccgtacccgggtacggtcccgtccccggtccccgtaccgggttccttaaccccggttcccggtttcccgtacccccccgtaccttcccgtcccgttcggg

SEQ ID NO: 289821 - DNA, 838 bp, Homo sapiens
  misc_feature: GYAE6OF01C83VR.45.38.D05.1.454.CMB.1.raw
  modified_base (200)..(200): a, c, t, g, unknown or other
  misc_feature (200)..(200): n is a, c, g, or t
  modified_base (233)..(233): a, c, t, g, unknown or other
  misc_feature (233)..(233): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctcgtgtctgggtcctccgtggacngtcgatcaccatcggcctgcactggaaccaacngtgtagtggttagggttagtttttagttttgtcttccttacggtaaccctaaaccgaaccgaacccccgggaccgtaaaccgacccccctaaaacttaactcgtaactttaagtaacggaactaacgtaaacggcccggtacccgttcgggggtttacaacggttaccgtcgtttccgtcgtcgggcctaccgtaagttcgtacggaccaaaccgaccggtcccttaccctgaacctaactccgtttacgtcgggtacccgttcccgaagggtccttacggaacggggtaacccgaggggtcctaagtaacgtttttgtttacgtttgttaccggtcttacgaatttacgtggaccggaacggggtaccccaggtaccgttacgggttttcgggggttaggtttccgggggacggggtaacggggtacccgttaacggggtttcccggtaacccggttcccggttaaacgggtccgtaacccgggtaccccggtaaacgggtccccgttaccccggttccccccggttacggttccccgttaacccgttcccggtttacccccttacccccggtaacccccttcccgttacccggttaaccccgg

SEQ ID NO: 289822 - DNA, 247 bp, Homo sapiens
  misc_feature: GYAE6OF01CCX71.45.38.D05.1.454.CMB.1.raw
  modified_base (244)..(247): a, c, t, g, unknown or other
  misc_feature (244)..(247): n is a, c, g, or t
tcagacgcgatcgacacgaccggtgctcgatttagtatctgatagttgggtttgggggtgtggtggtctccactcccgccttgacgaggctgattatttctgttgctcatatgcagggaccagcacttgggtgttcggcggagggaccaggttgaccgtcctaggtcagcccaagtctgcccctggtcactctcgttcccaccctctctcgatcgcgtctgagcgggctggcaaggcgcatagnnnn

SEQ ID NO: 289823 - DNA, 177 bp, Homo sapiens
  misc_feature: GYAE6OF01AS981.45.38.D05.1.454.CMB.1.raw
  modified_base (174)..(177): a, c, t, g, unknown or other
  misc_feature (174)..(177): n is a, c, g, or t
tcagacgcgatcgacacgaccggtgctcgatttagtatctgatagttgggtttggggggaagaggaagactgacggtcccccaggagttcaggtgctgggcacagcggccctgggctgcctggtcaaggactacttcctcgatcgcgtctgagcgggctggcaaggcgcatagnnnn

SEQ ID NO: 289824 - DNA, 778 bp, Homo sapiens
  misc_feature: GYAE6OF01DCU6X.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactgggtgaagccttcggagaccctgtccctcacttgcagttgtctctggtgacctccatcagtagtagtactaattaagttttggggctcgggtcccgaccgaccgacccccgaaggggaacggggtcgtgggaggtgggtagtttgggacttgtctacgtcgtaggtcgggacctaaccttattaaccgccgtaccccgtcccttacgaaacgtaccgtacgtacgttgggtagtactaccttaacaaaactaaaaccgtaccgttacccgaaaacggtaaacccttaaactttacccgtacccgtaggaacggtccttaacgtaacccttcgtacggtaccggaaccccggtacccggaccgggtaacccgaaccgggtaaaccctaaaacgttacgtttaaccgtggttacggaccgaagggaacggtacgggtaccgtaaggttaaacttaccgtttaccgtttaacggaccgtacgggttccggggtaccgtaccggggtaacccgtcggtacccgtacccggttcctccctaccgacccgtacccgtaccccgaaaccggtaccggaccccgtacgtccccggttcccccg

SEQ ID NO: 289825 - DNA, 763 bp, Homo sapiens
  misc_feature: GYAE6OF01AE77B.45.38.D05.1.454.CMB.1.raw
  modified_base (464)..(464): a, c, t, g, unknown or other
  misc_feature (464)..(464): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctccggatgcgtcctgtcccagctgcacctgcaggagtcgggcccaggactgggtgaacgccgttacgggacgaccccttcgtcccctctacttcggctaggttcgttcctcgtgggtactacctccatccgaagttagtacgtctaagtttaaacggttttggggccgttcgggtcccgccgaaccggcccccgaagggggtacggggcgtgggaaggttggtacgttcggggtacttcgtacctacgtcgtaggtcgggtaacctaccgttaacttaccgccgtccccgtccctacgtaacgtaccgtacgtacgtaggtcgtactacctaanaaactaaccgacgtaaccaaacgtaaacctaacttccgtaccgacggtacgtctacgtaaccttcgtacggtaccgacccggtaccgacggaaccgtaaccggaaccttaaagttacgttacgtggtaccacgtaaggaaccggtcggttacacggttaattaccgttcgttacggacctacgggtccggaccggtccggaccgttcggtacccgtaccgtcgtcccgtaacgcccggtacccaccggtaacccgtaccgggtacccttaccgggtccttccccggttcccctacccgg

SEQ ID NO: 289826 - DNA, 621 bp, Homo sapiens
  misc_feature: GYAE6OF01B4R3J.45.38.D05.1.454.CMB.1.raw
  modified_base (224)..(224): a, c, t, g, unknown or other
  misc_feature (224)..(224): n is a, c, g, or t
  modified_base (228)..(228): a, c, t, g, unknown or other
  misc_feature (228)..(228): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
  modified_base (373)..(373): a, c, t, g, unknown or other
  misc_feature (373)..(373): n is a, c, g, or t
  modified_base (427)..(427): a, c, t, g, unknown or other
  misc_feature (427)..(427): n is a, c, g, or t
  modified_base (456)..(456): a, c, t, g, unknown or other
  misc_feature (456)..(456): n is a, c, g, or t
tcagacgcgatcgacacgaccggtgctcgatttagtatctgatagttgggtttggggggtcacaagaggcagcgctctcgggacgtctccaccatggcctggctctgctgctcctcactctcctcactcaggacacaggatcgtggccctttctgccctgactcagcctgcctccgtgtctgggtctcctggacagtcgatcacatggcctgcactggaaccanagtnagttggttggtagttttagttttgtctcctaggtaaccaacaaccacccggacaacgacccccaaactatcctaatttagaggactacacggccggcccgttcggggttacagtcgcttctcngctcagtcngcacgcgcctccngacatcgtcgtcggctccgaggctcgacggacgagctggatttatttcgtgttnacgttcaagttacgtgaccggtaggaccngtaccgttacggtttgggttcggtccggggtacggtaacgggtaccgtagggttaccggaaccgttccgtaggtccaaccgggcccgtaacggtcccgtccccggtcccccgttcggtacccaccttccggttcccgttcccccgcccttccgtcccgtacccgg

SEQ ID NO: 289827 - DNA, 704 bp, Homo sapiens
  misc_feature: GYAE6OF01AWIWB.45.38.D05.1.454.CMB.1.raw
  modified_base (238)..(238): a, c, t, g, unknown or other
  misc_feature (238)..(238): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcggtcgggtccctttctgccctgactcagcctgcctcgtgtcgtgggtctccgtggacagtcgatccacctagtcggcctgcacgtcggaaccngcagtgtagtggttaggtagttactaaccgttgtccgtccgtacggtaaccaacgacgccaaccgacggaccaaaccgtacccctaaaatactactaatttaacgacggacctaacgtacggccggtccggttacgggttacacgtctcttcgtcgtcgactacgtagtcgtacggacaccgtaccggcctaccgtagaactactcgtacgtcggacctcgacgtcacgacgggactggtactagttatacgttcgtcgtcttacgctacgtagtacgtacggtacgttaaggttagttacggttttcgggtttacggttcgggttaccggggacgggtacggtaaaccggtacggttccggtaccggtaccgggtttaaccgacgggtaaccggaccgacccggtaacggcccgtttacccccggccccggttaccgttaccggttccccttcccggttccccgg

SEQ ID NO: 289828 - DNA, 733 bp, Homo sapiens
  misc_feature: GYAE6OF01DVKFZ.45.38.D05.1.454.CMB.1.raw
  modified_base (226)..(226): a, c, t, g, unknown or other
  misc_feature (226)..(226): n is a, c, g, or t
  modified_base (233)..(233): a, c, t, g, unknown or other
  misc_feature (233)..(233): n is a, c, g, or t
  modified_base (694)..(694): a, c, t, g, unknown or other
  misc_feature (694)..(694): n is a, c, g, or t
tcagacgcgatcgacacgaccggtgctcgatttagtatctgatagttgggtttggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccngcagtgntgttgggagttataaccttgtctcctggtaccaacagcaccaggcaaacgcccccaaatcatgtactttagtgagggacaggtaagccggcccgtcgtacggggttttctaagttcggtctttccgttctcggctaccgaaagttcgtggacccaaaccgaccgggtcccctaccccgtaggaacctaattcctcgtcggggtacctccgaacgggtcgttacgggaacgggtaacggcgggtacgttggttaacttttacgtttttcgttcggtttcggtccttaccgtaacgtttaacgtcgtaccggaacggggaccctaggtaccgttaccgggttttgggggttacggttccgggggaccggggtaacggggtaccccgggttaagggtttaccgggtaccccggtttacccggttaacgggtacccgtaccgggacccccgtaacggggttcccnccccgggtacccccccgttcgggtcccctttaccccggg

SEQ ID NO: 289829 - DNA, 285 bp, Homo sapiens
  misc_feature: GYAE6OF01DI73J.45.38.D05.1.454.CMB.1.raw
  modified_base (232)..(232): a, c, t, g, unknown or other
  misc_feature (232)..(232): n is a, c, g, or t
  modified_base (275)..(285): a, c, t, g, unknown or other
  misc_feature (275)..(285): n is a, c, g, or t
tcagacgcgatcgacacgaccggtgctcgatttagtatctgatagttgggtttggggggtgtggtggtctccactcccgccttgacgaggctgattatttctgttgctcatatgcagggaccagcacttgggtgttcggcggagggaccaggttacgacccgtacgtaggtcacgacccgaaggtctccgccccgtcggtctactcgttccgtaccccaccctcctctacgntccggccgtgtaggcggccggtgcggacgaaggccacaagagnnnnnnnnnnn

SEQ ID NO: 289830 - DNA, 779 bp, Homo sapiens
  misc_feature: GYAE6OF01BUR49.45.38.D05.1.454.CMB.1.raw
  modified_base (708)..(708): a, c, t, g, unknown or other
  misc_feature (708)..(708): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcgaggagtccgggacccagggactgggtagaacgtcccgtttcgggacgtaccccttcgttcccccttactacgttggcctaggttgtccttcgtggtcgacctccatcagttagtagtactaagttaagttttgggcgtcgggtcccgcccgaccggacccccggaagggggaacggggtcgtagggtaggtggtagttcggggacttgtaccttacgtcgtaggtacgggacctaacctactaccgacgtccccgtcctacgaacgacctcgtacgtggtacgtactacctactaaactaaaccgacgtaaccaaacgtaacctaacttcctacccgtaggacgtacgtacgtaaccgttctacggaccgacccggccggacggaaccgtaaccggaacctaaacgttacttaccgtaggtacgaacggaaggtacgggacgggttacgtaacggtttaacttaccgtttacgttaccgaccgtacgggtaccggggtccgtaacgggtacccgtcggtacccgtacccgttcctacccgtaccnccgttcccaaccccggtaacccggtaccgggtacccctcggttaccccggttccccttaccccggtacccg

SEQ ID NO: 289831 - DNA, 689 bp, Homo sapiens
  misc_feature: GYAE6OF01CSJI5.45.38.D05.1.454.CMB.1.raw
  modified_base (282)..(282): a, c, t, g, unknown or other
  misc_feature (282)..(282): n is a, c, g, or t
tcagacgcgatcgacacgaccggtgctcgatttagtatctgatagttggggtttggggggggtcacaagaggcagcgctctcgggacgtctccaccatggcctgggctctgctgctcctcactctcctcactcaggacaacaggatcggtcgggtccctttcgtcgcccctgactcacgcctgcctccgtgtcgtgggtcctccgtggacagtcgatcaaccatctcctgcacgtggaaccagcagtgagtggtgggattataacttgtctcgtagaaccangaccaccaggacaaacgccccaatcatagtaatttagaggaggtacaagtacgccgccgtaggtagggttactaagtccgtcttcgtcgtcgtcctacgaagtcgtacggacaaccgtcggtccctacctacgaactaacgtccgtccggtagggtaccctaccggaagggtcgtaacgggaacggaacggagttacgtaggttaactttaacgttaccgtgtaccgtgtaccgtataacgtaagtcggaacgttaaggttaagttaggtttacggttagggttccggggtttacgggaaccgggtaaggggaaccctaacgggtccgtaaccgggttacccgtacggtaccggtaccgaccggtacccgtaaccggtccgtaccccggtccccgtcggttaccccg

SEQ ID NO: 289832 - DNA, 583 bp, Homo sapiens
  misc_feature: GYAE6OF01C7QUF.45.38.D05.1.454.CMB.1.raw
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
  modified_base (311)..(311): a, c, t, g, unknown or other
  misc_feature (311)..(311): n is a, c, g, or t
  modified_base (323)..(323): a, c, t, g, unknown or other
  misc_feature (323)..(323): n is a, c, g, or t
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
  modified_base (390)..(390): a, c, t, g, unknown or other
  misc_feature (390)..(390): n is a, c, g, or t
  modified_base (434)..(434): a, c, t, g, unknown or other
  misc_feature (434)..(434): n is a, c, g, or t
tcagacgcgatcgacacgaccggtgctcgatttagtatctgataggttggggtttggggggggtcacaagaggcagcgctctcgggactctccaccatggcctgggctctgctgctcctcactctcctcatcaggacacagggtcctcgggcccagtctgccctgactcagcctgcctcgtgtctgggtctcctggacagtcgatcaaccntctcctgacactggaaccngtcagtgattggttacggattaataaccttgtctacnggtacaacgnccaccgagacaaacaccccaaactcatgatttanggaggacagtancgacctcgagggttanaagctcgttntcgtgctcaacgtctggacacacgcctcctagacactctgngtcctcgagtactgacggtaacgaggtctagtaacttatacgtntacgtgtactataatctaggtacgtaggttaacgttaggtttaggttacgggtcggtcgggtacgggtacggaaccgtacggtaccgtaccggacccgttacgacgtacgaaccgacccgtacgacccttcccggtcccgtccggtacc

SEQ ID NO: 289833 - DNA, 704 bp, Homo sapiens
  misc_feature: GYAE6OF01E35RW.45.38.D05.1.454.CMB.1.raw
  modified_base (324)..(324): a, c, t, g, unknown or other
  misc_feature (324)..(324): n is a, c, g, or t
tcagacgcgatcgacacgaccggtgctcgatttagtatctgatagttgggtttggggggtcacaagaggcagcgctctcgggacgtctccaccatggcctgggctctgctgctcctcactctcctcactcaggacacagggtcctgggcccagtctgccctgactcagcctgcctcgtgtctgggtctccgtggacagtcgatcaccatctccgtcgcacgtggaaccagcagtgtagttggttagggagttactaacctttgtctcctggtaccaacgagacacccgagaccaaaccgcccccaaactcatagtaatttacgnggagggcaacgtacggccggccctacgtacgggtttactaagtccgtacttctcgtcgggtcctaccgtaagttccgtggacctaaaccgccggtccccttcccgtacgaacctaacgttccgtacgtacgggtcctaccgacggacgtagggacggacggaggtcgtagttatttaacgttacgtcgacttcgaccttacgaattacgtacggacggttaagggttacggttaacggttacggttttagggtacgggttcggggacggggtaaccggtaaccgacgggtccgttaccggtaacccggttcccggtaacggtaccgtaccggaccccgtaaccgggtcccgtccccggtccccccggtgggttaaccccg

SEQ ID NO: 289834 - DNA, 756 bp, Homo sapiens
  misc_feature: GYAE6OF01CLUO1.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtgcggctccggatgcgtcctgtcccagctgcacctgcaggagtccgggcccaggactggtgaagtccttcgggacaccccttgtcccctcacttgccagttgtcctcgtggtcacctccatcaggtagtagtactaagttaaaggttttggggcgttcgggtcccgcccgtaccggccccggaaggggaacggggtcgtagggacggtagggtagttcggggacttcggtcctacgtcgtaggtacgggtaccctaccgttacttaccgacgtccccgtccctacaacgtctacgacgtggtactactctacaataaaccgacgtaaccgaaacgtaacctaattcctcctaggacggtactacgtaactcgtacggtaccgacccggtccgaccggaaccgtaaccggaacctaaaagttacgtttaacgtgtacgaacgtaacgggacggtacgggtaccgtaaggttaactttaccgttccgtttacgacccgttaccgggtcggggtacccgtaccggggtaacccgttcgggtacccgtacccggttacccgttccccgtaccgtacccgtccccgtacccgaacccggaaccggtacccccgttacggttccccggttacccccg

SEQ ID NO: 289835 - DNA, 746 bp, Homo sapiens
  misc_feature: GYAE6OF01AM9G7.45.38.D05.1.454.CMB.1.raw
tcagacgcgatcgacacgaccggtgctcgatttagtatctgatagttggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctccgtggacagtcgatccaaccagtcggcctgcactggaaccaacagtgagttggttgggtagtttttagttttgtaccttcctaggtaccaaacaacgaccccggacgaacgacccccaaactaactctagtttaacgtacgggaaccaacgtaacgaccggtcccgttacgggggtttacaaacgtcgtctttctacgtggtcctacaagtccgtggaccaacgaccggacccttccccgtagtaaccaacgttcctaccgttcggggcctacccgagggtacctaccggaagggacccgagggtccttaggtaacgtttacgtttcgttacgtttacgacttactaagttacttacggacgtacgggacctagcccgttaacggtttacggggtcggtttaccggggcggggtaacgggtaacccttaggggttacggacccgttacggttaacggccctaacggcccgtaacgggtccgtaccggtccccccgtaccgggttaccaccgttccgttacccgttacccccacccttccccgttcgttaacccgg

SEQ ID NO: 289836 - DNA, 581 bp, Homo sapiens
  misc_feature: GYAE6OF01BE58J.45.38.D05.1.454.CMB.1.raw
  modified_base (454)..(454): a, c, t, g, unknown or other
  misc_feature (454)..(454): n is a, c, g, or t
  modified_base (460)..(460): a, c, t, g, unknown or other
  misc_feature (460)..(460): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctccggatgcgtcctgtcccagctgcacctgcaggagtccgggcccagggactggtgaagccttcggagaccctgtccctcacttgcagtgtctctggtgactccatcagtagtagtcataaattttggggctgggtccgccagccccagggaagggctggagtggattgggactggtctacgtctagtcgggaccacctattacacgcccgtccctcaacgactcgactggtgatctcaataacaccgtaccaagaaccaattcctccctgacggctgaactctgtcgaccgccgacggaccacggaccaatacttactgtnacaagngacgggccgtaggtaacttacttcccgttgaccgacgtcggggcctacgggaaccccgtcggtccgtacccgttctccctcgacgtccctccgacccgaaggccccagtcccggttccccg

SEQ ID NO: 289837 - DNA, 523 bp, Homo sapiens
  misc_feature: GYAE6OF01CQ8RB.45.38.D05.1.454.CMB.1.raw
  modified_base (138)..(138): a, c, t, g, unknown or other
  misc_feature (138)..(138): n is a, c, g, or t
  modified_base (155)..(155): a, c, t, g, unknown or other
  misc_feature (155)..(155): n is a, c, g, or t
  modified_base (189)..(189): a, c, t, g, unknown or other
  misc_feature (189)..(189): n is a, c, g, or t
  modified_base (198)..(198): a, c, t, g, unknown or other
  misc_feature (198)..(198): n is a, c, g, or t
  modified_base (213)..(213): a, c, t, g, unknown or other
  misc_feature (213)..(213): n is a, c, g, or t
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
  modified_base (260)..(260): a, c, t, g, unknown or other
  misc_feature (260)..(260): n is a, c, g, or t
  modified_base (275)..(276): a, c, t, g, unknown or other
  misc_feature (275)..(276): n is a, c, g, or t
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
  modified_base (322)..(322): a, c, t, g, unknown or other
  misc_feature (322)..(322): n is a, c, g, or t
  modified_base (336)..(336): a, c, t, g, unknown or other
  misc_feature (336)..(336): n is a, c, g, or t
  modified_base (338)..(338): a, c, t, g, unknown or other
  misc_feature (338)..(338): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
  modified_base (378)..(378): a, c, t, g, unknown or other
  misc_feature (378)..(378): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
  modified_base (393)..(393): a, c, t, g, unknown or other
  misc_feature (393)..(393): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcatcaggacanaggatcgtggccctttngccctgactcagcctgcctcgtgtctgggtctcnggacagcancacatggcctgcacnggaaccangtgatggtggtatttgttnctcctgaacaacacacccgngaacaccccaaatannattagaggcataagcgccgtgggttcagtncttnactgctcaagtnggacacgacgtccncnactaatcgtncggcncaggccagaagcgtagctatatttnttngttnctagatgngacgaggactagcgtaggtgggtgtacgggacggtaggtacgtaggtcgtaccgtacgacggtccagacccgtaggccctcccggtccccgtagtcaccgttcccgtacccgtcccctcttcgtcgtacg

SEQ ID NO: 289838 - DNA, 722 bp, Homo sapiens
  misc_feature: GYAE6OF01BII01.45.38.D05.1.454.CMB.1.raw
  modified_base (169)..(169): a, c, t, g, unknown or other
  misc_feature (169)..(169): n is a, c, g, or t
tcagacgcgatcgacacgaccggtgctcgatttagtatctgatagttgggtttggggagtgctttctgagagtcacggacctcctgtgcaggaacatgaagcacctgtcggttcctcctcctgctggtggcgctcccggatgcgtcctgtcccagctgcacctgcaggngtcgggcccaggactggtgaacgccgttacggacgtacccctgtcccctcacgttgccagttgtctcgtggtcaccttccatcgaagttagtagtctaattaaagtttggggactcgggtccgccgacggccccgaaggggacgggctggagtggagttggactgtctactcgtaggtcggaccactagttacacgccccgtcctacaacgctacgacgtggtacacgtctacaaactaacgacgtaccaaacgaaccctaattcctacccgtagacggtacctaggaaccttcgtaggtcgacccggtccggacggaaccgaaccggtacctaaaagttactttacgaggttagaacgaaagggacggtacggggtaccgttaaggtaactttacgttccgtttaacgacccgtccggttacggggacccgttaaccggggtaaccccgttcgggtacccgtaacccggttcccgttacccgtaccggtaccgtaccccgtacccgtacccgggaacccgggtcccctaacggttccccggtttaccccccg

SEQ ID NO: 289839 - DNA, 307 bp, Homo sapiens
  misc_feature: GYAE6OF01CPWQY.45.38.D05.1.454.CMB.1.raw
  modified_base (252)..(252): a, c, t, g, unknown or other
  misc_feature (252)..(252): n is a, c, g, or t
  modified_base (291)..(307): a, c, t, g, unknown or other
  misc_feature (291)..(307): n is a, c, g, or t
tcagacgcgatcgacacgaccggtgctcgatttagtatctgatagttgggtttggggggtgtggtggtctccactcccgccttgacgaggctgattatttctgttgctcatatgcagggaccagcacgttgggtggttcggcgggacgggacctagggttcgaacccgtccgtaggtcacgaccccgaaggcctcgcccccgtcggtccacctctccgttcccacccctcctctcgtacgtccgtcgttcgnggacggccgggcgtaggacgaacgggtccacgtaagagnnnnnnnnnnnnnnnnn

SEQ ID NO: 289840 - DNA, 823 bp, Homo sapiens
  misc_feature: GYAE6OF01BNQ3H.45.38.D05.1.454.CMB.1.raw
  modified_base (209)..(209): a, c, t, g, unknown or other
  misc_feature (209)..(209): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctccggatgcgtcctgtcccagctgcacctgcaggagtcgggcccaggactggtgaagccttcggacgaccctgtccctnacttgcagtgtctctggtcgactccatcagtagtagtctaagttaaacgtttggggctcgggtccgccacggccccgaaggggaacggggcgtgggagtggagttgggactggtctactcgtaggtcggacctactattacacgtcccgtacctacaacgtactcgacgtggtacgtatcgtaactaaactaaacctacgtaaccaaacgaacccttaattacccgtcctaggtacgacctacgtaacttcgtacgtacgaccccggtccggacggtaaccgaaccggtaacctaaacgtttacgttacgtagtacggaacgtaaacgggagggtaacgggtaccgttagggttaaacctttacgttaccccggtttttacggaaacccgttacggggttaccgggggtacccgtttaacccgggggtaaaccccgtttcgggtaaacccccggttaaccccggttacccgttacccccgggttaacccggaccccggttaccccccgttaaaccccccggaaacccgggttaaaccccgggggtaccccccttaaaccgggttttccccccccgggttttacccccgtttaccccccccgggttaccccgggg

SEQ ID NO: 289841 - DNA, 919 bp, Homo sapiens
  misc_feature: GYAE6OF01BHYCW.45.38.D05.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
  modified_base (895)..(895): a, c, t, g, unknown or other
  misc_feature (895)..(895): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggtccctttctcgccctgactcacgcctgcctccgtgtcgtgggtctccgtggacngtcgatccaccatcggcctgcacgtacggaaccaagngtgagttggtttagggttacgttttttagttttcgtccttccgttacggtaacccaaaccgaaacccgaacccccgggtaccgaaacccgtaaccccccctaaaaacttaactaccgttaaacttttaacggtaacggggaaacctaaccggtaaaccggtacccggggttccccgggtttaaccggggggttttacctaaaaccgggttcccggttcccgttttaccgttacccggttaccgggttacccttacccgtaaaggtttcccggttaccgggaaccgtaaaacccggtaccccgggtaccctttacccccggtaacggtaaacctaacgtttcccgttaccggttacggggtccccttacccgaccgggtcctaccggtaacggggaaccggtacgggtacttacgggttaactttttacgttttacgttcgtttacggtacctacttaacgttgtacgacggtacggtaccgacgtcgttaacggtttcgggtacggttaccggggaccgggtaacgggttaccgtacgggttaccgtaccccggttacggttacggaccgaaccgggtaccccgtacgggttcccgtacccggtccccccggtacggttaccgtaccccgtttccgttaccccggttacccccnccccgtttccgtcccctacccggg

SEQ ID NO: 289842 - DNA, 708 bp, Homo sapiens
  misc_feature: GYAE6OF01BU9JZ.45.38.D05.1.454.CMB.1.raw
  modified_base (212)..(212): a, c, t, g, unknown or other
  misc_feature (212)..(212): n is a, c, g, or t
  modified_base (232)..(232): a, c, t, g, unknown or other
  misc_feature (232)..(232): n is a, c, g, or t
  modified_base (293)..(293): a, c, t, g, unknown or other
  misc_feature (293)..(293): n is a, c, g, or t
  modified_base (372)..(372): a, c, t, g, unknown or other
  misc_feature (372)..(372): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaacgtccttcggagaccctgtcccctnacttgcagtgtctctggtanactcatcagtagtagtcaattaaagtttgggctgggtccgcacgcccgaggggaggctggngtgagttggactgtctactctagtcggacctacctattaccacgtcccgtccctagaacgtacgtaccgaacgttggtntactcgtacaaattaaaccacgtaccaaaacgtaaccctaattccctaccgtaggtaacggtcgttacggaacttccgttaggtaccgacccggcggaccggtaaccgaaccggaaccctaaaattaccgttacgttaggttacgacggtaaacggacgggaacgggtcccgttaaagggtaactttaccgtttacccgttacgaacccggtaacgtcggggtacccgtacggggtaacccgttcgggtacctacccggttcctccgaccgtccgacccgtacccaacccggtaaccgggccctaacggttcccggttcccttacccccggtaccg

SEQ ID NO: 289843 - DNA, 785 bp, Homo sapiens
  misc_feature: GYAE6OF01CMYRM.45.38.D05.1.454.CMB.1.raw
  modified_base (160)..(160): a, c, t, g, unknown or other
  misc_feature (160)..(160): n is a, c, g, or t
  modified_base (205)..(205): a, c, t, g, unknown or other
  misc_feature (205)..(205): n is a, c, g, or t
  modified_base (241)..(241): a, c, t, g, unknown or other
  misc_feature (241)..(241): n is a, c, g, or t
tcagacgcgatcgacacgaccggtgctcgatttagtatctgatagttggggtttggggggggtcacaagaggcagcgctctcgggacgtctccaccatggcctgggctctgctgctcctcactctcctcactcaggacacaggatcggtgggtccctttntcgccctgactcagcctgcctccgtgtcgtgggtcctccgtgacngtcgatcaccagtcgcctgcacgtaggaaaccaacngtgtagtggttggttagtttttagtttgtctccgtcgtaaccaacctaaccgacccggtacgaaccgaaccccaaagtatctaagtttaagacggactacgtaacggccggtaccggttcggggtttacaacgttccgtctttacgtcgtacggtacctaccgtaagttcgtacggaccgtaaccgaccgtccctaccgtaacgacgtaactccgtcgttacgggtccttaccggaggtccgtacgaacgggtacggtacgtcttaggtaacttttacgtttcgttagttcctacgttactaagttccgtacggaccggtaacgggtacctacggtcggttaacggtttgggggttaccggtaccgggggtcgggtaaacgggtaccgttacgggttccgacccgggtttacggtaccgggttaaccaccggtaccccggtacggttacccggtcccggttcccccggttacgttaccgttaacccgtttccccgtttaccccggtttaccccccgaccccctttcgggttcccgttaacccgg

SEQ ID NO: 289844 - DNA, 694 bp, Homo sapiens
  misc_feature: GYAE6OF01D3PSP.45.38.D05.1.454.CMB.1.raw
  modified_base (214)..(214): a, c, t, g, unknown or other
  misc_feature (214)..(214): n is a, c, g, or t
  modified_base (270)..(270): a, c, t, g, unknown or other
  misc_feature (270)..(270): n is a, c, g, or t
  modified_base (304)..(304): a, c, t, g, unknown or other
  misc_feature (304)..(304): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacagggtcctgggcccagtctgccctgactcagcctgccttccgtgtcgtgggtctccgtggacagtcgatcaaccnttcctcctgacactaggaaccagcagtgatgttgggattatactgtctctgacacngacaccagacaacgacccaactcatagtattagnggaggcaagtacgccgtcgtacggtacgggttactagtccgtacttcgtcgtcggtactaccgtaagtccgtacggacgtaaccgcccggtccttacccgtagtaacctaacgttccgttccggtcgggaccttaccgacgggtacccgtagggaacggtacggtacggtaccgtagtttaacgttacgtttcgtacgtctttcggaccttacaagttactacggtacgttaggttaacgttacgttttacgttcgggttacgggtaccgggtacgggtaacgggaacgttaacggtccggttaacggacccggtttccggtaacggtacccgtaacccgggtaccgaacccggttcccgtacccccgggtcccgtttccggttaacccg

SEQ ID NO: 289845 - DNA, 254 bp, Homo sapiens
  misc_feature: GYAE6OF01DKX78.45.38.D05.1.454.CMB.1.raw
  modified_base (241)..(241): a, c, t, g, unknown or other
  misc_feature (241)..(241): n is a, c, g, or t
  modified_base (247)..(254): a, c, t, g, unknown or other
  misc_feature (247)..(254): n is a, c, g, or t
tcagacgcgatcgacacgaccggtgctcgatttagtatctgatagttgggtttggggggtgtggtggtctccactcccgccttgacgaggctgattatttctgttgctcatatgcagggaccagcacttgggtgttcggcggagggaccaggttgaccgtcctaggtcagcccaagtctcgccccctggtcactctcgttcccaccctcctctcgatcgcgtctgagcggctggcaaggcncatagnnnnnnnn

SEQ ID NO: 289846 - DNA, 801 bp, Homo sapiens
  misc_feature: GYAE6OF01D0RGX.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggacgtccgggcccaggacgtggtgaacgccgttcgggacgaccctcgtcccctctacttgcagttcgtctcgtggtcgaccttccatcaaggttagtagtactaagttaaaggttttcgggggcttcggggtcccgacccgtaccggacccccggtaagggggaacggggtcgtaggggaggttcgggtaaggtttcgggacgttggtaccttacgtcgtaggtcgggtacctaccgtataccgcgtccccgtacctacgaacgcgtacgtacgtggtacgtactaccgtaactaaactaaaccgaccgttaaccgaaacgtaaaccctaactttaccctcccgtaggaaccggtcctaacggtaaccttcgttcggtaccggaaccccggccggaacccgggaaccgtaacccgggtaacccttaaaagttaccttaacgtcgttacggaacgtaagggaacggtaccgggtaccgttaagggttaactttaccgttaccgttacgacccgtacgggtccgggtacccgtacgggtaacccgttcgggtacccgtacccgttcctcccgaccgtacccgtaccccgtacccgaacccggtaccgggtacccctcgggttcccggttaccccccg

SEQ ID NO: 289847 - DNA, 903 bp, Homo sapiens
  misc_feature: GYAE6OF01A7K79.45.38.D05.1.454.CMB.1.raw
  modified_base (222)..(222): a, c, t, g, unknown or other
  misc_feature (222)..(222): n is a, c, g, or t
tcagacgcgatcgacacgaccggtgctcgatttagtatctgatagttgggtttgggggctttctgagagtcacggacctcctgtgcaggaacatgaagcacctgtggttcctctcctgctggtggcgctccggatgcgtctgtccagctgctacgtgcaggagtccgggaccaggtacgtgggtagaacgtccttacgggacgtaccccttcggttcccctntacggttcgacgtagttccgtccttcggtaggtctaaccgtaccaagttacgtaaggttaacgttaacgttactaaaggttttaacgggtttttcggggacgttccgggtacccgtaccgtaaccggacccccggtaaggggaacgggtccgtaggtacggtaggtacgttcgggtacttcggttacttacgtcgtaggtacggtacctaaccgttactaccgacgtcccgtctacgtaccacgttacgtagtcggtacgaacttcgtaaacgtaactaaaccgtaccggtacctaaaaacgtacccgtttaacgtccgtaccgtacggtaacgtctaaccgtaaccggtcttacggttaccggaccccggtaacgggaccgtaaccgggtaccgaacgtttaaacgttacttaaccggtaaggtccgtaacggtaaaggtaacgggtaccggtagttaaacggttaccgtttaaccggttaacccgtttacgacccggtttacggggtaaccgggttacccggttaaccgggtacccgggtttactaaccccggtttaaccggtcccgttaacccggtacccgttaacccgggtaaccccggtacccggttaaacccggttaaccgggccccccttaagggtttcccccgtttcccccgttacccgggttaaccccccgg

SEQ ID NO: 289848 - DNA, 806 bp, Homo sapiens
  misc_feature: GYAE6OF01CLPVS.45.38.D05.1.454.CMB.1.raw
  modified_base (752)..(752): a, c, t, g, unknown or other
  misc_feature (752)..(752): n is a, c, g, or t
tcagacgcgatcgacacgaccggtgctcgatttagtatctgatagttggggtttgggggctttctgagagtcacggacctcctgtgcaggaacatgaagcacctgtcggttccctcctcctgctggtggcggccgtcccggatgccgtcctcgtcccagctcgcaccgtgcgaggcggtccgggcccaaggctgggtgaacgtcccgttacggacgacccctcgtcccctcaccgttggctaggtcgttctcgtggtagacctccaattcaaggttagtagtacaaagtttaaaggtttcggggcgtcgggtcccgaccgaccggcccccggtaaggggacggggtctagggtaggtgggtaggtttgggaacgttcgttaccgtaaccgttcgtaacgggtaccgggaaccctaaccgttaacgttaccgaacccggtacccccgtcccctaaacgaaaccggtacccgttccggtaaccgttgggtaactaacttaccgttaaactaaaaacctaaaaccgtaaccgtaacccaaaacgaaacccttaaacttcccgtacccgtaggtacgtactacgtaacctcgtcgaccggtaccccgacggacggtaaaccgaccggaactaaagttcgtaacgtggtacgaacgaaggaaggacggtacgttaggtaacttacgtaccgtttcgaaccgtacgggtcgggtacccgtacgggtaaccctgggtaccctaccggtcctaccgtacncccgacctaacccgaccgaacgggtccctaggttcccgttccctccccgtaccg

SEQ ID NO: 289849 - DNA, 856 bp, Homo sapiens
  misc_feature: GYAE6OF01DKOGY.45.38.D05.1.454.CMB.1.raw
tcagacgcgatcgacacgaccggtgctcgatttagtatctgatagttgggtttggggatgctttctgagagtcacggacctcctgtgcaaggaacatgaagcacctgtggttcctcctcctgctggtggcggctcccggatgcgtcctgtcccagctgcacctgcaggacggtccgggcccaggctggtcgaaagtcccgttcggaacgtccctcgtccctctacttgcagttgttcctcgtggtcacctccatacgagtagttagtactaaagtttaaggtttcgggcgtcgggtacccgaccgaccggaccccggaagggggaacgggtcgtagggtaggttaggtaggtttacgggtaacgttcggttaccttacgttacgttacggggtaccgggaacccttaaccgtttaacgttaaccgacccggtcccccgtacccttactaaaaccgtccggttaccgacggttaacgggttacaaccgtttacctaaacgtaaaaacctaaaaccgtaacccgtttaaaccaaaaccggtaaaacccttactttacccgtacccgtaggtaacggtaccgttaacgtaacccgttcggttacccgtaccggaacccgggacccggaccgaacccgtacgggaaaccctaattacgttacgtaggtcgaaacgtaagggaacggtcgggtaaccgtacggtttaattaccgttcgttaaccggaccgttaaccgggtaccggggtacccgtacccggtacccggttcggtaccgtccccgttcctaaccccgtacgtaccccggtaaccctaccccggaaccgtacccggaacccttcccggtccccgtttacccccg

SEQ ID NO: 289850 - DNA, 696 bp, Homo sapiens
  misc_feature: GYAE6OF01B3T9C.45.38.D05.1.454.CMB.1.raw
  modified_base (475)..(475): a, c, t, g, unknown or other
  misc_feature (475)..(475): n is a, c, g, or t
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctccgtggacagtcgatcaccatggcctgcactaggaaccaacagtgatggttgggtagtttttagttttgtctcctggtaaccaacaacaccccggacgaacgaccccaaactaactacaatttaagtagggaacctaactaacggccggtccccgttacgggggtttacaacggtcgtccttctcgtggacctaccgaacgtctggacaacgaccggcctccctagaacaactctcgtggcctccgaggctacgaggacgaggctgtaatttacgtttctgtttcncttacaatagtgacgtacgggaccacggactacggttcggggtcgttcggggacgggtaacgggaccggtagggtttaccggtaccggttccgtagggttaccaacgggacccccgaagggtacccgttcccggttaccccccccgtagggtttacccctaacccgttcccgtttaccccggttcccccggttcccccgttacccgttccccggttaccgg

SEQ ID NO: 289851 - DNA, 814 bp, Homo sapiens
  misc_feature: GYAE6OF01BSMX7.45.38.D05.1.454.CMB.1.raw
  modified_base (212)..(212): a, c, t, g, unknown or other
  misc_feature (212)..(212): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggactcggtcggtccctttctcgcccctgactcacgtcctcgtcctcgtgtcgtcggtctccgtaggaccgngtcgatccacctagtcggcctagctacgtaggaaccatagtgtagttggtttgggttacgtttttagtttcgtccgttacgtacggtaaccaaccgtaacccggaccccggaaccgtaaacccgtacccctaaaacttaactacgttaactttaacggtaaccggaaccttaacgtaaccggtcccggttccccgggtttacggggtttacaacgttccgtccgtttcgtaccgtcgggttacctaaccttaggccgttacggaccctaaacccggccggttccctacccgtacaacgtaccgttcctcccggtcgggaccttcccggaagtccctacggaacggtaccggcggttaactcggtttagttttaaccgtttcgttagttccgtcttaacgtaagttgtaccggtcggtaaacggaccgtacgtacgggttaggtcgggtttcggtacgggtaacgggacggttaccggtcggttaccgtccggtaacggttacgccccggtaaccgaccggtaccgggtccgaccccggttccccggtacgttacccgtccgtacccgtttcccccgccctccccggttccgtccgtacccgg

SEQ ID NO: 289852 - DNA, 292 bp, Homo sapiens
  misc_feature: GYAE6OF01BZ8RQ.45.38.D05.1.454.CMB.1.raw
  modified_base (287)..(292): a, c, t, g, unknown or other
  misc_feature (287)..(292): n is a, c, g, or t
tcagacgcgatcgacacgaccggtgctcgatttagtatctgatagttgggtttcaagtcgcttctctggctccaagtctggcaacacggcctccctgacaatctctgggctccaggctcaggacgaggctgattatttctgttgctcatatgcagggaccagcacgttgggtgttcggcggagggaccaggttgaccgtcctaggtcagcccaaggctcgccccctcggtcactctcgttccccacctcctctcgatcgcgtctgagcgggctggcaaggcgcatgnnnnnn

SEQ ID NO: 289853 - DNA, 641 bp, Homo sapiens
  misc_feature: GYAE6OF01CU6MF.45.38.D05.1.454.CMB.1.raw
  modified_base (162)..(162): a, c, t, g, unknown or other
  misc_feature (162)..(162): n is a, c, g, or t
  modified_base (215)..(215): a, c, t, g, unknown or other
  misc_feature (215)..(215): n is a, c, g, or t
  modified_base (221)..(221): a, c, t, g, unknown or other
  misc_feature (221)..(221): n is a, c, g, or t
  modified_base (248)..(248): a, c, t, g, unknown or other
  misc_feature (248)..(248): n is a, c, g, or t
  modified_base (435)..(435): a, c, t, g, unknown or other
  misc_feature (435)..(435): n is a, c, g, or t
  modified_base (457)..(457): a, c, t, g, unknown or other
  misc_feature (457)..(457): n is a, c, g, or t
  modified_base (473)..(473): a, c, t, g, unknown or other
  misc_feature (473)..(473): n is a, c, g, or t
tcagacgcgatcgacacgaccggtgctcgatttagtatctgataggttggggtttggggggggtcacaagaggcagcgctctcgggacgtctccaccatggcctgggctctgctgctcctcactctcctcactcaggacacaggatcggtcggtccctttcncgccctagactcagcctcgcctccgtgtcgtcgggtcctcgaggactagcacncaaccngtcggcctagcaacgtagaaaccaagngtagagttcggttaggttagttttagttcgtctaccgttcgaaccaaacaaccgaccggacaaaccgaccccaaatactactaagttacgaacggactacgtacgcccggtccggtacgggttaacaggtcctcgtcgtacgtcggaccttacgaacgtcgtacggaccaaacgccgtccaccgtanaagtactcgagtcggcaaccgngaactcgaaggacgtnctaggttacttagttcttgacgtctatatcggagacgaacagtactcggtaagtgggtaccgtggacgggacgtcgtcgtacggactccgtaggccacgccgaacggtccctcacccggttacgccgtaaccttccggtaacccttcccaaccgttccgtacgtaccg

SEQ ID NO: 289854 - DNA, 657 bp, Homo sapiens
  misc_feature: GYAE6OF01D6PG9.45.38.D05.1.454.CMB.1.raw
tcagacgcgatcgacacgaccggtgctcgatttagtatctgatagttgggtttgggggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtcgtctcgtggtcgactcatcagtagtagtctaattaaagtttgggctcgggtcccgccgacggcccccggaaggggtaacggggctcgggtaggtggtaagttgggactgtctactcgtaggtcgggacctaccttattacgacgtcccgtccctacgaacgtactcgacgtggtcactctacgaactaaacacgtaaccaacgaacctaacttcctaccgtagacgctagactgtcgtacgaccgccgacggaacacggactaaatacttacagtcgacaaggacgacgggctagtattacgttaccttagacacgggtcgggtaccgtacgggtaccgttcgtaccgtaccgtcgtcctaccgtaccgtccctacccgaaccgaccggtaccaccgttccgtccccgtccccgtaccgtccctaccccttaccgacctaacggaccgtacccgg

SEQ ID NO: 289855 - DNA, 786 bp, Homo sapiens
  misc_feature: GYAE6OF01C5SF3.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtgttcctcctcctgctggtgcggctccggatgcgtcctgtccagctgcacctgcgaggagtccgggcccaggtacgtggtacgaacgtccttacgggactacccttcgtaccctcacgtttgctaggttgtcctcgttggtacctacctccatcgaagtaggttactctaagttaaggttttcgggcgtcgggtccgaccgtaccggccccgtaagggggaaggtccgtagggtacggtgggtagtttggggaccttggtacgttacgttacggtaggttacgggacctaccgttattaccgacgcccgttccctacgaacgtacgtacgtacggttcggtacgtaacttctaacgtaaactaaccgtaacccgtaacctaaacgtaaacctaacgttcccttccgtaggtaacggtccttacgaaccgttcgtcggtaccgaccgtacccggagggaacccaccgggtaactaactttacgtttacgacggttaaggaccgaaggtccgggaacggttccgtaagttaacgtttccgtaccggtttagacccggttacgggtaccgggtacccggtacggttacccgttccggtaacctcccggttaccctccttacgacccacccgttacccgaacccggtacggtccctaaccgttcccgttacccgtcccgtaacccg

SEQ ID NO: 289856 - DNA, 977 bp, Homo sapiens
  misc_feature: GYAE6OF01D50F1.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtccgggcccaggactggtgaacgtccttcggacacccctgtcccctcacgttgcagttgtctcgtggtcacctccatcagtagtagtactaagttaaagttttggggcgttcgggtcccgccgacgcccgtacggaaggggaaggggtcgtaggggtaggttgggtaggtttcggggtaaccgttcggttaccgtttaccgttacggttaacgggttaccggggtaacccctaacccgtttaacgtttaacccgacccggtaccccccgttaccccgttaacgaaaacggtaccgttacccggtaacggtttacggggttacgtaacctttaccgtaaacctaaaaacgttaaaaacccgtaacccggttaaaaccccgaaaaaccggttaaaaccccttaaaccgttttcccgtaccccgttagggaaccggttaccgttaacggtaaacccgtttcccgttacgggtacccggtaacccccgggacccgggtaacccgggaacccgtaaacccggtaaaccccgttaaaaagtttaacccgtttaaccgttacggtaaccggaacggtaaaacgggaacgggtaccggggtacccgttaaaggggttaaaccttttaaccgtttacccggttttaccgaaccccggttacgggttacccgggggtaccccgttaaccggggtaaccccgtttcgggtaccccttaaccccgggtttcccttcccccgtaacccgaaccccggttcccccttaaccccggaaaccccggttaaacccggggtccccccttaacggtttcccccccgg

SEQ ID NO: 289857 - DNA, 928 bp, Homo sapiens
  misc_feature: GYAE6OF01BF0VR.45.38.D05.1.454.CMB.1.raw
  modified_base (118)..(118): a, c, t, g, unknown or other
  misc_feature (118)..(118): n is a, c, g, or t
  modified_base (158)..(158): a, c, t, g, unknown or other
  misc_feature (158)..(158): n is a, c, g, or t
tcagacgcgatcgacacgaccggtgctcgatttagtatctgatagttggtttggggggggtcacaagaggcagcgctctcgggacgtctccaccatggcctgggctctgctgctcctnactctcctcactcaggacacaggatcgtgggcccttttcngccctgactcagcctgcctccgtgtcgtgggtctcctggacagtcgatcaccatcggcctgcactacggaaccacgagtgtagtggtttgggtagtttttagtttcgtccttccgtacggtaaccaactaacccgaccccggacgaaaccgaccccctaaaacgtaactactaacgtttaacggtaacggggaacctaaccggttaaacgggtcccggggttccccggtttacgggggggttttacaacgggttccggtacctttcgttaccgtcgggtaccttacccggtaaacgtccgtacgggacctaaacccggtacccgggtccccttaccccggtacggtaaacctaaacgtttccccgtccgggttaccggggtcccgttaccccgaacggggtcccgttaccggaacgggggacccgtaacggggtacctttacgggtttaaacgtttttaacgtttttcggttacggtttacgggttacccttacgttaagtttaccggtaccggacccgggtaaccgggtaacccgtcgtaccgggttaacggggttttcgggggttacgggtttcccggggggtaacgggtaaccgggggttaacccgttaggggtttcccgggtaaacccggttccggttaccgggtaccgacccgggtaaccccggtacggtacccggtccccggtccccccgtttacgggtacccacccggtttccgtttcccccggtttaccccccggcccctttccccggtccgttaccccggg

SEQ ID NO: 289858 - DNA, 834 bp, Homo sapiens
  misc_feature: GYAE6OF01BCKVG.45.38.D05.1.454.CMB.1.raw
  modified_base (222)..(222): a, c, t, g, unknown or other
  misc_feature (222)..(222): n is a, c, g, or t
tcagacgcgatcgacacgaccggtgctcgatttagtatctgatagttgggtttgggggggggtcacaagaggcagcgctcgtcgggacgtctccaccatggcctggctctgctgctcctcactctcctcactcaggacacaggatcgtcgggtccctttctcgccctgactcgacgtcctcgtcctccgtcgtcgtcgggtctccgtgacacgtcactcacngtcggcctgacacgtacggaaccaacgtgtagtagttgggttaggttagtttttacgttcgtcgtaccgtacgtaaccctaaccgaacccgtaccccggaaccgtaaccgaaaccccctaaattactacgttaagtttaaggaacgggaacctaacggtaaccggtcccgggtacccggttacgggggttactaacggtccgtcttcgtcgtcgtccttacgacgttcgtacggaacctaaccggtccgacccttccgacgtaactaactcgtacggtcggtcctacggacgtcgacggacggacggcgtcgtattacgtttacgttcgtacgttcgtaactcgtaagtcgttacggaacggtaccggtaaccgtacgtaccgggtttaacgggttcggggtttaccggtcggggtaaccggggtccggtaacgggttccgggttaccgtaccccgggttaacgggtaccggtaacccggtaaccggtaccccggtaaccgggttccccggtacccccccggtttacccccgtttacctacccccggtttccccgtttccccggtttaaccccccccgtccctttacccggttaacccgtcggtacccccgg

SEQ ID NO: 289859 - DNA, 932 bp, Homo sapiens
  misc_feature: GYAE6OF01DW8EX.45.38.D05.1.454.CMB.1.raw
tcagacgcgatcgacacgaccggtgctcgatttagtatctgatagttgggtttgggggctttctgagagtcacggacctcctgtacaggaacatgaagcacctgtggttcctcctcctgctggtggcggcctcccggatgcgtcctgtcccagctgcacctgcaggagtcgggcccaggactggtagaacgtccttcggacgaccctcgtacctctacttgctagtgtctcgttggtcgactcctatctaagtagtagtactaagttaaacgttttggggccgtcgggtcccgccgaccggtacccccggaggggaacgggtcgtagggtaggtggtagttacggggtacgttcgttaccgttacgttcggtaaggtccgggtaaccctaccgttagtaccaccgtccccgttacccgtacaacgtacctcggtacgtggtacgtactactaacgtaaactaaacgtaaccgtaaccgaaaactaccgtaacttccgtaccgtacggtaacggtacgttacggtaacccttcggtacggttaccggaccccgggtacccggtaccgggtaaaccgaacccgggtaaccctaaaacgtttaccggttttaaccggtaccggtacgggtaaaccggaaaggggtaaccggggtaccgggttaaccgttaaacgggttttaactttacccggtttacccgtttaccgggaacccggtttaaccggggttcccggggtaacccggggtttaaccgggtaaacccccggtttcgggtaaacccccggtttacccgttccccgtttaacccccggttaccggaccccggttaccccgttaaacccccggtaacccggggtaaaccccggggtccccttaaccccgggtttccccggttaacccccccgtttccccccgggtaaggtaacccccccccg

SEQ ID NO: 289860 - DNA, 822 bp, Homo sapiens
  misc_feature: GYAE6OF01BKOGR.45.38.D05.1.454.CMB.1.raw
  modified_base (158)..(158): a, c, t, g, unknown or other
  misc_feature (158)..(158): n is a, c, g, or t
  modified_base (253)..(253): a, c, t, g, unknown or other
  misc_feature (253)..(253): n is a, c, g, or t
tcagacgcgatcgacacgaccggtgctcgatttagtatctgatagttgggtttggggggtcacaagaggcagcgctctcgggacgtctccaccatggcctgggctctgctgctcctcactctcctcactcaggacacgaggatcggtcggtccctttncgccctgactcagcctcgcctcgtgtcgtggtcctcgtaggactaggtcgatccaacctgtcggcctgacctacgtacggaaaccaacgtaggtntacgttgggttagggttaagttttttacgttcgtccttaccgttacggtaacccaaaccgaacccggaccccggaacgaaacccgtaaccccctaaaattactacttaagttttaacggaacgggtaactaacggttaaccggccccgggttacccgggtttacgggggtttaaccaacggttccgttccgtttacgtccggttacggtcccttaaccgaacggtttccgacggaacctaaccggcccggtccccttaccgtagaaacctacgttcccgtacggtcggtacctccggtagaccgtacggacgggtaacgagtactagttaactttcgttcgtgttcgtacttagtagtcgtacgaccggtaacggtactacgtcgtacgggttggggtaccgtcggggtacgggaacggttccgtacgggttacccgtaaccccggttaggtaccgtaaccggaccggtaccccgtacgggttccccgttccccgggtaccccgttcggtaccctttacccggttcccgttcccccgttaaccccgcccctttccgtcccggtacccgg

SEQ ID NO: 289861 - DNA, 695 bp, Homo sapiens
  misc_feature: GYAE6OF01C8N1R.45.38.D05.1.454.CMB.1.raw
  modified_base (210)..(210): a, c, t, g, unknown or other
  misc_feature (210)..(210): n is a, c, g, or t
  modified_base (678)..(678): a, c, t, g, unknown or other
  misc_feature (678)..(678): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactccaggacacaggatcggtgggtccctttctcgaccctgacctcacgcctcgcctccgtgtcgtcgggtctccgtggacngtcgactcaccagtcggcctgccaacgtcgaaaccagagtgtactggttggttacgttttagttttcgtccgtcgtacggtaaccaacaacccgtacccgacaaccgaccccaaatatctaattacgaggaccacgtacggccgtaccggttcggggtttacacgtccgtccgttaccgtcgtcggtctacgtacgtcgtcgaccaacgccgcctcctagacctatcgtacgtcggtctacgagtcgacggacggacgagtcagttacttatcgtacgctgtcctagtatagtacgtgtaacgttacgttcgttaacgtttggtccggttacgggcgggtaacggaccctaagggtcccgtacggtaacccgttacggtacggtaccgaaacccggtaccggtaaccgtcccggttaccccgtcccccggttagtaccccgtcgttaccccttccccggttacccccnccccgttcgttaacccg

SEQ ID NO: 289862 - DNA, 792 bp, Homo sapiens
  misc_feature: GYAE6OF01DQEE7.45.38.D05.1.454.CMB.1.raw
tcagacgcgatcgacacgaccggtgctcgatttagtatctgatagttggggtttggggggggtcacaagaggcagcgctctcgggacgtctccaccatggcctgggctctgctgctcctcactctcctcactcaggacacaggatcgtgggtccctttctcgccctgacctcagcctgccctcgtgtcgtgggtctcctggacagtcgatcaccagtcggcctgcacgtacgaaccaagagtgagttggttagggttagtttttagttttcgtcctccgttcggtaaccaacgtaaaccgaccccggacgaaccgacccccaaataactctatttagaggaacacgtaacggccggtccgttcgggggtttacaagtcgtctttctacgtcggctaccgaagtccgtggaccaaacgccggtccctcccgtacgaacctaactccgttccggtcgggacccttccgacggtccttaccggaacggtacggaacggtcttacgttaacgttttacgttttacgttcggtttacgtaccttacgtaacgtttagtacggtacggtaaccgggacccttaacgggtaccgttacgggttttcggggttcgggttaccggggtaccggggtaacggggttaccgtaagggttccggtaacccggttaccggttaggttacccgaccggtacccggtaaccggtcccgttacccggtacccccccggttgggttccctaaccggtttcccttaacccggtttcccccctaaacccctttcccgttacggttacccgg

SEQ ID NO: 289863 - DNA, 684 bp, Homo sapiens
  misc_feature: GYAE6OF01C3DO8.45.38.D05.1.454.CMB.1.raw
  modified_base (156)..(156): a, c, t, g, unknown or other
  misc_feature (156)..(156): n is a, c, g, or t
  modified_base (230)..(230): a, c, t, g, unknown or other
  misc_feature (230)..(230): n is a, c, g, or t
tcagacgcgatcgacacgaccggtgctcgatttagtatctgatagttgggtttggggggggtcacaagaggcagcgctctcgggacgtctccaccatggcctggctctgctgctcctcactctcctcactcaggacacaggatcgtgggccctttntgccctgactcagcctgcctcgtgtctgggtctcctggacagtcatcacagtcggcctgcactcggaaaccaangtgattggttggttagttttgtttgtctctgtaccaacaccgacccgacgaacgaccccaaatactctattagtacggacacgtaacggccggtaccggttcgggggtttacaacggtcgtcttctcgtcggcctacgtaacgttcgtacggaccaaaccgccggtccctaccctacggaactaactccgttcgcggtcctccgagtcctacgacggtacggaacgtcttaggtaatttttactttacgttggtttcgtaccttactaatttacgcgtcggtaaacgggaccctaggtcccgtaaggtttcggggttacggttacggggacgggtacgggtaccgtacgggttccggacccggttacgtacggttaccgacgacccggtacgcccgttaccgtcccccgtagtcctaccgttccgttaccgtacccctcccgtcctccgtaccg

SEQ ID NO: 289864 - DNA, 686 bp, Homo sapiens
  misc_feature: GYAE6OF01ACSUK.45.38.D05.1.454.CMB.1.raw
  modified_base (285)..(285): a, c, t, g, unknown or other
  misc_feature (285)..(285): n is a, c, g, or t
  modified_base (369)..(369): a, c, t, g, unknown or other
  misc_feature (369)..(369): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctcgtcccagctgcacctgcgaggagtcgggcccagggactgggtgaacgccttcggacgaccctgtcccctcacttgcagtcgtctcgtggtcacctccatctagtagtagtctaattaaagtttggggcgtcgggtcccnccgacgcccccggaggggacgggcgtagggaggtgggtagttgggactcgtactactcgtaggtcgggacctaccttagtaccnccgtcccgtacctacgaacgcgtcgacgtggtactacttacgtaactaaacgtaaacctaccgtaaccaaacgtaaacctaacttcctaccgtggacgtctacgtacctcgtacggtaccgacccggaccggaccggacgtaaccggacctaaattacttacgagtacgagtaacggacgggacggtacgtagtaacttaccgttccgttacgaccgtacgggtcggtaccggtcggtaccgtcgtacctccgtctaccgcgtccgccctaccgaaccggtaccggccttaccggtcccgttcccctcccggtcccg

SEQ ID NO: 289865 - DNA, 814 bp, Homo sapiens
  misc_feature: GYAE6OF01DFJXK.45.38.D05.1.454.CMB.1.raw
tcagacgcgatcgacacgaccggtgctcgatttagtatctgatagttgggtttggggatgctttctgagagtcacggacctcctgtgcaaggaacatgaagcacctgtgttcctcctctgctggtgcggctcccggatcgcgtcctgtcccagtctgcacctgcaggacggtccgggccaaggctgggtacgaacgtccgttcggacgtcccgttcgtccctctacgttgacgtagttcgtctgtggttacactccattaccgaaggttattaacgttacgtaagtttaaggtttcggggcgttcggtaccgccgaaccggtaccccggaaggggaacgggtcggtagggtggtagggtacggtttacgggaacgtttcgttacgttaccgttcggtaacggttaccgggtaacctaacgtttacggttacgcccgtaccggtaccctaacgtaccggtaccttcggtacgtcgggtacgactttaacaactaaacctaaaccgtacgtaaacccgtaaacgtaacctaacttcccgtaccctggaacggtactacggttaacctacgttcggtaacgggacccgtacggacggaaccgtccgttaaacgaaattttaaccgtacgttacgaaggtaccgaagtacgggaccgtacggtagttaactttcgtaccgtttacgaaccggtacggttaccggtaaccggtcggtaacccggttacggcccttacccggttaccgtcctaccggtaacccgttccccggaaacccaaccgggtaccgttccccgacgttcccccggggtttaccccc

SEQ ID NO: 289866 - DNA, 728 bp, Homo sapiens
  misc_feature: GYAE6OF01A5BO2.45.38.D05.1.454.CMB.1.raw
tcagacgcgatcgacacgaccggtgctcgatttagtatctgatagttgggtttgggggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtcgtctctggtgactccatcgagtagtagtctattaaagttttgggctcgggtccgccgacgccccgagggaacgggcgtggtaggtggtagttgggactgtctactcgtaggtcgggacctacgttactacgaccgtcccgtccctacgaacgtacgtccgtacgttcggtacgtacttcgtaactaaactaaaccgaccgtaccgaaaacgtaaccctaacgtttccctaccgtagacggtctacgtaacctcgtacggtcggacccgtccggacgtaccgaccggtaactaaacgttacgttacgtgtacgacgaaggacgggacggtacgtaggtaatttacgttccgtttacgaaccgtcggtaccgggtcgtaccgggtaccgttcggtaccgtaccgtcctacccgtcgaccgtcccgtacccgtaacccgggaaccggtcccctacggttccccggttccccgttacccccggccggtaccccttaccccctaccgaacccgtaacggtccgtaccccgg

SEQ ID NO: 289867 - DNA, 824 bp, Homo sapiens
  misc_feature: GYAE6OF01BRCMD.45.38.D05.1.454.CMB.1.raw
tcagacgcgatcgacacgaccggtgctcgatttagtatctgatagttgggtttggggctttctgacgagtcacggacctcctgtgcaggaacatgaacgcacctgtggttcctcctcctgctggtgcggcctccggatgccgtctgtcccagctgcactgcaggacgtccggacccaggacgtgggtcgaacgtccgttcggacgacccctcgtcccctcgacttggcgtagtgtcgtccgtgggtctacctcctagtcgtagttacgtagtacctaaagttaacgttttcgggcgttcgggtcccgcccgtaccgaccccccggaagggaacgggtccgtagggtacggtcggtaggttcgggacgttcggttaccgttaccgtcggttacggtacgggtaaccctaccgttacttaccgacggtccccgtaccctacgaacgtaccctacgtacgtggttacgacttactacgtaaacgtaaaccgccgtaacaaactaaccgtaacttccctacgtacggtcgtactacgtaactcgtacgaccggtacccgaccggtaccggaaccgtacccggtaacctaaagtttccggtaaccgttaggtaccgaacggtaaacgacggggtaacgtccggtaaacggtttacgttaccgttacccggtttacgaacccggtaccgggtaccgggttcccgggttaaaccggtaccccgttcggttaacccgtcccggttctacccgtcggtacccgaccccgttacccgacccggtacggtaccccttaacggttccccggttaacccccttcccggtaaccccgg

SEQ ID NO: 289868 - DNA, 257 bp, Homo sapiens
  misc_feature: GYAE6OF01C6KI5.45.38.D05.1.454.CMB.1.raw
  modified_base (246)..(257): a, c, t, g, unknown or other
  misc_feature (246)..(257): n is a, c, g, or t
tcagacgcgatcgacacgaccggtgctcgatttagtatctgatagttgggtttggggggtgtggtggtctccactcccgccttgacgaggctgattatttctgttgctcatatgcagggaccagcacttgggtgttcggcggagggaccaggttgaccgtcctaggtcagcccaagtctgccccctggtcactctgttcccaccctcctctcgatcgcgtctgagcgggctggcaaggcgcatagnnnnnnnnnnnn

SEQ ID NO: 289869 - DNA, 761 bp, Homo sapiens
  misc_feature: GYAE6OF01E15K5.45.38.D05.1.454.CMB.1.raw
  modified_base (305)..(305): a, c, t, g, unknown or other
  misc_feature (305)..(305): n is a, c, g, or t
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcccccgtgtctgggtctcctggacagtcgatcaccatggcctgcactggaaccaacagtgatgttgggtattttagtttgtctctggtaccaacaacaccccggacgaacgcccccaaataatctaattttanagggactaactaaggccggtcccgttacgggggtttacaaggtcgtactttccgtctggcctaccgaacgtctacggacaacgaccgggtccctaccctaggacctaatctacgtgggacctccgaacgggtcttaccgaacgggaccgacgggtcctagtaattttaactttcgtgtttcggtaccttacgtaattacgttacggaccgtaacggggtaacccacggtccgtaacggtttcggggttacggtttaccggggacgggtaaccggggttacccgtaaggggtttacccggtaaccccggttaccggttaacgggtccgaaaccgggtacccccgtaaaggggtccccttaccccgggtaccccccccgtttcgggtaccctacccgttacccgtttacccgttacccccctaacccccgtttccccgttaccgtccggttaacccgg

SEQ ID NO: 289870 - DNA, 742 bp, Homo sapiens
  misc_feature: GYAE6OF01DCPAF.45.38.D05.1.454.CMB.1.raw
  modified_base (243)..(243): a, c, t, g, unknown or other
  misc_feature (243)..(243): n is a, c, g, or t
tcagacgcgatcgacacgaccggtgctcgatttagtatctgatagttgggtttggggggggtcacaagaggcagcgctctcgggacgtctccaccatggcctggctctgctgctcctcactctcctcactcaggacacagggtcctgggcccagtctgccctgactcagcctgcctcgtgtctcgggtctccgtggactagtcatccacctatcctcctgaccacgtaggaacccagcagttnagttggttagggtaactttactaaccgttgtcctctacggtaaccaacagccaaccgagaccaaacccgtaccccctaaatcctaagtgtaacgtttagtacggacggctaaaggtaacgccggtaccccgttagtaacgggtttcctaagtccgtactttcgtcgtacggtctaccgtaagttccgacggtacctaaccggtacccgtcccttaccgtacgaaccttacgtcccgttacggtccggtacccctaaggtaccggtacgtaggaacggtacccggtagggttacccttaggttacttttaaccgttaccgttacggttcctacgttacctttacgaagtttacccgttaggtaacggttaccgggtttagttacggttttacggtttcgggtaccggtacggggtacgaaacgggtacgtaccggtcggttaccgtacccggtcgtaggtacccacgttacccggatcccgtcccgtcccgtcggtaccc

SEQ ID NO: 289871 - DNA, 839 bp, Homo sapiens
  misc_feature: GYAE6OF01A1VV3.45.38.D05.1.454.CMB.1.raw
  modified_base (787)..(787): a, c, t, g, unknown or other
  misc_feature (787)..(787): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtgcggctccggatgcgtcctgtcccagctgcacctggacaggtacgtccgggacctaaggcgtggtagaacgtccgttacggaccgtaccctcgtccctatacgtcgactagttcgtctcgtgtcacctactatacgtaagtaggttactactaaaggtttaaggtttcgggaccgttcgggccgtaccgaccggtacccggaaggggtaacgggtcgtaaggcggttaggacggttacggacttacggtactacgttacgtacggtacgaacctaaccgttactaccgaccgtccccgttaccgaacgtaacgaccgtacggtaacgtcggtaacacgttacgtaaaccaaaacgttaaacccgtaaccgtaaaccgtaaaccgtaaaacccgtttaaccttacccgttacccggtaggtaacggttacccgttaacgtaaacccttccgggttccggtaaacccggtacccccgggaaccggttaaccgggaaccggttaacccggtaaactaaacgtttaccgttaacgtacgggttaacgaaacggttaacggaacgggtacgggttaaccttaagggttaaccttcgtaaacccggtttccgaaccgttacgggacggtacccgtaccggtaaccgtccggtaccctaccgtccgtacnccgtccgacctaccgtacccgacgtacctaccgtccctccggtccctaccgg

SEQ ID NO: 289872 - DNA, 1015 bp, Homo sapiens
  misc_feature: GYAE6OF01DSD07.45.38.D05.1.454.CMB.1.raw
  modified_base (125)..(125): a, c, t, g, unknown or other
  misc_feature (125)..(125): n is a, c, g, or t
tcagacgcgatcgacacgaccggtgctcgatttagtatctgatagttgggtttgggggctttctgagagtcacggacctcctgtgcaggaacatgaagcacctgtcggttcctcctcctgctggnggcgctccggatgcgtcctcgtcccagtctcgcctacctggacgagggtacggtcccggggacccgagggtacggtgggtagaacgtcccgttacgggacctaccccttcgttcccctctacttcggcttaggttcgttccgttccgtagggtacctaccttacctaacgtacgtaacgggttagttaacgttacttaaaaggtttttaaacgggttttcgggggtccggttaccggggtaccccggtacccggaacccgggaccccccgggggtaaaggggggtaaacgggggtccggttaacggggtacggggttaggggttacggtttacgggtaacccgtttcgggtttaccttaaccggttacggttaacgggtacccgggtaaccctttaaccgtttaaccgttaccgaccccggttccccccgttaacccgtacgtaaacccgttacgtaccggtaccggttaggttaaccgtacttacctaaacgaaaaccgttaaaccgtaacccgtaaccgtaaactaaaccctactttaccgtaccggtagtaccggtacgttacgtaaccgtttcggacggttacccgggaccccggaccgggaaccggtaaaccgtacccgttaaacgtaaacttttacggtacggttaggacggtaacggaagggtaaccgggtacggtaccgtaaggtttaacgttcccgttttaacggtacccgttaacggggtaccccggttcgggggtacccgttaaacccggggtccgtaccccgggttaacctccccgggttcctaccccggtaacccgtcccggtaaacccggtaccccgaaccccgggtaccgtacccgttacccggtttcccgggttccccctccccggtaccccgg

SEQ ID NO: 289873 - DNA, 797 bp, Homo sapiens
  misc_feature: GYAE6OF01E4VQO.45.38.D05.1.454.CMB.1.raw
  modified_base (613)..(613): a, c, t, g, unknown or other
  misc_feature (613)..(613): n is a, c, g, or t
tcagacgcgatcgacacgaccggtgctcgatttagtatctgatagttggggtttgggggctttctgagagtcacggacctcctgtgcaggaacatgaagcacctgtggttcctcctcctgctggtggcggcctccggatgcgtcctgtcccagctgcacctgcgagggagtccggggacccagggtacgtgggtagaacgtcccttacgggacgtacccccttcgtcccctctacgtttcgcaggttgtcctcgtggtcgacctaccattaccgaaggttagtacgtactaaagtttaaggtttcggggcgtcggggtcccgacccgaccggacccccggaagggggacggggtcggtagggacggtacggtagttcggggtactcggttacttacgtcgtacggtacgggtaaccctaccttacttaccgccgccccgtaccctacgaacgtacgtccgtaacgttggtacgtactactaacaaacgtaaacctaaccgtaaccaaaacgaacctaacgttcctaccgtacggacgtacgtacgtaacttcggtacgtcgggacccgccggaccggaacgaaccgactaaattacgttacgtgtacggtaanaacggtacgggacggtacggtaaggttaacgtttaccgttaccgttaccgaccgttacgggtaccgggtccgttaccggaccggttcggtacccgtaccgtcctccaccggtcctaccccgtaacccggtaacccggacccggtacccttaaccggttccccggttcccctccccggttccccg

SEQ ID NO: 289874 - DNA, 917 bp, Homo sapiens
  misc_feature: GYAE6OF01BQQ31.45.38.D05.1.454.CMB.1.raw
tcagacgcgatcgacacgaccggtgctcgatttagtatctgatagttggtttgggggggggtcacaagaggcagcgctctcgggacgtctccaccatggcctgggctctgctgctcctcactctcctcactcaggacacaggatcggtgggccctttctgccctgactcagcctgcctcgtgtctgggtctccgtggacagtcgatcaccatggcctgcctactacggaaccaacgagtgagttggtttaggggttagtttttagttttcgtctccgttaggtaaccaacaacccgaccccggacgaaccgacccccaaaactaactactaagtttaacgaacggggtacctaacgtaacggtcccgggtcccggttaccgggggttttacctaacggttccgtcctttccgtcgtaccggtaccttacccgtaaacggttccgtacgggaacctaaacccggtacccgggtcccttaccccgtaggaaccctaacttcccgtaccggttcgggaccctaccggaggtccgtacggacggggtaacccggaaggtccttaggttaactttttacgtttcgttacggttcgtaccctagttaagttaggtaccgtacggtaaccggggtaaccctacgggttacccgttaacggggttttcggggggttacccgggtttaccgggggggaaccgggggttaaaccggggttacccgggttaacggggtttaccccggttaccccgggttaaccgggttaaccgggtacccggtaaacccgggtacccccggtaaccgggttccccgggtacccccggttcccccgggttacccggttacccgttaccccggtttccccgttttaccccggttaaccccccccttacccccggttttccctacccggtttacccccggg

SEQ ID NO: 289875 - DNA, 784 bp, Homo sapiens
  misc_feature: GYAE6OF01ADCFL.45.38.D05.1.454.CMB.1.raw
  modified_base (145)..(145): a, c, t, g, unknown or other
  misc_feature (145)..(145): n is a, c, g, or t
  modified_base (249)..(249): a, c, t, g, unknown or other
  misc_feature (249)..(249): n is a, c, g, or t
  modified_base (730)..(730): a, c, t, g, unknown or other
  misc_feature (730)..(730): n is a, c, g, or t
  modified_base (777)..(777): a, c, t, g, unknown or other
  misc_feature (777)..(777): n is a, c, g, or t
tcagacgcgatcgacacgaccggtgctcgatttagtatctgataggttggggtttgggggctttctgagagtcacggacctcctgtgcaggaacatgaagccactgtcggttccctcctcctgcgtgggtcggccggcctccggntcgccgtcctcgtcccagctcgcctccgtggacggagggaccggtccggggacccgaagggtcgttgggacgaaccgtccgttacggacctcccttcgtccctnacgttcgctgtcgtctgtaggtcactctagtcgtagtagttacgtacttaaggtttacgggttccgggcggtccggtacccgaccggaccgggaccgggaggggacggtcggagggtaggtaggtacggtcggtacttacgtactaccgtacgtacggtaccgtaacccttacgttaacctacccgcccgtccccgtaacctacggaaccgtccgtacgtaggtagtactactaacctaaacgtaaacgttaacccgaccgtaacctaaaccgttaccttccgttaccgacggtagaccgttacgtacctacgttcggtaccggacccggtacccggaaccgtacgaaactacgtaaacttatcgtacgagacgaacggaggtacggacgtaccgttagttaccttccgtacggtaccgacgggtccgtacgggtaccgttaaccgcccgttacgaccccgtcccgttacgccccgttacncccgttaaccccgaccgtacgtcccgtaccctaccgtccccgtcccnccgtccc

SEQ ID NO: 289876 - DNA, 798 bp, Homo sapiens
  misc_feature: GYAE6OF01DPSDV.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcgagggagtccgggcccaggacgtggtgaacgtccgttacggacgtacccctcgtccctcacttgctagtcgtcttcgtggtcgactccatcgaggttacgtagtactaagttaaaggttttggggtcgtgggtcccgccgaccgacccccggaggggaacggggcgtagggagtggacgttgggacttgtacgtacgtcgtaggtacggaccacttataccacgtccccgtcctacgacgtacgtcgtactggtagtactactaacaaactaaactaccggtaaccgaaacgtaaaccctaacttccctaccgtacggtacggaccgttacgtaaccctttcgtacgtacccggaccccggacccgggtaaccggaaccgacccgtaactaaaacgttactttacgtaggtacgaacgtaacggaagggtacggtacggtaagttaacgtttcgtttaccggttacgtaccggttaccggtaccggggtaccggttaccgggtaccccggttacgggtacccgttacccggttccttacccgacccgttacccggacccccgttaacccgaacccgggtaaacccggtccccggttacggttcccccggttaccccgtttcccccggtacccccgg

SEQ ID NO: 289877 - DNA, 774 bp, Homo sapiens
  misc_feature: GYAE6OF01CMUVQ.45.38.D05.1.454.CMB.1.raw
  modified_base (557)..(557): a, c, t, g, unknown or other
  misc_feature (557)..(557): n is a, c, g, or t
  modified_base (590)..(590): a, c, t, g, unknown or other
  misc_feature (590)..(590): n is a, c, g, or t
tcagacgcgatcgacacgaccggtgctcgatttagtatctgatagttggggtttggggggggtcacaagaggcagcgctctcgggacgtctccaccatggcctggctctgctgctcctcactctcctcactcaggaccacgagggtcctgggcccagtctcgccctgactcacgcctgccctcgtgtcgtggtcctccgtggacagtcactccacactctcctgaccacgtacggaacctgctagtgtagtgggttagggaacttacgttaaccttgtctccgtacggtaacaacgcgaccaaccgtacggaaccgtaaaccgaccccctaaataccgtaagttacgtaacgttttacgtacgggaacgggacgtaacggtaaaccggtcccggtacccgttacggttaacgggtttaacctacgttccgttcttccgttacgtaccgtcctaacggtacgtccgtcggaaccaaccgtaccgtcccgttaccgtacgaaccttactccgtacgggtccacccgttcgaacggtcgtaggaacgggtacgtacggtnttaacgttaattaccgtttagcgtacggttacncgttacaacgtttaggacgtacggttaaaggttcggttttaaccgtttgggtttaccgggttcgggtaacccgggtacgggaaaccggtaccgttaacggaccgttaccggacccgttacgggtaccggtacccgtaacggacccccggtactaccccgggtcccgttccccgtccgttacccg

SEQ ID NO: 289878 - DNA, 852 bp, Homo sapiens
  misc_feature: GYAE6OF01ETXIT.45.38.D05.1.454.CMB.1.raw
  modified_base (307)..(309): a, c, t, g, unknown or other
  misc_feature (307)..(309): n is a, c, g, or t
  modified_base (380)..(380): a, c, t, g, unknown or other
  misc_feature (380)..(380): n is a, c, g, or t
  modified_base (416)..(418): a, c, t, g, unknown or other
  misc_feature (416)..(418): n is a, c, g, or t
tcagacgcgatcgacacgaccggtgctcgatttagtatctgatagttgggtttggggctttctgagagtcacggacctcctgtgcaggaacatgaagcacctgtggttcctcctcctgcgtggtggcggccgtcccggagtcgtcgtcctcgtccgacgctcgccaccgtcgacgacggacggtccgggacccagggacgtgggtacgaacgtcccgttaccggacgaccccgtcgttcccctacctaccgttcgacctaggttcgtaccgtcgtacggtacgtacctaccgactacgtagtagtannngtacctaagttaaaacgtttttagggggtaccgttcggggtaccccggtaccccgtaaccggtacccccgnggaacggggtaaccggggtacggtacgggtaggtannngggtaacggttacgggtacgttacggtacgttaccgttacgtaacggtggaacccgtaaccgtaacgttaaccgtacgtaccccgtacccgtaccgtaaacgtacgtaccgtacgtacggtacgtactacgtaccgtaaacgtaaacgtaaccgtaaccgtaaacgtaaaccgtaaacgttaccgttacccgtagtaacggtaccgtacgtaaccgtacgtacgtaccgtacccggtacccggtaccggaacccgaaccggtaaccgtaaacgttaacgttaaccgttacggttaacgtaaccgtaaacggtaaacgggtaacgggtaccggtaacggtaaacgtttaaccgttacccggtttaccgtaacccgtaaccggttaccggggtacccggtaccgggtaacccggttaccggtacccggtaaccccg

SEQ ID NO: 289879 - DNA, 761 bp, Homo sapiens
  misc_feature: GYAE6OF01ANS7O.45.38.D05.1.454.CMB.1.raw
  modified_base (224)..(224): a, c, t, g, unknown or other
  misc_feature (224)..(224): n is a, c, g, or t
  modified_base (250)..(250): a, c, t, g, unknown or other
  misc_feature (250)..(250): n is a, c, g, or t
  modified_base (564)..(564): a, c, t, g, unknown or other
  misc_feature (564)..(564): n is a, c, g, or t
tcagacgcgatcgacacgaccggtgctcgatttagtatctgatagttgggtttggggggggtcacaagaggcagcgctctcgggacgtctccaccatggcctggctctgctgctcctcactctcctcactcaggacacaggactcggtcgggtcccttttctcgccctagactcacgcctgtcccttccgtgtccgtggtctccgtagacaggtcactccaccngtcggcctgactacgtacggaaccangtgtacgttggttagggtttagtttttacgtttcgtccgttccgtacggtaacctaaccgaacccgtaccccggaccgaaaccctaaccccgtaaactacttacttagttaacgacggtaacaacgtaccggtccggtacccggttacgggttacagtccgtcttcgtcgtcgtacctacgtacgtctacgacacgtccgtcctccgtagactactcgtacgtcggacctcgagtccgtcggacggtaacgcggtaacttcgttaaatttcgttcgttcgttaccgcgttagtatacgtcggtacggaaccgtntaccggtcgttcgggttacggggtcgggttacgggcggggttaccgggtacgttaccgggttaccggaccgttaccggtagtcccggaaccgtacccggtaaccgggttccccgacccgggttcccccgggttacgaccccgttccgtttccccgggttccccgttacccccggttccccttcggttcccggtaccg

SEQ ID NO: 289880 - DNA, 861 bp, Homo sapiens
  misc_feature: GYAE6OF01A0J6M.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtcggttcctcctcctgctggtggcggctccggatgccgtcctgtcccagctcgccaccgtgcgaggacggtccgggacccgaggacgtagggtacgaacggtcccgttacggaccgtacccgttcgttccctactacgttgacgtaggttcttccgtacgtgggtaccaccttaccgatcggaagttaacgtacgttacttaaagttttaacggttttcggggtaccgttccggggtccccgacccgtacccgggaccccgggtaaggggaacggggtcggtaggtaagggttcggtaggttacgggtacgttacgttacgttacgtacggttaacggtaccggtaaccctaaccgttaaccgttaaccgtccggtacccccgtacccgtaacgaacgtaccgtacggtacgttcggtactactacgtaaactaaacctaaaccgtaccgtaaacgtaaaccgtaaccttaaccgttcccgtaccgtagggaacgtcgaaaccggttccttacggtccggtaaccggcccgtaaccgggacgtaaccgaaccggtaacttaagttaccgtacgtacggtacgaaggttaacgggacgtacgggttcgtaacggtttaccgttacgtaccggttaacgaccggttcggtacgggtaccggtaccgtcggtcccgtaccgttaccgtccgtacctacggtacctacccgtacgaacccggtaccgtacccgtacgttccccggtcccgtcccggtcccg

SEQ ID NO: 289881 - DNA, 939 bp, Homo sapiens
  misc_feature: GYAE6OF01EX0J5.45.38.D05.1.454.CMB.1.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcggtcgggtcccttttctcgccctgactcagccctgccttccgtgtctgggtctccgtggactagtcgactcaccagtcggcctgacaccgtaggaaacccaacgtaggtagtagttggtttaggggtaagtttaaccgttaacctttcggtaccttcccgttacggtaaacccaacgaccgaccgaaccccgaacggacccaaaaccgacccccccaaaacttcgaagttacgttaagtttacgtggaacgggtacaaggtaacggcccggtacccgttcgggttaaggggtttacctaacgttccgttcctttccgtacgtcggtaccgttaccgtaacggtccgtcggtaaccaacggacccggtccccttacccgagtaacctaacgttccgttcgtccgggtacccgttaccggacggttccgtaagggtaaacgggaccgtaggtaccgtttacgtaacgttttacgttaacgttcgtccgttcgttacccttagttaacgttacggttacggttaacggggttaacgtttaacggtttaacgggtttttacggttttacgggggttttacgggttacccgggggggtaaaccggggttaaccggggttaaaacccgtaacggttacccggggttaaacccgggttaacccccgggtttaccggggttaaacccgggttacccggtaaccccgggtaacccccccggggttaacggggtccccccgggttttaacccccgggtcccccccgggtttaccggggtttaccccccgtttaaacccccgggg

SEQ ID NO: 289882 - DNA, 774 bp, Homo sapiens
  misc_feature: GYAE6OF01C34IS.45.38.D05.1.454.CMB.1.raw
  modified_base (208)..(208): a, c, t, g, unknown or other
  misc_feature (208)..(208): n is a, c, g, or t
tcagacgcgatcgacacgaccggtgctcgatttagtatctgatagttgggtttggggcttcctgagagtcacggacctcctgtgcaggaacatgaagcacctgtggttcctcctcctgctggtggcggctccggatgcgtcctgtcccagctgcacctgcaggagcgggcccaggactggtgaagccgttggacgtccctgtcccctnacttgcgtagtgtctcgtggtcactccatcgagtagtagtactaagttaagttttggggctggtccgccacgccccgaagggaaggggctggagtggagttgggactgtctactctaggtcggtaacctacttattaccgacggtccccgttaccctacgaaacgtacttccggaacgtgggtacaacttacgaactaaaataaaacccgaaccgtaacccgtaaaaacggaaaccctaaacgtttacccttcccagggtaacgggtactaacggtaaaccttcgtagtaccggaaccggtcccgaacggaacccgaacggaaccctaaaagtttaacttacgttaggacgaacgaaagggaaccggaagggtacccgtaagttaacgttaactttacccgtttaacggacccgtacgggttccgggtaacccgttcggggtaaaaccccgttcgggaacccgtaacccggtttccgtaccccgttacgacccggtacccctaccccgtaaaccggaaacccgggcccctaacgttccccggtttacccgttccccccgtaccggg

SEQ ID NO: 289883 - DNA, 830 bp, Homo sapiens
  misc_feature: GYAE6OF01B8EZB.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgccgtcctgtcccagctgcacctgcgagggagtccgggcccagggacgttgggtagaacggtcccttacgggacgtaccccttggtcccctctacgttgctagttcgttcctcgttggtcgaccttccatacgaagtagttacgtactaaagttaaggttttggggccgttcgggtcccgtacccgaccggacccccggaagggggaacggggtcgtagggacggtagggtaagttcggggtacttcgttacttacgtacgtacgggtacgggtaaccctaaccgttagttaaccgaccggtcccccgttaccgtaacgtaacgtaccgtacgtacgttggtacgtacttaccgtaacaaaacgttaaaccaaccgtaaccaaacgtaaaccctaagtttccctacccgttaaggaccgtacgtagtaaccttcgtacggtcgaccccggaccggaccgaacgtaacccggtaactaaacgttcttaaccgtaggtacgaacgtaaaggaaccgggtcgggtacgttaaggtaaactttaccgttaccgttacgtaccggtacggttaccggggacctacccgggtaaccgttcggtaacccgtcccgtccctactacccggtacggtaccccgtacccgaaaccggtacccggtccctaacggttccccggttaccccgtccccggtcccg

SEQ ID NO: 289884 - DNA, 723 bp, Homo sapiens
  misc_feature: GYAE6OF01ADLUD.45.38.D05.1.454.CMB.1.raw
  modified_base (159)..(159): a, c, t, g, unknown or other
  misc_feature (159)..(159): n is a, c, g, or t
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (508)..(508): a, c, t, g, unknown or other
  misc_feature (508)..(508): n is a, c, g, or t
  modified_base (524)..(524): a, c, t, g, unknown or other
  misc_feature (524)..(524): n is a, c, g, or t
tcagacgcgatcgacacgaccggtgctcgatttagtatctgatagttgggtttggggggggtcacaagaggcagcgctctcgggacgtctccaccatggcctggctctgctgctcctcactctcctcactcaggacacaggatcggtcggtcccttttncgccctgactcagcctgcctccgtgtctgggtctaccgnggacngtcgatccacagtcggcctgacacgtacgaaccaagtagtgtagttgggtttggttattttacgtttcgtactccgtacggtaccctaacgaaccgacccggacaaccgaccccaaatactactaattagacggactacgtaacgccgccggttacgggttacacggtcgtcttacgtcgtcgtcctactagttcgacgtacaaccgtcccggtcccttacccgagtaacctaacttccgtcggtaccggccgtacgacggtctacggacgggacgtcgtactacgttaattactttgtcgttancctagtaatcggtacnccggaacggtacctcggtacgttacggtttaggggtcgttaccggggcgggtaacgggtacgttacgggttaccgaccccggttacgtacggttacccaaccgggtacccggtaccgtaccccgtcccggtaccccgtcgtacccttacccggttcctttaccccctaacccccggtcccttccgaccgttaccccggg

SEQ ID NO: 289885 - DNA, 834 bp, Homo sapiens
  misc_feature: GYAE6OF01AP7P8.45.38.D05.1.454.CMB.1.raw
tcagacgcgatcgacacgaccggtgctcgatttagtatctgatagttggggtttgggggctttctgagagtcacggacctcctgtgcaggaacatgaagcacctggtcggttcctcctctgcgtggtcggcggcctccggatggccgtcctcgtcccagtctcgcctaccgtggacgagggcggtccgggacccgtaggtaccgttgggtacgaacgtcccgttacgggaccgtcccgttccgtcccctatacgttcgaccgtagttcgttcttcggtaggttcaccttaccagttacgtaaggttagtacgttaagttaaagttttaaggggttttcgggccggttaccggggtcccggacccgaaccgggacccgggaagggggtaacgggtcggtagggtcggtagggtacgttcgggacttacgtccgttacgtacggtaggtaccggtaaccttaacctacgtaccgtaccgtcccttaccgacgaacgtaccgtcgtacgtagtcgtaacttacaacgaaacctaaacgactaaccgaaactaactacttaccgaccgagtaacggtctacgtacttcgaccggaccgtacccgacgacggtaaccaaccgaacttaaactcgttacgtacggaactacggaaggtaccgggtacgttaccgttaaagttcgttaacccgtttacgtaacggtaaccggtcggggttaacccggaaccggtttccgggaccttaccggttaccccgacgttccctaccgacccggtccaacccgtacccggaacccgtcggtaacccgttcccgtcccgttccccgtaccgggtaccc

SEQ ID NO: 289886 - DNA, 695 bp, Homo sapiens
  misc_feature: GYAE6OF01CEZI0.45.38.D05.1.454.CMB.1.raw
  modified_base (166)..(166): a, c, t, g, unknown or other
  misc_feature (166)..(166): n is a, c, g, or t
  modified_base (418)..(418): a, c, t, g, unknown or other
  misc_feature (418)..(418): n is a, c, g, or t
  modified_base (560)..(560): a, c, t, g, unknown or other
  misc_feature (560)..(560): n is a, c, g, or t
  modified_base (647)..(647): a, c, t, g, unknown or other
  misc_feature (647)..(647): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctccggatgccgtcctgtcccagctgcacctgcaggngtcgggcccaggactggtagaacgtcccgttcggacgtacccctcgtcccctcacgttgccgtagttgtctcgtaggtcacctaccatacgtagtagtagtactaagtttaaacggttttggggccgttcggggtcccgacccaccgggacccccggaagggggaacggggtcgtgggtaggtcggtaggttcggggacgttcgtactacgtcgtaaggtcggaccctactattaccgaccgtccccgtccnctaacgctacgcgtgtagtacttactactaaactaactaacgtaccaaacgtaaaccttactcccgtacccaggtacggtctacggtaccttcgtcggtccgacccgtcggacgacgtaccgacttaagtacttacgcgtanaagacggagcggtcgtagttacttctacttgacccgtgtccgggtacgtaccggtaccgtcgtacgtacccgtcctccgcgtacccnccgtaaccgaccggaccgtcctaccgtccccggttccctcccgtcccg

SEQ ID NO: 289887 - DNA, 626 bp, Homo sapiens
  misc_feature: GYAE6OF01B811A.45.38.D05.1.454.CMB.1.raw
  modified_base (210)..(210): a, c, t, g, unknown or other
  misc_feature (210)..(210): n is a, c, g, or t
  modified_base (230)..(230): a, c, t, g, unknown or other
  misc_feature (230)..(230): n is a, c, g, or t
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcggtgggccctttctgccctgactcagcctgcctcgtgtctgggtctccgtggacagtcgatcaccntggcctgcactggaaccaangtgatggttagggtatttttagtttgtctccgtaggtaccaacaacgtacccggacgaacgaccccaaactaatctagttagtaggacacgtaacgccggtccgttcggggttcaagtcgtcttcgtcgtggtctcgtaacgtcgtcgacaacgacggtcctaccgtagactaacgtctcgtcggtctccgaggctacgaggacgacggtctagtatttacgtttctgttgctctatacgtcgacgtacggaccagtcgtacgttgggtcgtcgggacggacggtacgtacggtcgaccgtcgtacggtacgacgtacccgtaggtccgtccgtcccccgttcggtacctaccgttccgttacccgttacccctacccgttccgtccgttacccgg

SEQ ID NO: 289888 - DNA, 691 bp, Homo sapiens
  misc_feature: GYAE6OF01AV0GL.45.38.D05.1.454.CMB.1.raw
  modified_base (207)..(207): a, c, t, g, unknown or other
  misc_feature (207)..(207): n is a, c, g, or t
  modified_base (249)..(249): a, c, t, g, unknown or other
  misc_feature (249)..(249): n is a, c, g, or t
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
  modified_base (515)..(515): a, c, t, g, unknown or other
  misc_feature (515)..(515): n is a, c, g, or t
tcagacgcgatcgacacgaccggtgctcgatttagtatctgatagttgggtttggggggggtcacaagaggcagcgctctcgggacgtctccaccatggcctggctctgctattcctcaccctcctcactcgagggcacgacgggtcctcgggcccagtctcgccctgactcacgcctcgccttccctgtcgtcggtctcctggacncgtcgactccacctactccctgcacgtggactccgagcggtntacgtttacgttgttttaatctcgttccttcggtgtacgtcacgaccaaccgaccgaacgaccgaaacctacccctaatctactactatttacngtacgttnaactaagtaccgttccgtaccttcggttacggttctactactccgttctcctcggtacgctaacgacgttcgacgtactaacgtacccgtccttaccgactacctcttcgtacgtcgtaccacggcgacgtaaggaacgtggtacgttctaagttactttacgngtacgacgtacgaactactaagttacttacggttacgtttaccgttagtaccgggttacgggtacggtacgggaacgtaacggttacctacggttcgtaccggttgtaacccgtcgtaccgccggtaccggtcccttacccgggaccccgttgccttaccggttccgttaccccgg

SEQ ID NO: 289889 - DNA, 266 bp, Homo sapiens
  misc_feature: GYAE6OF01BFD3J.45.38.D05.1.454.CMB.1.raw
  modified_base (109)..(109): a, c, t, g, unknown or other
  misc_feature (109)..(109): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (259)..(266): a, c, t, g, unknown or other
  misc_feature (259)..(266): n is a, c, g, or t
tcagacgcgatcgacacgaccggtgctcgatttagtatctgataggttggggtttgggggggtgtggtggtctccactcccgccttggacgagctgattatttctgttnctcatatcgcagggaccagcacgttgggtgttcggcggagggaccagggttgacccgtctaggtcagcccaaggctcgccccctggtcacttctgttcccaccctcctctcgatccgctactgagccgggctggcaagggcncaatgncnnnnnnnn

SEQ ID NO: 289890 - DNA, 793 bp, Homo sapiens
  misc_feature: GYAE6OF01A1PHH.45.38.D05.1.454.CMB.1.raw
tcagacgcgatcgacacgaccggtgctcgatttagtatctgatagttgggtttggggggggtcacaagaggcagcgctctcgggacgtctccaccatggcctggctctgctgctcctcactctcctcactcaggacacaggatcggtcggtccctttctcgcctgactcagcctcgcctccgtgtcgtgggtcctcgtggacagtcgactccacgagtcggcctgcacgtacggaacacgtagtgtagttggtttacggggttagttttttaggtttcgtccgttccgttacggtaaacccaaaccgaacccgtacccggaacgaacccgaacccctaaataactactaattacggaacggacctacggtacggccggtcccggtttaggggttcaacggtcgtccttgtcgtacggccgttacgtaacggtcgtacggacaaccgtacccggtcctcctacgactaactccgtacggtcggacctcggtacggcgtacggacggtaccggtagtccgtagtttaacgtttcgtttcgtcgttacgtacttcgtaaagttacgttacgggaccgttaccggtaaccgagtaccgggttttacgggtaggggttaccgggttacgggggacggggtaaccggggttacggttaaccggggtccgttacccggttaccggttagaacccgggtaccggaacccggtccggtacccgtccccgggtccccgtttacggacccgtttacccttccggtttaacccttccccggacccgtttaccgcccggttaacgg

SEQ ID NO: 289891 - DNA, 677 bp, Homo sapiens
  misc_feature: GYAE6OF01BAIP0.45.38.D05.1.454.CMB.1.raw
  modified_base (481)..(481): a, c, t, g, unknown or other
  misc_feature (481)..(481): n is a, c, g, or t
  modified_base (503)..(503): a, c, t, g, unknown or other
  misc_feature (503)..(503): n is a, c, g, or t
  modified_base (519)..(519): a, c, t, g, unknown or other
  misc_feature (519)..(519): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtggccctttctgccctgactcagcctgcctccgtgtctgggtctctggacagtcgatcaccatcggcctgcacgtcggaaaccaacagtgagttggtttgggtagtttttagttttcgtctaccgttacggtaacccaaccgtaaccgaccccggacgaaccgtaccccccaaaactaactactatttaagtacgggacctaacgtaacggccgggtcccgttacgggggtttctaacggtcgctttactcgtcggctaccgaagttcgtggaccaaccgccggtccctcccgtgaacctaatcctcgtcggcctccgacggctggacggacggnggtcttagtattaacgttacgngtctagctacatagtnacgtaggtagttacgttacgtttgggtacggttccgggacgggtacggtactacggtcgtaccggtaccgtccgtaggtaccacggtacccgtaaggtcccgtccgtcccccgtacgtccctacgttcccgtacccggttccctccccgtctacccgg

SEQ ID NO: 289892 - DNA, 809 bp, Homo sapiens
  misc_feature: GYAE6OF01CENBW.45.38.D05.1.454.CMB.1.raw
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggcccagtctcgccctgactcagcctgcctcgtgtcgtgggtctccgtggacagtcgactcacctatcctcctgacacgtacggaaccagcgtaggtagtagttggttacgggtatttaacttaaccgttgtaccttaccgttacggtaaccctaaaccgacgacccgaaccccgaaagggtaaccccaaaacccggtaaccccccctaaaacgtccgtaaagtttacgttaaacgtttaagtacggggaacggtacgtaacggtaaaccggcccgggtcccgtttaacgggttacgggttttaaccaaacgttccggttccttacgttccgtcggtacctaccgtaacggtccgtacggtacccgaaaccggtccggtaccccgttacccgaagtaaccgtaaccgtttccggtaccgttacgggtaccctccggtacggtaccggtagggaccggggtaaaccggtgtacggtttaagtaagtttaacgtccggtacgtcgttactacgtctaaaggtcgtaccggagttaacgggttatttacgggttagtttcgggtacggtggggaaccgggtaacgtaaccgtacggttaccgtaccggtaccgttccgtacggtaccgtaccgaccctagggtcccgtcccggtacccccgtacgg

SEQ ID NO: 289893 - DNA, 268 bp, Homo sapiens
  misc_feature: GYAE6OF01A8JU5.45.38.D05.1.454.CMB.1.raw
  modified_base (215)..(215): a, c, t, g, unknown or other
  misc_feature (215)..(215): n is a, c, g, or t
  modified_base (245)..(245): a, c, t, g, unknown or other
  misc_feature (245)..(245): n is a, c, g, or t
  modified_base (251)..(268): a, c, t, g, unknown or other
  misc_feature (251)..(268): n is a, c, g, or t
tcagacgcgatcgacacgaccggtgctcgatttagtatctgatagttggggtttggggggtgtggtggtctccactcccgccttgacgaggctgattatttctgttgctcatatgacagggaccagcacgttgggtgttcggcgggagggccaggttgaccgtcctaggtcagcccaaggctcgccccctggtcactctgttccccgccctctcncgatcgcgtctgagcgggctggacaaggcncatagnnnnnnnnnnnnnnnnnn

SEQ ID NO: 289894 - DNA, 782 bp, Homo sapiens
  misc_feature: GYAE6OF01CZB5S.45.38.D05.1.454.CMB.1.raw
  modified_base (237)..(237): a, c, t, g, unknown or other
  misc_feature (237)..(237): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcgctccggatgcgtcctgtcccagctgcacctgcaggacgtcggacccaggactggtagaagtccttacggacgtaccctgtaccctcacttgctagtgtctcgtggttanacctccatcagttagagtctaagtaaagttttgggctcgggtccaccgaaccggcccccgaaggggtaacgggtctaggggtagtgggtagttcggggactttcgtacgttaccgcgttaacgtaccgggtaaccctacgttaacgtttacgaccggtaccccgtacctaacgaaccgtaccgtaacgtacggttaggtcgtaaataccgtaactaaaaacttaaccgaaccggtaacctaaaacgaaacccttaaacttacccgtaaccccgttaggaacgtacgttaacgtaccttacggttaggaacccggtcccggacccggtaacggaaaccgtacccggttaaacctaaactttacgtttaaacgtgtacgtaagtaaaggacggtacgggtaacccgtagtaaactttaccgtccttacggaaccagggtccgggacttaccgggaaccttcgggtacctaccggtcctaccgtacaccgtacccttacccgaagtaccccggtactaccggttcccgtccccgttcccggtaacccg

SEQ ID NO: 289895 - DNA, 835 bp, Homo sapiens
  misc_feature: GYAE6OF01EJJLK.45.38.D05.1.454.CMB.1.raw
  modified_base (572)..(572): a, c, t, g, unknown or other
  misc_feature (572)..(572): n is a, c, g, or t
tcagacgcgatcgacacgaccggtgctcgatttagtatctgatagttgggtttggggggggtcacaagaggcagcgctctcgggacgtctccaccatggcctggctctgctgctcctcactctcctcactcgaggacacaggagtcgtcgggtccctttctcgccctgacctcacgcctcgtccctccgtgtcgtggtcctccgtggacagtcgactccacctgtcggcctcgccacgtacggaaaccaacgagtgtagttggtttaggggttagttttttagttttcgtccttccgtacggtaaacccaaaccgaacccggaccccggaacgaaacccgaaccccctaaaactacgtacttaagtttaaggaacggaacctaacgtaaccggtccgggttcccggttacggggttacaacggttccgtctttcgtacgtcggtcctaccgagtcgtacgacgaaccgtccggtccctacccgtagaactacttcgtcgttcggacctaccggacggtccgtacggacgggtaacggacggtacttcgttattttacgttttcgagtttccncttacgttagttacgtcggtaaccggacgggtaaccctaggttaccggttccgggtttaggggtcccggttacgggggacggggtaaaccgggtcccggttaacgggttacccgtaacccggttaccggttacgggtacccgtaacccggaccccggtaaccgggtccccgttcccccggtcccccgttacggtaccccttttacccggtttccccggtacccccgtttcccccccggtacccgtttcccgtaccggtcccgg

SEQ ID NO: 289896 - DNA, 859 bp, Homo sapiens
  misc_feature: GYAE6OF01A2C0S.45.38.D05.1.454.CMB.1.raw
  modified_base (106)..(106): a, c, t, g, unknown or other
  misc_feature (106)..(106): n is a, c, g, or t
  modified_base (526)..(526): a, c, t, g, unknown or other
  misc_feature (526)..(526): n is a, c, g, or t
  modified_base (605)..(605): a, c, t, g, unknown or other
  misc_feature (605)..(605): n is a, c, g, or t
tcagacgcgatcgacacgaccggtgctcgatttagtatctgatagttgggtttggggggtcacaagaggcagcgctctcgggacgtctccaccatggcctggctcngctgctcctcactctcctcactcaggacacaggatcggtcgggtccctttctcgccctgactcgacgcctcgcctcgtgtcgtggtctaccgtgacacgtcgactcgaccagtcggcctcgcacctacggaaacctaacgagtgtagttcggttaggggttagtttttacgttttgtcctccgttacggtaacctaaccgaaccgaacccggtaccgaaaccgaccccctaaactaactactagtttaagtaacggactaacgtaaggtcccggtaccggttaccggggtttacaacgttcctccgttcgttaccgtcggtacccgttccgtaacgccgttacgggaccctaaacggcccggtaccccttacccgtacgaacctaacgttccgtttacgggtaaccggtcctaacccggnggtaccgtccggaagggacccgttaaggacctttcggttaaaactttttcgttttaccgtggtttccgtaccttttaanaaccggtttacgtaccggaacccggtaacggggtaccaaaccggtttggtaaccggggtttagggttcggggacccggggtacggggtaacccgggaccggttaacggggttaccgttaaccccggttacggttaaaccgggtccgaacccggttaacccggacggttcccggtaccccggtccccgttaccggtacccgttcccttcccggttacccgtttaccccccctctcccccgttggtaacccccggg

SEQ ID NO: 289897 - DNA, 572 bp, Homo sapiens
  misc_feature: GYAE6OF01CB4HB.45.38.D05.1.454.CMB.1.raw
  modified_base (287)..(287): a, c, t, g, unknown or other
  misc_feature (287)..(287): n is a, c, g, or t
  modified_base (311)..(311): a, c, t, g, unknown or other
  misc_feature (311)..(311): n is a, c, g, or t
  modified_base (499)..(499): a, c, t, g, unknown or other
  misc_feature (499)..(499): n is a, c, g, or t
  modified_base (530)..(530): a, c, t, g, unknown or other
  misc_feature (530)..(530): n is a, c, g, or t
  modified_base (563)..(563): a, c, t, g, unknown or other
  misc_feature (563)..(563): n is a, c, g, or t
  modified_base (566)..(572): a, c, t, g, unknown or other
  misc_feature (566)..(572): n is a, c, g, or t
tcagacgcgatcgacacgaccggtgctcgatttagtatctgatagttgggtttgggatcccggagggccggtcgtttttaccaaacatgacaagtagaggggcctgtcccggcttctgttggtaccagtttgcatagtgccctctgaggctgtctccgtggcatgtgatcttgactgtctgtcccaaggccacagacacagcagactcctgagtcagcccagaagaaagtacagacctatgacaaagagtgaaggagagtgagccagagaggggtcaggccagtggnggagacacccagaactctgcttcncgagcccacctcgaggacgaagatggaggtctagactattattgcagcagtcccgggaacaaccgtaaataagtggttagtttcgtttcggccggtacccggaacgtaacggtctaacccgttcgtttcggacaacggacccaacggaccccaaacccgtactacgtaccacttcctccggttccccncccttcccgtcttaccgtactccgtcgttcnggacgggtcggccgtgacgaacggtgacatagncgnnnnnnn

SEQ ID NO: 289898 - DNA, 736 bp, Homo sapiens
  misc_feature: GYAE6OF01B49VF.45.38.D05.1.454.CMB.1.raw
  modified_base (303)..(303): a, c, t, g, unknown or other
  misc_feature (303)..(303): n is a, c, g, or t
  modified_base (734)..(734): a, c, t, g, unknown or other
  misc_feature (734)..(734): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgcgtggtggcggctccggatgcgtcctgtccagctgcacctgcgaggcgtccgggccaggactgggtagaacgtccgttcgggacgtaccctcgtccctactacgttgcgtagtcgttcgttcgtggtcgaccttccaatcgaggttagtactataaagtttaaggttttcgggcgtcgggtccnccgacggcccggaggggacgggcgtaggaggtggtagtcggtactcgtacttacgtcgtacggtacggacctacttacgtaccgcgtccccgtccagaaaccgtcgtcgacgtggtactactactaacgaaactaaccgacgttaaccaaacgtaaacccttacgtttaccctcccggtaggtacgttcctaagttaacccgtcggtacggtacccgtacccgccgggtaaccggaaaccaacggtaacctaaagttcgttaacgtgacgaacggtaaggacgggtacgtcgtaaggtacttttaccgtccggttaacgaccggttacgggtggccccgttaacggtaccgtacgtaccgacccgtcgtacccgacgtaccgccccgtacaacccgggacgtaccctaccggtttccgcccccggttaccncg

SEQ ID NO: 289899 - DNA, 912 bp, Homo sapiens
  misc_feature: GYAE6OF01ENZ7D.45.38.D05.1.454.CMB.1.raw
  modified_base (209)..(209): a, c, t, g, unknown or other
  misc_feature (209)..(209): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcggccaggactggtgaagtccttcggacgaccctgtccctntacgttgcgtagtgtctcgtggtctacctcctatcgaagttagtagtactaagttaaaggttttggggacgtcggggttcccgcccgaccggaccccccggaagggggaacggggtccgtagggtacggtgggtaggtttcggggacttcggtccttacgttcgtaggtacgggaaccctaccgtaagtttaccgaccgtccccgttacccctacgaaacgtaccgtacggtacgtgggtagtaacgttctaacgtaaactaaaaccgtaccgtaaccgaaaacgtaaacccgtaacgtttacccttaccccgtagggtacgtacctaacgtaaccgttacgtacggttaccggacccccggtaccgggacccggtaaaccgaaccccgggtaaccttaaaaacgtttaccgtttaaaccgttaggtaccggtaaaccggtaaagggaacgggtaacggggtacccgttaagggttaaaactttaccgtttacccggttttaaccggtaacccgtacggggttacccgggggtacccgttaaccgggggtaaccccgtttacgggtaacccgtttacccccggttaccgttacccggttaccgtacccggttaccccgtaaccccggtaaacccggtaaacccggggtcccccttaacccgggtttccccgggtttcccccgttccccccgggtaacccccgg

SEQ ID NO: 289900 - DNA, 359 bp, Homo sapiens
  misc_feature: GYAE6OF01EYXY7.45.38.D05.1.454.CMB.1.raw
  modified_base (296)..(298): a, c, t, g, unknown or other
  misc_feature (296)..(298): n is a, c, g, or t
  modified_base (300)..(305): a, c, t, g, unknown or other
  misc_feature (300)..(305): n is a, c, g, or t
  modified_base (307)..(307): a, c, t, g, unknown or other
  misc_feature (307)..(307): n is a, c, g, or t
  modified_base (310)..(359): a, c, t, g, unknown or other
  misc_feature (310)..(359): n is a, c, g, or t
tcagacgcgatcgacacgaccggtgctcgatttagtatctgatagttggggtttgggggggtgtggtggtctccactcccgcttgacgaggctgattatttctgttgctcatatgcgagggaccagctacgttgggtggttcggcgggagggacctagggtttcgacccgtcctaagggtccacgaccccgaagggcctcccgcccccgtcggtccaccttccgtccgttcccccgtcccttcctctacgactccgtcgtacgtggacgggcgggtctggacaacggctacaatgnnncnnnnnntnatnnnnnnnnnnnnnnnnnnnnnnnnnnnnnnnnnnnnnnnnnnnnnnnnnn

SEQ ID NO: 289901 - DNA, 782 bp, Homo sapiens
  misc_feature: GYAE6OF01DE9EO.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttccctcctcctgctggtggcggctcccggatcgcgtcctgtcccagctgcacctgcgaggacgtcggccaaggcgtggtgaacgtccgttcggaaccgtcccttgtcccctcacgttcgctagtcgttcctcgtggtcgacctcaatcaaggttagtatctaagtttaaggtttgggcgtcggtcccgaccgtaccggacccccggtaaggggacgggtcgtagggtaggtcgggtaggtttacgggtacgtttcgttactacgttacgttaacgggcggtaaccctacgtacttacgacccgtcccgtccctactaacgtacgttacgtacgttggtacgtactccgtaaactaaacgaaaccgaccgtaacaaaccgtaaacctaacttccgttcctaggtacgtaacgttacgtaaccgttcgttacggacggtaccccgaccggaccgaaccgaacccgtacgttaaacttcgtaaccgtgtacgtacggaacggtacggacggtcgttaacgttacgttacgtttccgttacggtaccgtaggggttcccggtaaccgtaaccgggtaccgtacccgtccgtaaccccgtcggtcccgtacgaccgtacccgaccccgtaacgggaccgttaccccgtaccgtttccccggtaccttcccccggtaacg

SEQ ID NO: 289902 - DNA, 1030 bp, Homo sapiens
  misc_feature: GYAE6OF01AN7RX.45.38.D05.1.454.CMB.1.raw
tcagacgcgatcgacacgaccggtgctcgatttagtatctgatagttgggtttggggatgctttctgagagtcacggacctcctgtgcaggaacatgaagcacctggtgttcctcctcctgctgggtggcggctcccggatcgcgtcctgtcccagctgccacctgcaggagtcgggcccagggactggtagaagtcccgttcggacgaccccgttgtcccctcgtacgtttgaccgtaggttcggttccttcggttacgggttccgaccttccctaagtccgtaaggttacgttacgttacgttaaagtttaaaaggtttttcggggccggtttaccggggtaccccgtacccggtacccggaccccccggtaaggggggtaaaccgggggcggttacggggaaggtggggttaaggtttaccgggggaaccgtttcggttaccgttaaccgttaccggttaaggggttaccgggtaacccttacccggtttaaactaccggtaacccgtcccccggttacccgtacctaacgtaccgttccggtacgttcgggtaacgtacttacctaactaaacgttaaacccgaaacccgttaacccgtaaaaccgtaaacccgttaaacctttacccgtaacccgttacggacgggttacccttacggtaacccgtttcgttacggtacccgggacccgtacccgggtacccggtaacccgaacccggtaaaccgtaaactttaaccgtttaccgttacgtaccggtaacgtaaacgggtacgggtaacccgggttaccggtaacggtttaaaccgtttccgttaacccggtttaaccgtacccgggtacgggttaacccgggggttccgttaacccccggggtaaccccggttaccggttaccccggtttaacccggtttcccccgttccccggttaaccttaacccccggtccccggtttaaaccccccgaacccgggttaaccccgggtacccccgtttacccgggtttcccccggtttaccccccccccgg

SEQ ID NO: 289903 - DNA, 643 bp, Homo sapiens
  misc_feature: GYAE6OF01ATKIX.45.38.D05.1.454.CMB.1.raw
  modified_base (324)..(324): a, c, t, g, unknown or other
  misc_feature (324)..(324): n is a, c, g, or t
  modified_base (333)..(333): a, c, t, g, unknown or other
  misc_feature (333)..(333): n is a, c, g, or t
  modified_base (383)..(383): a, c, t, g, unknown or other
  misc_feature (383)..(383): n is a, c, g, or t
  modified_base (636)..(636): a, c, t, g, unknown or other
  misc_feature (636)..(636): n is a, c, g, or t
  modified_base (641)..(641): a, c, t, g, unknown or other
  misc_feature (641)..(641): n is a, c, g, or t
tcagacgcgatcgacacgaccggtgctcgatttagtatctgatagttgggtttgggtttagaacctatgaacattctgtaggggccactgtcttctccacggtgctccctttctgccctgactcagcctgcctccgtgtctgggtctcctggacagtcgatcaccatggcctgcactggaaccaacagtgatgttgggtagtttttagttttgtctcctggtaccaacaaccacccggcgaacgcccccaaactaatcatttatagggacactaagcggccctcgggggtttcaagtcgcttctctggctcaagtctggcaacncggcctccngacatctctgggctccagctcgaggacgaggctgtattattctgttgctnatatgacagggacagctacgtttggggtcgttcgggcgggtacggtacccgtaagggttcgacccggttccgtacgggtaccacggtaccccgaggtccgtcccggtcccccctcgggttcctaccgtccgtttcccggttcccccgtcccgttccgtccgttccgtaccgtcccggtcgttccgtaggtaccggtccgggtcggttacgggaccggtaaacggggccgacccgtaaagttacggctacgtcngtccncg

SEQ ID NO: 289904 - DNA, 760 bp, Homo sapiens
  misc_feature: GYAE6OF01EH7B9.45.38.D05.1.454.CMB.1.raw
  modified_base (215)..(215): a, c, t, g, unknown or other
  misc_feature (215)..(215): n is a, c, g, or t
  modified_base (239)..(239): a, c, t, g, unknown or other
  misc_feature (239)..(239): n is a, c, g, or t
  modified_base (394)..(394): a, c, t, g, unknown or other
  misc_feature (394)..(394): n is a, c, g, or t
  modified_base (565)..(565): a, c, t, g, unknown or other
  misc_feature (565)..(565): n is a, c, g, or t
tcagacgcgatcgacacgaccggtgctcgatttagtatctgataggttgggtttggggggggtcacaagaggcagcgctctcgggacgtctccaccatggcctgggctctgctgctcctcactcctcctcactcaggacacgaggatcgtgggcccttttgtcgccctagactcagcctgcctcgtgtctggtctcgtggacagtcgatccaccngtcggcctgcacgtagaaccaagngtgtagttggtttaggggttatttttttacggtttgtccgtccgtacggtaacccaaccgaaccgacccggtaccaaaccgtacccccaaattactacgttaatttacgaacggtactaacgtacggccggtacccggtcgggtttacacgttcnctttacgtcgtcggaccttacgacgtctacggacctaaccgaccgtcctcccgtaacaacgtaccgttacgtcgtcgggtacctaccggaacggttcccgaggaacgggaccggtagtacgttacggttttaactttacgtttcgttacgttcggtacttaactaaggttntcggaccggtaacggacgtacgtcgttaacgggtttcggttcgggttcgggacgggtaacgggtcgttccgggtaccgtaccggttacgtaccggttacgaccggtacccggacgttccccggtccgtcccccggtacggttaccaccccggtttcccgtaccccgttacccccgtccgtcccgttcccggtagg

SEQ ID NO: 289905 - DNA, 667 bp, Homo sapiens
  misc_feature: GYAE6OF01AYKXQ.45.38.D05.1.454.CMB.1.raw
  modified_base (231)..(231): a, c, t, g, unknown or other
  misc_feature (231)..(231): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggacgaccctgtccctcacttgcagtcgtctcgtggtnactccatcagtagtagtctaattaagtttgggcgtgggtccgccacgcccgagggagggctggagtggagtggatgtctactctaggtcggacctactattacacgcccgtacctacgaacgcttcgacgtcggtatactctaacaaacgtaaacacgtaccaaacaacctaacttcctaccgtagacgtctacgtaaccttgtcggtacgacccggccgaccggaacgacccggtaactaaacttacgttacgtagtacgacgaaggacggagggtcctagggtaacttacgttcctttacggaacctacggcggggtaccttacggggaacccgttcggtaaccgcccgttccgtaccctaccgtaccgtcccctaacccgaacccggtaaccggtccccgtaacggttcccgttcccttcccccggtacccgg

SEQ ID NO: 289906 - DNA, 773 bp, Homo sapiens
  misc_feature: GYAE6OF01B5GCQ.45.38.D05.1.454.CMB.1.raw
  modified_base (160)..(160): a, c, t, g, unknown or other
  misc_feature (160)..(160): n is a, c, g, or t
  modified_base (514)..(514): a, c, t, g, unknown or other
  misc_feature (514)..(514): n is a, c, g, or t
  modified_base (576)..(576): a, c, t, g, unknown or other
  misc_feature (576)..(576): n is a, c, g, or t
tcagacgcgatcgacacgaccggtgctcgatttagtatctgatagttggggtttggggggggtcacaagaggcagcgctctcgggacgtctccaccatggcctgggctctgctgctcctcactctcctcatcaggacacaggatcggtcggtccctttcncgccctgactcacgcctgcctcgtgtcgtgggtcctcgtgacacgtcactacaccagtcggcacgacacgtaacgaaccagtagtagtaggtttgggtttaggttttaaggtttttgtttcgttccgttaccggtaacggtaaacccaaccgaaacccggacccggaaccgaacccgtaaacccctaaattacttaacttaagttttacggaaaccggtaactaaccggtaccggtcccggttaccgggttacgggttactaccggtcgtttactcgttcgtaccgtacctagtacggtacgaccgtaacggacccgtacccgtaccgtaccttacggaaacctcgtttaccgnggtcccgccgtacgaccgtacgtaggaacgggtcgtaagtccggttattattttagttccgngttacgctaatggtacccgggtaacgtacgatccggtacgttcggggtttggccggggtaacggtcggggaacctaacgggttccgggtaacccgttcggtacggtccgaccggtaccgaaccggccggtaccgttcccccgtacccgggtactccgttcccgttacgcccccgttccctaaccgtccgtcgtcccg

SEQ ID NO: 289907 - DNA, 792 bp, Homo sapiens
  misc_feature: GYAE6OF01EONGP.45.38.D05.1.454.CMB.1.raw
  modified_base (738)..(738): a, c, t, g, unknown or other
  misc_feature (738)..(738): n is a, c, g, or t
tcagacgcgatcgacacgaccggtgctcgatttagtatctgatagttgggtttggggatgctttctgagagtcacggacctcctgtgcaggaacatgaagcacctgtgttcctcctctgctggtgcggctccggatgcgtcctgtccagctgcacctgcaggagtccgggccaggtactggtagaacgtccgttacggacgtacccctgtccctactacgttgactagttcgtcttaccgtggtacgaccttaccataccgtaaggttagttaactaccgtaagttaaaacggttttcggggacgttacgggtacccgaccgaccggaccccgtaagggggaacgggtcgtagggacgttagggtagttcgggtacttcggtacctaacgttcgtaacggtcgggtaacctaccgtaatttaccgacgtccccgttaccgtaacgaacgtaccgttacggacgttacggtacgtaactacctaacaaaaccgttaaacgtaacccggtaaaccctaaaacggtaaaaccccttaaagttttccctacccggtaggtaaccgggtactacggtaaccttcgtacggtaccggacccgtcggaacgaccacggtaacctaacttacgttacgacggtacgacgtaaacggcggtaacggtccgtaggttaacttcgttaccttacggaccgtacgggtcgggtacccgtaccgggtaaccctggttccctaccgttaccnccgttaccgaacgcccctaaccggaacgaacccgtctcggttcccgttaccccg

SEQ ID NO: 289908 - DNA, 885 bp, Homo sapiens
  misc_feature: GYAE6OF01B2LPT.45.38.D05.1.454.CMB.1.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcggtggccctttctgccctgactcagcctgcctcgtgtctgggtctcctggacaggtcgatcaccagtcggcctgcactcggaaccaagagtgatggttgggtagtttttagtttgtcttccgtaggtaaccaacaaccgaccccggacgaacgacccccaaactaactacctatttaacgtaacggggacaacgtaacggccgggtcccggttacgggggttttacaaacggttcgtacctttcgtacgttcgggacctaccgtaaacggtccgtacggaacccaaaccgtacccggacccttccccgtaacggtaaccgtaaaccttcccgttaccggtacggggtacccttaccggaaccggggttacccgtacccggaaccggggtaaaccggggtaccgggtaccgttaacgtttaacgttttaacgtttacgtttacggtttcggtaccttacgtaagttacgtacgggaccgtaacgggtaacccgaacggtaccggttaaccgggtttacggggttaccgggtttaccggggtaccggggtaacggggttaaccggtaacggggttccgtaaacccgggttccccggttaacggtaccggtaaccggtaaccccgggtaacccgggtccggttacccgggtccccccggtttacccgggtacccgttaaccccgttcccgttaccccggttacccccccgttacccccgttccccggttcccggttaacccgg

SEQ ID NO: 289909 - DNA, 801 bp, Homo sapiens
  misc_feature: GYAE6OF01B4A02.45.38.D05.1.454.CMB.1.raw
  modified_base (601)..(601): a, c, t, g, unknown or other
  misc_feature (601)..(601): n is a, c, g, or t
tcagacgcgatcgacacgaccggtgctcgatttagtatctgatagttgggtttggggatgctttctgagagtcacggacctcctgtgcaggaacatgaagcactgtgtcctctctgctggtgcggctccggatgcgtcctgtcccagctgccaccgtgcaggacgtccgggcccgaggacgtggtagaacggtccgttacggacgtaccctcgtccctctacgttcgctagttcgtctcgttgggtacacctaccgtatacgtaagttaagttacgtactaagtttaaaggttttcggggtcgtcgggtccgaccgaccggacccggaagggggtaacgggcgttagggaggttacggtaggttacgggtacttcgtaccgtacgtcgtagggtcggtaaccctaaccgttacgtacgtaccggtaccctcccgtaagtaaccgtacgtccgtaagttcgggtactacgttacctaacaaactaaacgtaccgtaaccaaaacgtaacctacgttccgtacccgttaggacgtcctacgtaaccttcgtcgtaccggaccgtaccggacggtaaccaaccggtaacctaaagttcttacgnggtagaacgaggtaccggaacggttccgtaagttaacttaccgttaccgtttaccgggaccgtaaccgggtccgggtacccgtaaccgggtacccgttcggggtaacccctcgtttacccgtccgtaacccgtaaccggccctttaacccggacccggtaaacccggtccctaacccggttttcccggtaacccccccgg

SEQ ID NO: 289910 - DNA, 839 bp, Homo sapiens
  misc_feature: GYAE6OF01CB9M9.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctctgctggtggcgctccggatgcgtctgtcccagctgcactgcgaggagtccgggacccaggtacgtgggtacgaacggtccgtttacggaaccgtccccgttgtcccctactaacgtttcgcgtacgttcggttcctccggtggtctaaccctcaagttcgaggttagtagtactaaaggttttaaggtttcgggacgttacggtacccaaccggacccggacccgggaagggggacgggcgtagggtggtggtaggttcgggtacttcgtacttacgttcggtacggtccgtaacctaccttaacgttaccacccggttaccctaccacggtaacgtacgtaccggtaacgtgggtacgtactaccgtaataaaccgtaaccgtacgtaaaccgaaaccgttaaaccttacgtttccccgtacgtaggtaccgtttactaacggttaccgttggtaacggttaccccgacccgggacccggtaaccggtaaccgtaaccggaactttaaaacgttcgttaccgtaggtaacgaacggtaagggtaccgggttacgaccgttaagtttaaccctttcggttacgttaacccggacgggttaccggggttaccgaccggttacccggtaccgttccggtaccctccggtcccttaccgcggtcccgtaccccaacggtacccggtacgttacccttcgggttcccccttcccgttaccccgcccg

SEQ ID NO: 289911 - DNA, 830 bp, Homo sapiens
  misc_feature: GYAE6OF01A75TM.45.38.D05.1.454.CMB.1.raw
  modified_base (215)..(215): a, c, t, g, unknown or other
  misc_feature (215)..(215): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtctgtccagctgcacctgcaggagtcgggccagggactggtgaacgtccgttcggacgtaccctgtcccctnacttgctagttcgtctcgtggtcgacctccatcagttagtacgtactaagttaaaggttttcggggacgttcggggtcccgaccgtaccggacccccggaagggggaacggggtccgtagggaggttggacgtttgggacttgtcctacgttcgtaggtcggacctacttacttacgaccgtccccgtacctacgtaacgtaccgtacgtacgttggtcgtaacttaccgtaactaaacgttaaaccgtacccgttaacccgaaaacgtaaacccgttaaactttcccgtacccggtaggtaacggtcccgtaagtaacccgttcgtaccggttacccggaaccccgggtcccggtaacccgggtaaccgaacccgggttaacctaaaacgtttaccgtttaaccgcggtaaccgacggtaaacggacggtacgggtaccgtaacggttaactttaccgttcccgttaacgtacccggtacgggtacggggttacccgttaccgggtaaccccggtttccggtaccgttaccccggttccgttcccgttacgacccgttccccgtaaccccgaaccgggtaacccggtcccctaccggttcccggtttccccccg

SEQ ID NO: 289912 - DNA, 711 bp, Homo sapiens
  misc_feature: GYAE6OF01B4SCW.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtccgggcccaggactgggtagaacgtccgtttcgggacgtacccttcgtcccctctactttgctagttgtctcgtaggtcgacctccatcagtagtagtctaagttaagtttggggctcgggtccgccacgccccggaggggagggcgtgggagtggtagttcgggactgtctacgtcgtaggtcggacctactataccgacgccccgtcctacgaacgtctacgtacgtggtacgtactcgtacaaactaaccaacgtaccaaacgtaacctaacttccctaccgtacgacgtctagtaacctcgtacgtacggacccgccggacgaaccgaaccggtaacctaaagttacgttacgtagtacgaacgaaggtacggacggtaccgttaaggtaactttacgttaccgttacgacccgttacgggtccgggtaccgttaacgggtacccgttcggttacccgtacccgtccttacccgtcgtacccgtaccctacccgaacgtacccggtaccctacggttcccggttaccctccccgtaccg

SEQ ID NO: 289913 - DNA, 787 bp, Homo sapiens
  misc_feature: GYAE6OF01EZ1HJ.45.38.D05.1.454.CMB.1.raw
  modified_base (591)..(591): a, c, t, g, unknown or other
  misc_feature (591)..(591): n is a, c, g, or t
tcagacgcgatcgacacgaccggtgctcgatttagtatctgatagttgggtttggggggggtcacaagaggcagcgctctcgggacgtctccaccatggcctggctctgctgctcctcactctcctcactcaggacacaggatcggtgggtccctttcgtgccctgactcacgcctgcctccgtgtcgtgggtctcgtggacagtcgatcacagtcggcctgccaactacggaaccaagagtgagttggtttggttagttttttacgtttgtccgttaccgtacggtaacccaaccgaaccgaccccggacgaaaccgaaccccctaaaacgtaactacttaacgttttaacgaacgggtaactaaccgttaaccggccgggttccccggttacgggggtttaccaacggttcgtccgtttaccttcgtcggaccttaccgaagtcgttacggacctaacccggaccgtcccttacccgtacgacctacgttctcggtacggcctccgaggtccacgacggacgacggtcgtagttactttacgtttcgttcgttacgcttacgtacttagtacggacggacggtaaccgnggtaccgttaggtttcggggttcggttaccggggtacggggtaccggtacgttacgggttaccgtaccggttaccggttacgggtacctaacccgggtaccggtaaccggtcccggttaccccggcccccgttacggtacccgtaccgtttcccggttaccccttaccccctacccgttcccgttcccgtacccgg

SEQ ID NO: 289914 - DNA, 914 bp, Homo sapiens
  misc_feature: GYAE6OF01C5I44.45.38.D05.1.454.CMB.1.raw
  modified_base (890)..(890): a, c, t, g, unknown or other
  misc_feature (890)..(890): n is a, c, g, or t
tcagacgcgatcgacacgaccggtgctcgatttagtatctgataggttggggtttggggggggtcacaagaggcagcgctcgtcgggacgtctccaccatggccgtggctctgctgcctcctcactctcctcactcgaggacacgaggatcggtcggtccctttcgtcgccctgactcacgtctcgccttccggtgtcgtcggtctccggtcgacacgtcgactacacctagtcggtcctacgaccgtaaccggtaacgaaacccaaggtagttggtaggtttgggtttaggggtttacgttttttacgtttcgtaccgttccggtaacggtaaacccaaaccgaacccggaccccggaaccgtaaacccgaaaccccctaaattaactacgttaaagtttaaccggaacggaaccctaaacggtaaccggtcccggggtttaccgggtttaccggggtttacaacggttcccggttccttacggtcggtcgtaacctaccggtaacgtacggtacgaaaccgtaacccgtcccggtaccctacgtaataactacgttccgtacggtaccggtcctaccgtagggtccgtaaaccggaacgggtaccggtaaggtcgtttaccgtttaagtttttaccggtcgttacggttactctaacgtaacgttaaccggcgaaccgggtaacgggtacccgttaagggttcccgggttagggttacgggggttcgggaaccgggtccgggggtaaaccgttccgggtttaaccggccggttaaacccgttcgggttacggaacccccggtaacggacccccggtagggtcccccggtacccccttcccgggtaccggtacccttaccccggttcccggttcccccgttaacccccnccccgtttacgtcccggtaaaccg

SEQ ID NO: 289915 - DNA, 798 bp, Homo sapiens
  misc_feature: GYAE6OF01ENHIK.45.38.D05.1.454.CMB.1.raw
  modified_base (226)..(226): a, c, t, g, unknown or other
  misc_feature (226)..(226): n is a, c, g, or t
  modified_base (306)..(306): a, c, t, g, unknown or other
  misc_feature (306)..(306): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtccgggcccagggacttgggtagaagtcccgttcgggaccgtaccccccgttccctntaccttggcctaggttcgtccttcgtggtcacctccatcgaaggtagtagtactaattaaagttttggggctgggtcccnccgacgccccgaaggggaacggggctgggtaggtgggtagttcgggacttgttacgttacgtcgtacggtcgggtaaccctaccgttattaaccgaccggtccccctaccccttacgaacgtaccgttaccgagttcgggtatacgtcctactaaaactaaaccgaccgtaccaaaacgtaaacctaacgtttccctaccgtaggacggacctaggtaaccttcgttacgtcccggtacccggcccgtacggaacccgtacggaacctaaattacgttaacgtgtcgaacaagggtaggaccggtacgttaaggtactttacgttacccgttacgaacccggtacggtaccgggtacccgtacgggtaaacccccgttggtaaccccgtcccgtttacccgttccctccgtacccgttaccccgtacccccgtaacccgggaccccgggttaccccacccggtttccccggtttccccgttaccccccccgg

SEQ ID NO: 289916 - DNA, 810 bp, Homo sapiens
  misc_feature: GYAE6OF01C4THJ.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtgcggctccggatgcgtcctgtcccagctgcacctgcgaggacggtccggcccaggactgggtacgaacgtccgttcggaacgtacccctgtcccctctacgttcgactaggtcgtctcgtagggtcacctccaagtcgtaaggtacgttacgaacttaacgtttaaaggttttcggggtaccggttcgggtcccgtacccgaaccggaccccggtaagggggaacggggtacgtgggtacggttgggtaacggttcggggtacttcggttaccgttaacggttacggttaacgggttaccgggtaaccccttaaaccgtttaacgttaacccgacccggtacccccgttacccgttaacgaaccgtaccgtacgtacggttacggtacggttactaccgtaacaaacgtaacaccgttaacgaaacgtaacctacgttccctaccggtacgtacggtctaaccgtaacgtcgtacgtaccggacccggtccggaccgaaccgaccggtaactaacgttacttacggtgtacgacgaaggtaccggacggttacgtaacgttattaccgttaccgttacgaccgtcgggtaccggtacggtacccggtacgtcggtacccgtaccggttcctaccgtccgacctcccgtacccgaacgaccggtccctaccggtccgtacccccg

SEQ ID NO: 289917 - DNA, 742 bp, Homo sapiens
  misc_feature: GYAE6OF01CG6CZ.45.38.D05.1.454.CMB.1.raw
  modified_base (219)..(219): a, c, t, g, unknown or other
  misc_feature (219)..(219): n is a, c, g, or t
tcagacgcgatcgacacgaccggtgctcgatttagtatctgatagttgggtttgggggctttctgagagtcacggacctcctgtgcaggaacatgaacgcacctgtggttcctcctctgctggtggcggctccggatgccgtctgtcccagctgcactgcaggagtccgggcccagggacttggacgaacgtccgttggaacgtccccttggtcccctnacgttgctagtcgttcctcgtggtcaccttccgattcagtacgtagactaagttttaaacgttttcggggcttcggggtacccgacccgaccggtaccccggaagggggacgggtccgtaggaggtcggtaggttcggggaacttcgtacgtactacgtaggtccggtaacctacgttaattaccgacgtccccgttacctagtaaactccgtcgtacgttcggtagtactactaacaaaactaaccgtacgtaaccgaaacgtaaaccctaagttcccctcgtaggactacgtacgtaacttcgagtcccggaaccgccgacggaaccgacgtaactaaattacgttacgtacgacgaagtaacggcgtaacgtcgtaaggttacttaaccgttccgtaggtaaccctaggttccggggaaccgttacgggacgttcccggtactcccgttactccggtaccaccgtcccgtaccgaaacccgggacgtcccgttaacgtcccggtcccgtccccgtaccgg

SEQ ID NO: 289918 - DNA, 1015 bp, Homo sapiens
  misc_feature: GYAE6OF01D6WH7.45.38.D05.1.454.CMB.1.raw
tcagacgcgatcgacacgaccggtgctcgatttagtatctgatagtttggggtttgggggctttctgagagtcacggacctcctgtgcaggaacatgaagcacctgtggttcctcctcctgcgtgggtggcggctccggatcggccgtcctcgtcccagctcgacctacctggacgtagggtacggtccgggacccgaaggtacggttggtacggaacgtcccggttacgggaccgtaccccgttcgttacccctacttaccgttcgaccttaggttcgttccgtttccggttacgggtacctaccctaccgtacgttacggtaaggttaacggttaacgtttaacgtaaaacgtttttaaacggggttttcggggtccggttaccggggtaccccgtacccggaacccgggtacccccggggtaaaggggggtaacggggtcggttaggggtacgggtagggttacggttacgggtaaccgttcggtttaaccgtttaccggtaacgggttacgggtaaccgggtaaacccttacgtttaaaccgttacccgtacccggttacccccgttaaccctaaacggtaacccgtaaccgttaccggtacggtttcgggttaactaaccttaccgttaaaacctaaaaacccgtaaaaccgtaacccgtaaaccgaaaacccgtaaacttaaccctttacccggtaccggtacggtaacgtccttaaacggttaccgttacgtacccgggacggacccccggtacgggaaccgaaacccgggtaaccttaaactaactttacggtacggtagaacgacggaacggtacgggtacgttaacggttaattaacgttttacgtacccgtaggttacccggaccgggtaccgggtacccggtaaccggtaccgttcccgtaacccgtaccccggttcttaccgacccgtccctaacccggtccgaaacccgggcccggttaacccctccgggttttccccccgtacccgtccccggtaacccc

SEQ ID NO: 289919 - DNA, 761 bp, Homo sapiens
  misc_feature: GYAE6OF01AOP8L.45.38.D05.1.454.CMB.1.raw
  modified_base (124)..(124): a, c, t, g, unknown or other
  misc_feature (124)..(124): n is a, c, g, or t
  modified_base (418)..(418): a, c, t, g, unknown or other
  misc_feature (418)..(418): n is a, c, g, or t
tcagacgcgatcgacacgaccggtgctcgatttagtatctgatagttggggtttggggggggtcacaagaggcagcgctctcgggacgtctccacatggcctgggctctgctgctcctcactcncctcactcaggacacaggatcggtcggtccctttctcgcctgactcacgcctgtccgtcgtgtcgtcgggtctccgtaggactagtcgactccacctagtccggcctacgcgaccgtaggaaaccaacgtaggttgtacgtttgggtttaggttagtttttttcggttcgttaccgtccgttacggtaaccaaccgaacccggtacccggacgaaccgacccctaaattattactagtttaggacggaacacgtacggtccggtaccggttcgggttacacgttctcttcgtcncggtactcgagtcgaggaaccctacgcccgtcctacgtacgactaccgtcgtccggtaacggcctcggacgtaccgtacgacgggacggtacgtctttagttacgttttacgttcgtacgtttcgaccgtttagtacgtacgtacggtaaccggtaaccgggtaactaccgggttaacgttccggggttaggggtacgggttaccgggcgggtaacgggttcgtacggtccgtcgttaaccgtcggttaccggaacggtacccgtagtccccggtcgtaccccggttattacccgtcgttccccggttacccgttcccgttacccgtaccgttccgggtaccg

SEQ ID NO: 289920 - DNA, 836 bp, Homo sapiens
  misc_feature: GYAE6OF01E1K0D.45.38.D05.1.454.CMB.1.raw
  modified_base (174)..(174): a, c, t, g, unknown or other
  misc_feature (174)..(174): n is a, c, g, or t
  modified_base (614)..(614): a, c, t, g, unknown or other
  misc_feature (614)..(614): n is a, c, g, or t
  modified_base (656)..(656): a, c, t, g, unknown or other
  misc_feature (656)..(656): n is a, c, g, or t
tcagacgcgatcgacacgaccggtgctcgatttagtatctgatagttgggtttggggggggtcacaagaggcagcgctctcgggacgtctccaccatggcctgggctctgctgcctcctcactctcctcactcgaggacacgaggatcgtcggtccctttctcgccctgactcncgcctcgcctccggtgtcgtcggtctccgtggacacgtcgactaccacctacttcctccgtacgccgtaaccgtaaccggaaaccgacggacgtaagggttggtacggttttaggggtttaacgggttaaacgttttaaccgttaacccgtttcgttacccttacccggttaacggtaaacccaaaccggaccgaaccccggaacccccggaaaccgaaaccccctaaccccctaaacgtcttaacggttacgttaagtttacggacgggtaacgggacgtaacggtaacccggtcccggttacccgttacgggtttaacggtttaacctacgttcccgttccgtttcgtacgtaccgggtacccttacgtaacgttccgtaaccggacctaacccgcccggttaccctcgtataaccgtacttccgtacggtccggtcncggaggtcgacggacggtacgtacgtatacgttaacgttacncgtacgtcgtacttacgtataacgttcggtacggtaaggtttaggtttaagttcggttttacgggttcggtcggggtaacggtcgggaaacgttacaccggttcggtacccggtaacgtacggtacgaccggaccgacccggtaccgccggttacccgtccccggttagtcccgttaccg

SEQ ID NO: 289921 - DNA, 818 bp, Homo sapiens
  misc_feature: GYAE6OF01BGQFK.45.38.D05.1.454.CMB.1.raw
  modified_base (128)..(128): a, c, t, g, unknown or other
  misc_feature (128)..(128): n is a, c, g, or t
tcagacgcgatcgacacgaccggtgctcgatttagtatctgatagttggggtttggggggggtcacaagaggcagcgctctcgggacgtctccaccatggcctgggctctgctgctcctcactctctnactcaggacacaggtatcggtcggtccctttctcgacccttgactcacgtccgtcgtccgtccgtgtcgtcggggttcctcgtaggacagtcgatcaccgtagtcggctgcgacgtacgaacctagtagtgtagttggtttaggttagttttaggtttcgtacttccgtacgtaaccctaactaaccgacccggacgaacccgtaacccctaaacttactactacgttaagacggaactacgtacggtacccggtccggttacgggttacacggtccgtcttaccgtgtcgtcgtacccgtagtccgtaggaaccctaacgtacccggtcctaccgtaacgtaacttactaccggtcggtacgtaccgttaccggtacggtaccgtaacggacgggtagggtaaccgttcgtttaacggtacttttagtttcgttgtttaccgtacgtttacgtagttaccggtacggaaccggtaaaccggtcgtaaccggttcggttccgggtttaaggggttcccggggtaggggtaaccgggtacgggtaacggttaccggttacggttaccccggttcggtaacggttacccgaccgggacccggttaccgtacccggttccccgggtaccccggttcgtaccgttccgttcccggttcccgttacccccggttcccttacggtacccgtaccgg

SEQ ID NO: 289922 - DNA, 952 bp, Homo sapiens
  misc_feature: GYAE6OF01BBHAD.45.38.D05.1.454.CMB.1.raw
tcagacgcgatcgacacgaccggtgctcgatttagtatctgatagttgggtttggggggggtcacaagaggcagcgctctcgggacgtctccaccatggcctggctctgctgcctcctcactcctcctcactcaggacacgaggacttcggtcgggtccccttttcgtcgccccgttagacctcacgtcctcgccgttccgtgtccgtggtcctccgtggactagtcgatcaccgagtcgcctcgactacgtacggaaaccaagtaggtgtagtttaggtttggggtttaagttttttacgttttcgttccgttccgttaacggtaaccctaaaccgtaaccccgggaaccccggaaccggtaaaccccaaacccccgttaaaacgttaaccttaacttaacgttttaacgaacggtaacccgtaaccgtaacgggtaccccgggttcccggtttaccgggggtttacctaacggttccgtaccgtttccgttccgtcgtccctaccgtacgtccggtacgaaccgtacccgtacccgtcccttacccgtaacgtactaacccgttccgtccggttaaccggtcccgtaccgtacgggtacccgtaccggtaccgggtacggtacggtaccgttacgttacgttttacgttttcgttacgttcgttccgttacgttaacgtacgtacggtacggtaaccggtaccgtaccgggtaccggtttacgggtttacggggttaccggggttaccggggtaccgggtaccggggttaaccggttaaccggggttaccgggttacccgggttacccggttaccggtacccggtaccgggtaccccggtaccggttcccggttacccccggttcccccggttaccgtccccgttacccgttaccccgtttacccccggttacccccggttccccccgtttcccggttcccgttacccgg

SEQ ID NO: 289923 - DNA, 806 bp, Homo sapiens
  misc_feature: GYAE6OF01B4FYC.45.38.D05.1.454.CMB.1.raw
  modified_base (126)..(126): a, c, t, g, unknown or other
  misc_feature (126)..(126): n is a, c, g, or t
tcagacgcgatcgacacgaccggtgctcgatttagtatctgatagttggggtttgggggctttctgagagtcacggacctctgtgcaggaacatgaacgcacctgtcggttcctcctcctgctggnggcggctccggatgcgtcctcgtccagctcgcacgtgcgagggacggtccgggaccaggacgtgggtacgaacgtccgttacggacgaccccttcgtccctctacgttgcgtagttcgtctcgtaggtcgacctccgatcgtaagtagttatacttaagtttaacggtttcgggcgtccgggtacccgaccgaccgggaccccggaaggggtacgggtcgtagggaggtcggtacggttcgggtacgttcggttactacgttcgtacgggccggaacctactacttaccgaccggtaccccgtccacgaaccgtccgtacggcgttgtacttactactaacaaacgttaacgaccgtaactaaacgtaaccttacttaccgtaccggtagtacggtacgttacgtaaccgtttcggtaccggtacgggtacccccggtacggaaccggaaccgtaaccgggtaactttaacgttaccgtacgttagggtacgacggtaacgggacgggtacgggtacgttaaccgggttattacccgggttacgttacgaccgttaacgggtccgggtacggtaccggtaccgttcggtaccgttacccgttcgttacccgaccgtacccgccgtaaacccgccgggtaccgtaccgttacccgtccccgttacccgttccccgtacccg

SEQ ID NO: 289924 - DNA, 754 bp, Homo sapiens
  misc_feature: GYAE6OF01DTMWI.45.38.D05.1.454.CMB.1.raw
  modified_base (165)..(165): a, c, t, g, unknown or other
  misc_feature (165)..(165): n is a, c, g, or t
  modified_base (182)..(182): a, c, t, g, unknown or other
  misc_feature (182)..(182): n is a, c, g, or t
  modified_base (492)..(492): a, c, t, g, unknown or other
  misc_feature (492)..(492): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtgcggctccggatgcgtcctgtcccagctgcacctgcgaggngtcggccaggactggtnaagtccttaggactaccctgtccctcacttcgctagtgtcttcgtggtcactcatcagtagtgttctaagttaacggtttcgggcgttcgggtcccgaccgaccggaccccggtaagggggaacggggtcgtacgggtaggtcggtacggttcggggaactttcgtacttacgttacggtaggtaccggtaacctaccgttacttaccgtaccgtccccggtacctaacgacgtacctcggtacgttgtacgtaactaccgtacgaaaactaaaccgacgaacccaaacgtaaaccttactccgtaccgngacgtcttacgactccgtgtaccgccgccgtacggaaaccgtcggtaacctaattacggttactaggtacgtaacgaacgggtacgggaacgttacggtaacggttaacttttcgttaccgttacggacccgttaggggtcccgggtacccgttacgggaacccttcggtcccctaccgtcctaacgtcccgtacgtacccccgtaccaaaccggggtacccttacccgtccgttacccggttccccgttcccgtaaccccg

SEQ ID NO: 289925 - DNA, 779 bp, Homo sapiens
  misc_feature: GYAE6OF01BGG16.45.38.D05.1.454.CMB.1.raw
tcagacgcgatcgacacgaccggtgctcgatttagtatctgatagttgggtttggggggggtcacaagaggcagcgctctcgggacgtctccaccatggcctggctctgctgctcctcactctcctcactcaggacacaggatcggtcgggtcccttttctcgccctgactcagcctgcctcgtgtcgtggttctccgtggactagtcgatccaccagtcggcctcgcactacggaaaccaagtagtgagtttgggtttaggttagtttttagttttgtccttccgtacgtaacctaaccaaccgtaacccggacgaaccgacccctaaactaactactattagtacggacactacggccggtccgttcggggttactacgtcgtcttcgtcgtcgctactaggtctgaccaacgccgtccgtcctacgactaacgtcctacgtcgggtcctaccgcggacctacgaacggtacggacggtacgttaggttaacttttacgtttcgttgtttcggtaccttacgtagttacgtacggtaccggaacgggtaaccctccgggtacgtttacgggtttcgggtttaccggggtaccgggggtaccggggtaacgggttaacccgggttacggttaccgggtacccggttaccgggtaacggttaccggacccggttaacccggacgggttacccctccccgggttccccggttaccggttcccgttaacccggttcccgttacccggttcccccgttccccttcccgttacccggttcccg

SEQ ID NO: 289926 - DNA, 778 bp, Homo sapiens
  misc_feature: GYAE6OF01BS8AD.45.38.D05.1.454.CMB.1.raw
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (238)..(238): a, c, t, g, unknown or other
  misc_feature (238)..(238): n is a, c, g, or t
  modified_base (390)..(390): a, c, t, g, unknown or other
  misc_feature (390)..(390): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactgggtgaacgtccctttcgggagaccccttgtcccctcacttgctagtntctntggtnacttccatcagtagtagtctaattaagttttgggactcgggtccgccgacgtcccccggaaggggacggggctgggacgtgggtagttgggactgtccttacgtcgtacgggtcggaacctaccgttaatacgaaccgtcccttacccgtanaacgtaccgtacggtacttgggtactaacttcctaacgtaaactaaaccgtaccgtaacccgtaaaacgtaaacccttaaactttcccgtaccccgttagggtacgtccgttaacggtaaccttcgtacggtaccggaacccccggtcgggaccggaaccgacccggtaacctaaattacgtttaccgtcggtgacgtaaggagggtaacggtccgtaagggttaactttacgttaccgttacggaccctacgggtacggggcccgtaaccggggttaccttcgggtaccctaccggtccctttaccggtaccgtaccgtccctacccggaacccggtaccggggtcccctaacgggtttccccggttccccttaccccggtacccgg

SEQ ID NO: 289927 - DNA, 244 bp, Homo sapiens
  misc_feature: GYAE6OF02IN3I0.45.38.D05.1.454.CMB.1.raw
  modified_base (242)..(244): a, c, t, g, unknown or other
  misc_feature (242)..(244): n is a, c, g, or t
tcagacgcgatcgacacgaccggtgctcgatttagtatctgatagttgggttggggtgtggtggtctccactcccgccttgacgaggctgattatttctgttgctcatatgcagggaccagcacttgggtgttcggcggagggaccaggttgaccgtcctaggtcagcccaaggctgcccctcggtcactctgttcccacctcctctcgatcgcgtctgagcgggctggcaaggcgcatagnnn

SEQ ID NO: 289928 - DNA, 173 bp, Homo sapiens
  misc_feature: GYAE6OF02GI75Y.45.38.D05.1.454.CMB.1.raw
  modified_base (172)..(173): a, c, t, g, unknown or other
  misc_feature (172)..(173): n is a, c, g, or t
tcagacgcgatcgacacgaccggtgctcgatttagtatctgatagttgggtttgggaagaggaagactgacggtccccaggagttcaggtgctgggcacagcggccctgggctgcctggtcaaggactacttcctcgatcgcgtctgagttcgggctggcaaggcgcatagnn

SEQ ID NO: 289929 - DNA, 171 bp, Homo sapiens
  misc_feature: GYAE6OF02IEXDL.45.38.D05.1.454.CMB.1.raw
  modified_base (171)..(171): a, c, t, g, unknown or other
  misc_feature (171)..(171): n is a, c, g, or t
tcagacgcgatcgacacgaccggtgctcgatttagtatctgatagttgggtttggggaagaggaagactgacggtcccccaggagttcaggtgctgggcacagcggccctgggctgcctggtcaaggactacttcccgatcgcgtctgagcgggctggcaaggcgcatagn

SEQ ID NO: 289930 - DNA, 247 bp, Homo sapiens
  misc_feature: GYAE6OF02FXKL7.45.38.D05.1.454.CMB.1.raw
  modified_base (246)..(247): a, c, t, g, unknown or other
  misc_feature (246)..(247): n is a, c, g, or t
tcagacgcgatcgacacgaccggtgctcgatttagtatctgatagttgggtttgggggtgtggtggtctccactcccgccttgacgaggctgattatttctgttgctcatatgcagggaccagcacttgggtgttcggcggagggaccaggttgaccgtcctaggtcagcccaaggctgccccctcggtcactctgttcccgccctcctctcgatcgcgtctgagcgggctggcaaggcgcatagnn

SEQ ID NO: 289931 - DNA, 249 bp, Homo sapiens
  misc_feature: GYAE6OF02G1XJ7.45.38.D05.1.454.CMB.1.raw
  modified_base (245)..(249): a, c, t, g, unknown or other
  misc_feature (245)..(249): n is a, c, g, or t
tcagacgcgatcgacacgaccggtgctcgatttagtatctgatagttgggtttggggtgtggtggtctccactcccgccttgacgaggctgattatttctgttgctcatatgcagggaccagcacttgggtgttcggcggagggaccaggttgaccgtcctaggtcagcccaaggctgccccctcggtcactctgttcccaccctcctctcgatcgcgtctgagcgggctggcaaggcgcatagnnnnn

SEQ ID NO: 289932 - DNA, 247 bp, Homo sapiens
  misc_feature: GYAE6OF02HV5HD.45.38.D05.1.454.CMB.1.raw
  modified_base (244)..(247): a, c, t, g, unknown or other
  misc_feature (244)..(247): n is a, c, g, or t
tcagacgcgatcgacacgaccggtgctcgatttagtatctgatagttgggtttgggggtgtggtggtctccactcccgccttgacgaggctgattatttctgttgctcatatgcagggaccagcacttgggtgttcggcggagggaccaggttgaccgtcctaggtcagcccaaggctgcccctcggtcactctgttcccacctcctctcgatcgcgtctgagcgggctggcaaggcgcatagnnnn

SEQ ID NO: 289933 - DNA, 173 bp, Homo sapiens; identical to SEQ ID NO: 289699
  misc_feature: GYAE6OF02FFS2H.45.38.D05.1.454.CMB.1.raw
  modified_base (173)..(173): a, c, t, g, unknown or other
  misc_feature (173)..(173): n is a, c, g, or t

SEQ ID NO: 289934 - DNA, 248 bp, Homo sapiens; identical to SEQ ID NO: 289723
  misc_feature: GYAE6OF02GBB0L.45.38.D05.1.454.CMB.1.raw
  modified_base (246)..(248): a, c, t, g, unknown or other
  misc_feature (246)..(248): n is a, c, g, or t

SEQ ID NO: 289935 - DNA, 247 bp, Homo sapiens
  misc_feature: GYAE6OF02GQ74L.45.38.D05.1.454.CMB.1.raw
  modified_base (246)..(247): a, c, t, g, unknown or other
  misc_feature (246)..(247): n is a, c, g, or t
tcagacgcgatcgacacgaccggtgctcgatttagtatctgatagttgggtttgggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccgccctcctctcgatcgcgtctgagcgggctggcaaggcgcatagnn

SEQ ID NO: 289936 - DNA, 248 bp, Homo sapiens
  misc_feature: GYAE6OF02F1B81.45.38.D05.1.454.CMB.1.raw
  modified_base (246)..(248): a, c, t, g, unknown or other
  misc_feature (246)..(248): n is a, c, g, or t
tcagacgcgatcgacacgaccggtgctcgatttagtatctgatagttgggtttgggggtgtggtggtctccactcccgccttgacgaggctgattatttctgttgctcatatgcagggaccagcacttgggtgttcggcggagggaccaggttgaccgtcctaggtcagcccaaggctgccccctcggtcactctgttcccaccctcctctcgatcgcgtctgagcgggctggcaaggcgcatagnnn

SEQ ID NO: 289937 - DNA, 538 bp, Homo sapiens
  misc_feature: GYAE6OF02IQ58N.45.38.D05.1.454.CMB.1.raw
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaacccaacagtgatgttgggagttttagtttgtctcctggtaccaacaacacccggcgaagcccccaaactaatcatttatagggacactaagcggccctcgggggtttcaagtcgcttctctggctcaagtctggcaacacggcctccctgacaatctctgggctccaggctcaggacgaggctgattatttctgttgctcattatgcaggtatagttactttggtgttcggcggagggtaccaagctgaccgtctaggtcagcccaaggcctcgccccctcggtctactcttcgttccccgcccttcctctccg

SEQ ID NO: 289938 - DNA, 276 bp, Homo sapiens
  misc_feature: GYAE6OF02GSR9N.45.38.D05.1.454.CMB.1.raw
  modified_base (246)..(276): a, c, t, g, unknown or other
  misc_feature (246)..(276): n is a, c, g, or t
tcagacgcgatcgacacgaccggtgctcgatttagtatctgatagttgggtttgggggtgtggtggtctccactcccgccttgacgaggctgattatttctgttgctcatatgcagggaccagcaccttgggtgttcggcggagggaccaggttgaccgtcctaggtcagcccaaggctgccccctggtcactctgttcccgcctcctctcgatcgcgtctgacgcgggctggcaaggcgcatagnnnnnnnnnnnnnnnnnnnnnnnnnnnnnnn

SEQ ID NO: 289939 - DNA, 249 bp, Homo sapiens
  misc_feature: GYAE6OF02G8LYD.45.38.D05.1.454.CMB.1.raw
  modified_base (246)..(249): a, c, t, g, unknown or other
  misc_feature (246)..(249): n is a, c, g, or t
tcagacgcgatcgacacgaccggtgctcgatttagtatctgatagttgggtttgggggtgtggtggtctccactcccgccttgacgaggctgattatttctgttgctcatatgcagggaccagcacttgggtgttcggcggagggaccaggttgaccgtcctaggtcagcccaaggctgccccctcggtcactctgttcccaccctcctctcgatcgcgtctgagcgggctggcaaggcgcatagnnnn

SEQ ID NO: 289940 - DNA, 547 bp, Homo sapiens
  misc_feature: GYAE6OF02IOZA3.45.38.D05.1.454.CMB.1.raw
tcagacgcgatcgacacgaccggtgctcgatttagtatctgatagttgggtttggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataattttggggctgggtccgccagcccccaggaagggctggagtggattgggactgtctactctagtgggaccacctattacagcccgtccctcaagactcgactggtgatctcaataaacacgtccaagaaccaattctccctgaggctgaactctgtgaccgccgcggacaccggccaaatattactgtgcaagagagggcctggaattatcctttgacctacgtcgggcctgggaaccctggtccaccggtctccctcacgcctccaccgaacgggcccatccggtccttcccctcgg

SEQ ID NO: 289941 - DNA, 175 bp, Homo sapiens
  misc_feature: GYAE6OF02IX8RO.45.38.D05.1.454.CMB.1.raw
  modified_base (173)..(175): a, c, t, g, unknown or other
  misc_feature (173)..(175): n is a, c, g, or t
tcagacgcgatcgacacgaccggtgctcgatttagtatctgatagttgggtttgggggaagaggaagactgacggtcccccaggagttcaggtgctgggcacagcggccctgggctgcctggtcaaggactacttcctcgatcgcgtctgagcgggctggcaaggcgcatagnnn

SEQ ID NO: 289942 - DNA, 256 bp, Homo sapiens
  misc_feature: GYAE6OF02I5M8H.45.38.D05.1.454.CMB.1.raw
  modified_base (246)..(256): a, c, t, g, unknown or other
  misc_feature (246)..(256): n is a, c, g, or t
tcagacgcgatcgacacgaccggtgctcgatttagtatctgatagttgggtttgggggtgtggtggtctccactcccgccttgacgaggctgattatttctgttgctcatatgcgagggaccagcacttgggtgttcggcggagggaccaggttgaccgtcctaggtcagcccaaggctgcccctcggtcactctgttcccgccctcctctcgatcgcgtctgagcgggctggcaaggcgcatagnnnnnnnnnnn

SEQ ID NO: 289943 - DNA, 175 bp, Homo sapiens; identical to SEQ ID NO: 289754
  misc_feature: GYAE6OF02IWOT3.45.38.D05.1.454.CMB.1.raw
  modified_base (174)..(175): a, c, t, g, unknown or other
  misc_feature (174)..(175): n is a, c, g, or t

SEQ ID NO: 289944 - DNA, 531 bp, Homo sapiens
  misc_feature: GYAE6OF02JBXI6.45.38.D05.1.454.CMB.1.raw
  modified_base (520)..(520): a, c, t, g, unknown or other
  misc_feature (520)..(520): n is a, c, g, or t
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagttttgtctcctggtaccaacaacaccccggcgaagcccccaaactaatcatttatagggacactaagcggccctcgggggtttcaagtcgcttctctggctccaagtctggcaacacggcctccctgacaatctctgggctccaggctcaggacgaggctgattatttctgttgctcatatgcagggaccagcacgttgggtgttcggcggagggaccaggttgaccgtcctaggtcagcccgaaggcctcgcccctggtcactctcgtcccnccctcctctcg

SEQ ID NO: 289945 - DNA, 562 bp, Homo sapiens
  misc_feature: GYAE6OF02HZASB.45.38.D05.1.454.CMB.1.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagttttgtctcctggtaccaacaacaccccggcgaacgcccccaaactaatcatttataggacactaagcggccctcggggttcaagtcgcttctctggctccaagtctggcaacacggcctccctgacaatctctgggcctccgaggcctcgaggacgaggctggatttatttctgttgctctatatgcagggaccagcacgttgggtgttcgggcggagggaccgtagggttcgaccgtccgtaggtcacggcccgaaggcctcggcccccgttcggtccacttccgtcgttccccacccttccctcctccg

SEQ ID NO: 289946 - DNA, 248 bp, Homo sapiens; identical to SEQ ID NO: 289936
  misc_feature: GYAE6OF02GG8B7.45.38.D05.1.454.CMB.1.raw
  modified_base (246)..(248): a, c, t, g, unknown or other
  misc_feature (246)..(248): n is a, c, g, or t

SEQ ID NO: 289947 - DNA, 173 bp, Homo sapiens; identical to SEQ ID NO: 289699
  misc_feature: GYAE6OF02GOI0A.45.38.D05.1.454.CMB.1.raw
  modified_base (173)..(173): a, c, t, g, unknown or other
  misc_feature (173)..(173): n is a, c, g, or t

SEQ ID NO: 289948 - DNA, 534 bp, Homo sapiens
  misc_feature: GYAE6OF02JZLYP.45.38.D05.1.454.CMB.1.raw
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccacagtgatgttgggagttttagtttgtctcctggtaccaacaacaccccggcgaagcccccaaactaatcatttatagggacactaagcggccctcgggggtttcaagtcgcttctctggctccaagtctggcaacacggcctccctgacaatctctgggctccagctcaggacgaggctgattatttctgttgctcatatgcagggtaccagcacgttgggtgttcggcggagggtaccaggttgaccgtctaggtcagcccgaaggctcgccccctcggtccactcgtcgttcccgccctccgtctcg

SEQ ID NO: 289949 - DNA, 583 bp, Homo sapiens
  misc_feature: GYAE6OF02JVXA4.45.38.D05.1.454.CMB.1.raw
  modified_base (307)..(307): a, c, t, g, unknown or other
  misc_feature (307)..(307): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagttttgtctcctggtaccaacaacaccccggcgaacgcccccaaactaactcatttanagggacactaagcggcctcggggttcaagtcgcttctctggctcaagtctggcaacacggcctcccgtgacaatcctctcgggctccgaggctcgaggacgaggctgattatttctgttgcttcattatgcgagggtaccagcgtacgttgggtgttcgggcgggtagggacctagggttcgaccgttccgtaggtcacggtcccgaaggtccgtacggcccccgttacgggtccacccgttcgttccgttcccctacccttccctccgttcccgg

SEQ ID NO: 289950 - DNA, 282 bp, Homo sapiens
  misc_feature: GYAE6OF02F76F5.45.38.D05.1.454.CMB.1.raw
  modified_base (247)..(282): a, c, t, g, unknown or other
  misc_feature (247)..(282): n is a, c, g, or t
tcagacgcgatcgacacgaccggtgctcgatttagtatctgatagttgggtttgggggtgtggtggtctccactcccgccttgacgaggctgattatttctgttgctcatatgcagggaccgagcacttgggtgttcggcggagggaccagggttgaccggtcgtaggtcagcccaaggctgccccctggtcactctgttcccacctcctctcgatcgcgtctgagcgggctggcaaggcgcatagnnnnnnnnnnnnnnnnnnnnnnnnnnnnnnnnnnnn

SEQ ID NO: 289951 - DNA, 551 bp, Homo sapiens
  misc_feature: GYAE6OF02GXVRQ.45.38.D05.1.454.CMB.1.raw
  modified_base (539)..(539): a, c, t, g, unknown or other
  misc_feature (539)..(539): n is a, c, g, or t
  modified_base (546)..(551): a, c, t, g, unknown or other
  misc_feature (546)..(551): n is a, c, g, or t
tcagacgcgatcgacacgaccggtgctcgatttagtatctgatagttgggtttgggtttagaacctatgaacattctgtaggggccactgtcttctccacggtgctccctttctgccctgactcagcctgcctccgtgtctgggtctcctggacagtcgatcaccatggcctgcactggaaccaacagttatgttgggagttttagttttgtctcctggtaccaacaacaccccggcgaagcccccaaataatcatttataggacactaagcggccctcggggtttcaagtcgcttctctggctccaagtctggcaacacggcctccctgacaatctctgggctccaggctcaggacgaggctgattatttctgttgctcatatgcagggaccagctacgttgggtgtttcgggcgggagggacccgtagggttcgacccgttccgtacgggtcacggcccaaggcctcgcccccgtcggtccacgtcctcgttccccacccttcctctcgatcgcgtctgacgcggctggcaagggcncagtagnnnnnn

SEQ ID NO: 289952 - DNA, 246 bp, Homo sapiens
  misc_feature: GYAE6OF02H3X8V.45.38.D05.1.454.CMB.1.raw
  modified_base (245)..(246): a, c, t, g, unknown or other
  misc_feature (245)..(246): n is a, c, g, or t
tcagacgcgatcgacacgaccggtgctcgatttagtatctgatagttgggtttgggggtgtggtggtctccactcccgccttgacgaggctgattatttctgttgctcatatgcagggaccagcacttgggtgttcggcggagggaccaggttgaccgtcctaggtcagcccaaggctgccccctggtcactctgttcccgccctcctctcgatcgcgtctgagcgggctggcaaggcgcatagnn

SEQ ID NO: 289953 - DNA, 543 bp, Homo sapiens
  misc_feature: GYAE6OF02I18CP.45.38.D05.1.454.CMB.1.raw
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagttttgtctcctggtaccaacaacaccccggcgaagcccccaaactaatcatttatagggacactaagcggccctcgggggtttcaagtcgcttctctggctccaagtctggcaacacggcctccctgacaatctctgggctccaggctcaggacgaggctgattatttctgttgctcatatgcagggaccagcacgttgggtgttcgggcggagggaccagggttcgacccgtcctaggtcagcccgaaggcctggccccctggtccactctcgttccccgcccttcctctccg

SEQ ID NO: 289954 - DNA, 613 bp, Homo sapiens
  misc_feature: GYAE6OF02JFB66.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaatttggggctgggtccgccagcccccagggaaggggctggagtggattgggactgtctactcgtagtgggaccactattacagcccgtccctcaagactcgactggtgatctacaataaacacgtaccaagaaccaatctacctgagctagaactctgtgaccgccgacggacacggaccaaatacttacgtgtgacctaaagacggaggccgtaggaaatttacgttaccgtttacgaacccgtaacgtcgggggacccttacggggtaacccgtcgggttaccgtacccgttccgtacccttaccgaccgtcccgttacccgacccgtaacggggccccctagtcccgggttacccccg

SEQ ID NO: 289955 - DNA, 629 bp, Homo sapiens
  misc_feature: GYAE6OF02G7OR9.45.38.D05.1.454.CMB.1.raw
  modified_base (584)..(584): a, c, t, g, unknown or other
  misc_feature (584)..(584): n is a, c, g, or t
tcagacgcgatcgacacgaccggtgctcgatttagtatctgatagttggggttttgggggctttctgagacgtcgacggtaccctcctgtgtcaggaactatgaagcacctggtggttcctcctccctgctggtggcggcctcccggatggcgtcctggtcccagctgcgtacctgcaggtagttacgggcccaggactggtgaagccttcggagaccctggtcccgtcggacttgtctagtgtcctcggtggtcactccattcagtagtagtcattaaagttttggggactggtcgtccagtcccccctaggaagggcttggagtcggagttcgggactagtcctaacgtacgtagtgggtaccacgtacttacaggtcccgtccctacaacgactcgacgtggtgagttctaactaataaacgacggtaccaaacgaaccaagttcctccttgaggtctagtaacctctagtcgaacccgcggcgaacacggaccaaattattactgtgactaagagaggcctaggaatagttccttagacctacgtgggaccttgggaaccctgtactaccgtcttcctcncgtcctccgaccgtacggtccctacggtcggtcctcccgtaccgg

SEQ ID NO: 289956 - DNA, 253 bp, Homo sapiens
  misc_feature: GYAE6OF02JM8PB.45.38.D05.1.454.CMB.1.raw
  modified_base (243)..(253): a, c, t, g, unknown or other
  misc_feature (243)..(253): n is a, c, g, or t
tcagacgcgatcgacacgaccggtgctcgatttagtatctgatagttgggtttgggggtgtggtggtctccactcccgccttgacgaggctgattatttctgttgctcatatgcagggaccagcacttgggtgttcggcggagggaccaggttgaccgtcctaggtcagcccaaggctgcccctcggtcactctgttcccgcctcctctcgatcgcgtctgagcggctggcaaggcgcatagnnnnnnnnnnn

SEQ ID NO: 289957 - DNA, 530 bp, Homo sapiens
  misc_feature: GYAE6OF02JCJ4S.45.38.D05.1.454.CMB.1.raw
  modified_base (521)..(521): a, c, t, g, unknown or other
  misc_feature (521)..(521): n is a, c, g, or t
  modified_base (526)..(530): a, c, t, g, unknown or other
  misc_feature (526)..(530): n is a, c, g, or t
tcagacgcgatcgacacgaccggtgctcgatttagtatctgatagttgggtttgggtttagaacctatgaacattctgtaggggccactgtcttctccacggtgctccctttctgccctgactcagcctgcctccgtgtctgggtctcctggacagtcgatcaccatggcctgcactggaaccaacagtgatgttgggagttttagttttgtctcctggtaccaacaacaccccggcgaagccccccaaactaatcatttatagggacactaagcggccctcgggggtttcaagtcgcttctctggctccaagtctggcaacacggcctccctgacaatctctgggctccaggctgaggacgaggctgattatactgctgctcatatgcaggtatagtactttggtgttcggcggagggaccagctgaccgtcctaggtcagcccaaggctcgcccctcggtccactctcgttcccaccctcctctcgactcgcgtctgacggcgggctcggcaggcgacngtagnnnnn

SEQ ID NO: 289958 - DNA, 247 bp, Homo sapiens
  misc_feature: GYAE6OF02GREBF.45.38.D05.1.454.CMB.1.raw
  modified_base (246)..(247): a, c, t, g, unknown or other
  misc_feature (246)..(247): n is a, c, g, or t
tcagacgcgatcgacacgaccggtgctcgatttagtatctgatagttgggtttgggggtgtggtggtctccactcccgccttgacgaggctgattatttctgttgctcatatgcagggaccagcacttgggtgttcggcggagggaccaggttgaccgtcctaggtcagcccaaggctgccccctcggtcactctgttcccaccctcctctcgatcgcgtctgagcgggctggcaaggcgcatagnn

SEQ ID NO: 289959 - DNA, 531 bp, Homo sapiens
  misc_feature: GYAE6OF02I9ZWW.45.38.D05.1.454.CMB.1.raw
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatctcctgcactggaaccagcagtgatgttgggagttataaccttgtctctggtaccaaaagcacccaggcaaagcccccaaatcatgatttatgaggcagtaagcggccctgagggtttcaatcgcttctctggctccaagtctggcaacacgcctcctgacatctctggctccaggctgaggacgaggctgattattactgctgctnatntgcgaggttagtagttactttgggtgttacgggcggtagggtaccaagtcgtcggacccgttcgtacggtccacggcccgaacggtcctccgcccccgttggtcctacccg

SEQ ID NO: 289960 - DNA, 549 bp, Homo sapiens
  misc_feature: GYAE6OF02G5JXG.45.38.D05.1.454.CMB.1.raw
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagtttgtctcctggtaccaacaacaccccggcgaacgcccccaaactaatcatttatagggacactaagcggccctcgggggtttcaagtcgcttctctggctccaagtctggcaacacggcctccctgacaatctctgggctccaggctcaggacgaggctgattatttctgttgctcatatgcagggaccagcacgttgggtgttcgggcggacgggaccgtagggttcgaccgttcctaggtcacggcccgaaggcctcgccccgtcgtccacttcctcgttccccgcccttcctctcg

SEQ ID NO: 289961 - DNA, 250 bp, Homo sapiens
  misc_feature: GYAE6OF02I9IAH.45.38.D05.1.454.CMB.1.raw
  modified_base (245)..(250): a, c, t, g, unknown or other
  misc_feature (245)..(250): n is a, c, g, or t
tcagacgcgatcgacacgaccggtgctcgatttagtatctgatagttgggtttgggggtgtggtggtctccactcccgccttgacgaggctgattatttctgttgctcatatgcagggaccagcacttgggtgttcggcggagggaccaggttgaccgtcctaggtcagcccaaggctgccccctggtcactctgttcccgccctcctctcgatcgcgtctgagcgggctggcaaggcgcatagnnnnnn

SEQ ID NO: 289962 - DNA, 517 bp, Homo sapiens
  misc_feature: GYAE6OF02FX44R.45.38.D05.1.454.CMB.1.raw
  modified_base (414)..(414): a, c, t, g, unknown or other
  misc_feature (414)..(414): n is a, c, g, or t
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatctcctgcactggaaccagcagtgatgttgggagttataaccttgtctcctggtaccaacagcaccaggcaaagccccaaactcatgattatgaggcagtaagcggcctcgaggggtttctaatcgcttctctggctcaagtctggcaacacggcctcctgacaatctctgggctccaggctgaggacgaggctagattattacngctgctctatatgctaggtagtagttagttggtagttcggcggtaggacaaggtctgaccgtctaggtcacgacccgaaggtcctacggtcccctggtacccg

SEQ ID NO: 289963 - DNA, 553 bp, Homo sapiens
  misc_feature: GYAE6OF02IQVPP.45.38.D05.1.454.CMB.1.raw
  modified_base (513)..(513): a, c, t, g, unknown or other
  misc_feature (513)..(513): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtcccctcacttgcagtgtctctggtgactccatcagtagtagtcataaattttggggctgggtccgccagcccccagggaagggctggagtggattgggactgtctactctagtgggaccacctattacacgcccgtcctcaagactcgactggtgatctacaataaacacgtaccaaagaaccaattctccctgaggctgaactctgtcgaccgcgcggacacggaccaaattacttactgtgacaagaggagggcctaggaattatcctttgaccacgtgggcctgggaaccctggtcaccgtctccncacgccctccaccgacgggcccagtccgtcctcccctcgg

SEQ ID NO: 289964 - DNA, 542 bp, Homo sapiens
  misc_feature: GYAE6OF02FFDA2.45.38.D05.1.454.CMB.1.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagttttgtctcctggtaccaacaacaccccggcgaagcccccaaactaatcatttatagggacactaagcggccctcgggggtttcaagtcgcttctctggctccaagtctggcacacggcctccctgacaatctctgggctccaggctcaggacgaggctgattatttctgttgcttcatatgcagggaccagcacgttgggtgttcggcggagggaccaggttcgaccgtcgtaggtcacgcccgaaggctcgccccctcggtcacgtcctcgttcccaccctcctctaccg

SEQ ID NO: 289965 - DNA, 533 bp, Homo sapiens
  misc_feature: GYAE6OF02GZSCG.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaattttggggctgggtccgccagccccccagggaaggggctggagtggattgggactgtctactctagtgggaccacctattacagcccgtccctcaagactcgactggtgatctcaataaacacgtccaagaccaattctccctgagctgaactctgtgaccgcgcggacacggccaaatatactgtgcaagagagggcctggaattatcctttgaccacgtgggcctgggaaccctggtccaccgtctcctcagcctccaccagggcccagtccggtccc

SEQ ID NO: 289966 - DNA, 542 bp, Homo sapiens
  misc_feature: GYAE6OF02FXT2I.45.38.D05.1.454.CMB.1.raw
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagttttgtctcctggtaccaacaacaccccggcgaagcccccaaactaatcatttatagggacactaagcggccctcgggggtttcaagtcgcttctctggctccaagtctggcaacacggcctccctgacaatctctgggctccaggctcaggacgaggctgattatttctgttgctcatatgcagggaccagcacttgggtgtttcggcggagggaccagggttcgaccgtccgtaggtcaggcccgaaggcctcgccccctcggtcactcctcgttcccaccctcctctccg

SEQ ID NO: 289967 - DNA, 566 bp, Homo sapiens
  misc_feature: GYAE6OF02HYKTE.45.38.D05.1.454.CMB.1.raw
  modified_base (418)..(418): a, c, t, g, unknown or other
  misc_feature (418)..(418): n is a, c, g, or t
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagttttgtctctggtaccaacaacaccccggcgaacgccccccaaactaatcaatttataggacactaagcggcccgtcggggttcaagtcgcttctctgctcagtctggcaacacggcctcctgacatctctgggctcgagctcgaggacgagctgatttatttctgttnctcattatgctagggaccagctacgttgggtcgttcgggcggacggaccgtagggttcgaccgttccgtaggtccacggccccgaaggtcctccggcccccgttcggtcaccgttccgtaccgttcccccacccttcccgtcgtaccg

SEQ ID NO: 289968 - DNA, 595 bp, Homo sapiens
  misc_feature: GYAE6OF02HBEM0.45.38.D05.1.454.CMB.1.raw
  modified_base (303)..(303): a, c, t, g, unknown or other
  misc_feature (303)..(303): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggtattttagtttgtctcctggtaccaacaaccacccggcgaacgcccccaaatatcatttanaggacactaagcggcctcggggtttcaagtcgcttctctggctcaagtctggcaacacgcctcctgacaatctctgggctccgaggctcgaggacgagctgtatttatttctgttgcttcattatgcgaggaacagctacgttgggtcgttcggcgggacgggaccgtagggttcgacccggttccgtagggtccgaacggtccccgaaagggtcccgtaccggtccccccgttcggtaccctaccgttccgttcccggtttcccccaccccgtttccctacccgttcccgg

SEQ ID NO: 289969 - DNA, 552 bp, Homo sapiens
  misc_feature: GYAE6OF02G4RUR.45.38.D05.1.454.CMB.1.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggtagttttagttttgtctcctggtaccaacaacaccccggcgaagccccccaaactaatcatttatagggacactaagcggccctcgggggtttcaagtcgcttctctggctccaagtctggcaacacggcctccctgacaatctctgggctccaggctcgaggacgaggctgattatttctgttgctcatatgcagggaccagcacgttgggtgttcggcgggacgggacctagggttcgaccgtccgtagggtcaggccccgaagggctacggccccctgacgtcactctcgttcccacccttcctccg

SEQ ID NO: 289970 - DNA, 628 bp, Homo sapiens
  misc_feature: GYAE6OF02IJTPL.45.38.D05.1.454.CMB.1.raw
  modified_base (229)..(229): a, c, t, g, unknown or other
  misc_feature (229)..(229): n is a, c, g, or t
  modified_base (458)..(458): a, c, t, g, unknown or other
  misc_feature (458)..(458): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactgggtgaagccttcggagaccctgtccctcacttgcagtgtctctggtnactcatcagtagtatcattaaattttggggctgggtccgcagcccccagggaagggctggagtggattgggactggtctacgtctaggtcggaccactattacagcccgtcctcaagactcgactggtgatctacaaataaacacgtaccaaagaacctaattcctaccgtgacggctagaactctagtcgaacgccgcgacacggtacaaagttacttactagtcganaaagagagggcctaggtaaactttactccgtttacgaacctacggtacggggacccgttcggggaaaccccggttccacccggttcctcccgtaccgaccgtccctacccgaaccgaaccggggtacccctacgttcccgggttcccctttcccccggtaggtacccccg

SEQ ID NO: 289971 - DNA, 551 bp, Homo sapiens
  misc_feature: GYAE6OF02G7HFH.45.38.D05.1.454.CMB.1.raw
  modified_base (443)..(443): a, c, t, g, unknown or other
  misc_feature (443)..(443): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaattttggggctgggtccgccagcccccagggaaggggctggagtggattgggactgtctactctagtgggaccacctattacagcccgtccctcaagactcgactggtgatctcaataaacacgtccaaagaaccaattctccctgacggctgaactctgtgaccgccgcggacacggccaaatacttacngtgacaagagagggcctagggaattatcctttgaccctacgtcggggcctgggaaccctggtccaccgttctcctcagccctccgaccgacgggcccagtccggtccc

SEQ ID NO: 289972 - DNA, 551 bp, Homo sapiens
  misc_feature: GYAE6OF02GPLFD.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaattttggggctgggtccgccagcccccagggaaggggctggagtggattgggactgtctactctagtgggaccactattacagcccgtcctcaagactcgactggtgatctcaataaacacgtaccaagaaccaattcctcctgaggctgaactctgtcgaccgccggcggacacggacaatattactgtgcaagagagggcctaggaattatcctttgacctacgtcggggcctagggaccctggtcctaccgtcctcctcacgccctaccgaccgaacgggccctacgtccggtccc

SEQ ID NO: 289973 - DNA, 570 bp, Homo sapiens
  misc_feature: GYAE6OF02G2W4V.45.38.D05.1.454.CMB.1.raw
tcagacgcgatcgacacgaccggtgctcgatttagtatctgatagttgggtttgggggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaattttggggctgggtccgccagccccagggaaggggctggagtggattgggactgtctactctagtgggaccacctattacagcccgtccctcaacgactcgactggtgatctcaataaacacgtaccaagaaccaattctccctgaggctgaactctgtcgaccgccgcggacacggccaaatattactgtgcaagagagggcctaggaattatcctttagaccacgtcggggcctggggaaccctggtaccaccggtctcctcacgcctccaccgaacgggccctagtccggttccttccccgtggccctaccccgtcctacccagacgtacccg

SEQ ID NO: 289974 - DNA, 174 bp, Homo sapiens; identical to SEQ ID NO: 289706
  misc_feature: GYAE6OF02GTQ87.45.38.D05.1.454.CMB.1.raw
  modified_base (173)..(174): a, c, t, g, unknown or other
  misc_feature (173)..(174): n is a, c, g, or t

SEQ ID NO: 289975 - DNA, 545 bp, Homo sapiens
  misc_feature: GYAE6OF02I5LOT.45.38.D05.1.454.CMB.1.raw
  modified_base (533)..(533): a, c, t, g, unknown or other
  misc_feature (533)..(533): n is a, c, g, or t
tcagacgcgatcgacacgaccggtgctcgatttagtatctgatagttgggtttggggggggtcgacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagttttgtctcctggtaccaacaacaccccggcgaagcccccaaactaatcatttatagggacactaagcggccctcgggggtttcaagtcgcttctctggctccaagtctggcaacacggcctccctgacaatctctgggctccaggctcaggacgaggctgattatttctgttgctcatatgcagggaccagctacgttgggtgttcgggcggagggacctaggttcgaccgtctaggtcacggcccaaggcctcgccccgtcgtccacgtctcgttccccnccctcctctccg

SEQ ID NO: 289976 - DNA, 587 bp, Homo sapiens
  misc_feature: GYAE6OF02HMK6L.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaatttggggctgggtccgccagcccccagggaaggggctggagtggattgggactgtctactctagtgggaccacctattacacgcccgtcctcaagactcgactggtgatctacaaataaacacgtaccaaagaaccaattcctacctgaggctgaactctgtgaccgccgacggacacggaccaaatattactgtagcaagagacgggcctaggaattattcctttagacctacgtggggccctacggggtaacccttcgggtcctacccggttcctcccgtaccgaccgtcccgtacccgaacccgaacgggcccctagttcccgggttcccc

SEQ ID NO: 289977 - DNA, 565 bp, Homo sapiens
  misc_feature: GYAE6OF02JNS8H.45.38.D05.1.454.CMB.1.raw
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
  modified_base (269)..(269): a, c, t, g, unknown or other
  misc_feature (269)..(269): n is a, c, g, or t
  modified_base (340)..(340): a, c, t, g, unknown or other
  misc_feature (340)..(340): n is a, c, g, or t
tcagacgcgatcgacacgaccggtgctcgatttagtatctgatagttgggtttgggggttcgtacgaagaggcagcgctctcgggacgtctccaccatggcctggctctgctgctcctcactctcctcactcaggacacaggatcgtgggccctttctgccctgactcagcctgcctccgtgtctgggtctcctggacagtcgatcaccntctcctgcactggaaccngcagtgatgttgggattataaccttgtctcctggtaccaancgcacccaggcaaacgcccccaaatcatgattatgaggcagtaagcgcctcgagggtttcatcgtcttctntgctcaagtctggactaacacggtcctcctgactatctcgtggctccgagctcgagtcgagtctgtactttagtttctagttcgtacctctattacgtgaccgtagggaccctagtcctacgtttgggtcgttacgggcggtacgggtaccgaggtttcgggacccttccggtaaggtcgacgcccgtaaggtcccttacggccccccgttgggttcctaaccgg

SEQ ID NO: 289978 - DNA, 539 bp, Homo sapiens
  misc_feature: GYAE6OF02GC216.45.38.D05.1.454.CMB.1.raw
  modified_base (425)..(425): a, c, t, g, unknown or other
  misc_feature (425)..(425): n is a, c, g, or t
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagttttgtctcctggtaccaacaacaccccggcgaagcccccaaactaatcatttatagggacactaagcggccctcgggggtttcaagtcgcttctctggctccaagtctgcaacacggcctccctgacaatctctgggctccaggctcaggacgaggctgattatttctgttgctnatatgcagggaccagctacgttgggtgttcggcggagggtccaggttcgaccgtcctaggtcagcccgaaggcctcggcccctggtccactcgtcgttcccaccctcctctccg

SEQ ID NO: 289979 - DNA, 552 bp, Homo sapiens
  misc_feature: GYAE6OF02FXSNF.45.38.D05.1.454.CMB.1.raw
  modified_base (299)..(299): a, c, t, g, unknown or other
  misc_feature (299)..(299): n is a, c, g, or t
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttggattttattttgtctcctggtaccaacaacaccccggcgaagcccccaaactaatcatttanagggacactaagcggccctcgggggtttcaagtcgcttctctggctccaagtctggcaacacggcctccctgacaatctctgggctccagctcaggacgaggctgattatttctgttgctcatatgcagggaccaggctacgttggggtgttcggggcggagggacctaggttcgaccgtcgtaggtcacggtcccgaaggcctcggcccccttcggtccacgttcgtccgttccccaccctcccgtctcccg

SEQ ID NO: 289980 - DNA, 552 bp, Homo sapiens
  misc_feature: GYAE6OF02GFA9F.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcgggagaccctgtccctcacttgcagtgtctctggtgactccatcagtagtagtcattaaattttggggctgggtccgccagcccccagggaaggggctggagtggattgggactgtctactctagtgggaccacctattacagcccgtccctcaacgactcgactggtgatctcaataaacacgtaccaagaaccaattctcctgaggctgaactctgtgaccgccgcggacacggccaaatattactgtgcaagagagggcctaggaattatcctttgacctactggggcctgggaaccctggtcaccggtctcctcacgcctccaccgacgggcccagtccggtccttccccgtcgg

SEQ ID NO: 289981 - DNA, 565 bp, Homo sapiens
  misc_feature: GYAE6OF02HC8RO.45.38.D05.1.454.CMB.1.raw
  modified_base (436)..(436): a, c, t, g, unknown or other
  misc_feature (436)..(436): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaattttgggctgggtccgccagcccccagggaagggctggagtggattgggactgtctactctagtggaccactattacagcccgtccctcaagactcgactggtgatctcaataaacacgtccaaagaaccaattcctcctgacgctgaactctgtgaccgcgcgacacggcaaatattactgtancaagagagggcctagggaactttatccgtttgaacctacgtcgggccttagggaacccttggtaccgtaccgtctcctcacgtccctaccacccgaacgggcccacgtccggttccttcccccgtacgg

SEQ ID NO: 289982 - DNA, 573 bp, Homo sapiens
  misc_feature: GYAE6OF02HB056.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaattttggggctgggtccgccagcccccagggaagggctggagtggattgggactgtctactctagtgggaccacctattacagcccgtccctcaagactcgactggtgatctcaaataaacacgtaccaaagaaaccaattcctccctgacggctgaactctagtcgaccgccgcggacacggaccaaatacttactgtgacaagagagggcctaggaattactcctttgacctacgtgggcctgggaaccctggtaccaccgtcctcctcgacgtccctaccgaccgaacgggcccctagtccggttcccttcccccgtcgg

SEQ ID NO: 289983 - DNA, 707 bp, Homo sapiens
  misc_feature: GYAE6OF02I19A4.45.38.D05.1.454.CMB.1.raw
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccacagtgatgttggtattttagtttgctcctggtaccaacacacccggcaacgcccccaaatatcattataggacactaagcgccgtgggttcaagtcgcttctctggctcaagtctggactaacgcgtcctccgtagactaactctcgtcgggcctccgaggcctacgaacgggacgaggtctaggtatttagtttcgtgttacgccttacgtaatttacgtcggaccgtaacggggacctaacggtccgttaacggtttcggggttccggtttaccggggaccgggtaagggggaaccccgttaaggggtttaccggtaaaccccggtttaccggttaaccgggttacccgacgggtaacccccggtaaaggggtccccgttacccggaccccccccggtttagggtacccgttaccccggttcccggtttcccggttaccccccggtccccgttttacccccgtcccggttaaccccgg

SEQ ID NO: 289984 - DNA, 602 bp, Homo sapiens
  misc_feature: GYAE6OF02HB0XT.45.38.D05.1.454.CMB.1.raw
  modified_base (451)..(451): a, c, t, g, unknown or other
  misc_feature (451)..(451): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagacccctgtccctcacttgcagtgtctctggtgactccatcagtagtagtcataaattttggggctgggtccgccagcccccagggaaggggctggagtggagttgggactgtctactctagtgggaccacctattacacgcccgtccctcaagactcgactggtgatctacaataaacacgtaccaaagaaccaatttcctaccctgacgctgaactctgtgaccgcgcggaccacggaccaaatacttacngtagacaagaggacggctaggtaattacttcctttagaacctacgtcgggggacctacggggaacccgttggtacctaacccggttccttacccgtaccgacgtcccgtacccgaccgaaccggggccccctacgttcccggttacccccg

SEQ ID NO: 289985 - DNA, 625 bp, Homo sapiens
  misc_feature: GYAE6OF02ILBIG.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaattttggggctgggtccgccacgcccccgagggaaggggctggagtggattgggactgtctactctagtcgggaccacctattacacgcccgtcctcaagactcgactggtgatctcaataaacacgtcaagaacctaattctcctgaggctgaactctgtcgaccgcgcggacacggaccaaagtacttactgtacgactaaggaggacgggtcccgtaggtaaactttacgttaccctttcggaacccgtacgttccggggacccgttacggggaaccccgttcgggtaaccctacccggttccttacccgttaccgacgtcccctaccgtaacccgtaacccgggtccccgacgttcccggttacccccg

SEQ ID NO: 289986 - DNA, 259 bp, Homo sapiens
  misc_feature: GYAE6OF02FRIEY.45.38.D05.1.454.CMB.1.raw
  modified_base (254)..(259): a, c, t, g, unknown or other
  misc_feature (254)..(259): n is a, c, g, or t
tcagacgcgatcgacacgaccggtgctcgatttagtatctgatagttgggtttggggggtgtggtggtcctccacctcccgccttgacgaggctgatttatttctgttgctcatatgcgaggaccagcacgttgggtgttcggcggagggaccaggttgacccgtcctaggtcacgcccaaggctcgccccctcggtcactctcgttcccgccctcctctcgatcgctctgaggcggctggcaaggcgcatagnnnnnn

SEQ ID NO: 289987 - DNA, 624 bp, Homo sapiens
  misc_feature: GYAE6OF02I0Q0I.45.38.D05.1.454.CMB.1.raw
  modified_base (210)..(210): a, c, t, g, unknown or other
  misc_feature (210)..(210): n is a, c, g, or t
  modified_base (371)..(371): a, c, t, g, unknown or other
  misc_feature (371)..(371): n is a, c, g, or t
  modified_base (401)..(401): a, c, t, g, unknown or other
  misc_feature (401)..(401): n is a, c, g, or t
  modified_base (422)..(422): a, c, t, g, unknown or other
  misc_feature (422)..(422): n is a, c, g, or t
tcagacgcgatcgacacgaccggtgctcgatttagtatctgatagttgggtttgggggggtcgacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccntggcctgcactggaaccaacagtgatgtttggagttttagtttgtcgtcctggtaccaacctaacaccccggccgaagcccccaactaatcaacgttataggacactaagcggtccctcggggtttcaagtcgtcttctctcggctccaagtctggcaacncggcctaccctgtacaactctctgggctcncgctcaggcgaggctgtattntttcgagttcgcttcattactgaccagggtaccaggtcgtacgtttgggtgttccggggacgggaacgggtcctaagggttccgaaccggttccgtaagggttcccaaggtccccgaagggtccccttcgggccccccttacgggtcctaccgtttcccgttccggtttaccccccggcccttttccccggtccttacccgg

SEQ ID NO: 289988 - DNA, 630 bp, Homo sapiens
  misc_feature: GYAE6OF02JKO1R.45.38.D05.1.454.CMB.1.raw
  modified_base (311)..(311): a, c, t, g, unknown or other
  misc_feature (311)..(311): n is a, c, g, or t
  modified_base (378)..(378): a, c, t, g, unknown or other
  misc_feature (378)..(378): n is a, c, g, or t
  modified_base (438)..(438): a, c, t, g, unknown or other
  misc_feature (438)..(438): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaaccaacagtgatggttgggtagtttttagtttgtctcctggtaccaacaaccacccggcgaacgacccccaaactatctaatttanaggacactaagcggtccgtcggggttacaagtcgcttctctggctcaagtctgcaacacggcctccngacatctcgtcggactccgaggctcgaggacgaggctagtatttatttcgtgttcgctanattagttgccgacgggaccagcctacggtttgggtcggtttaccggggcgggtaacgggtaccgtacgggttcgacccggttaccgtaggtccgtaacggtacccgtaacgggccttaccggtacccccgttcggttacccgtaccgtttcccgttccgttaccccctaccccgttcccgttacgttacccg

SEQ ID NO: 289989 - DNA, 543 bp, Homo sapiens
  misc_feature: GYAE6OF02IL2UO.45.38.D05.1.454.CMB.1.raw
  modified_base (433)..(433): a, c, t, g, unknown or other
  misc_feature (433)..(433): n is a, c, g, or t
  modified_base (440)..(440): a, c, t, g, unknown or other
  misc_feature (440)..(440): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagacccctgtccctcacttgcagtgtctctggtgacctccatcagtagtagtcataaattttggggctgggtccgccagcccccagggaggggctggagtggattgggactgtctactctagtgggaccacctattacagcccgtccctcaacgactcgactggtgatctcaataaacacgtccaagaaccatctcctgaggtctgaactctgtgaccgcgcgacgacgccaaatntactgtncagagaggcctggaattatccttgaccacgtggggacctgggaacccttggtcctaccgtcctcctcgacgccctccgaccgacgggcccacgtccgtccccg

SEQ ID NO: 289990 - DNA, 608 bp, Homo sapiens
  misc_feature: GYAE6OF02HJYIZ.45.38.D05.1.454.CMB.1.raw
  modified_base (357)..(357): a, c, t, g, unknown or other
  misc_feature (357)..(357): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaattttggggctgggtccgcagcccccagggaagggctggagtggattgggactgtctactctagtgggaccacctattacagcccgtccctcaagactcgactggtnatctcaataaacacgtccaaagaaccaattctaccctgaggctgaactctgtgaccgcgcggacacggaccaaatattactgtgcaagaggacgggcctagggaatttacgtccttttagacccgtaacgtcggggcccttacggggaaccccttgggtacctaaccccggttcctaccctccgtaccgcccttacccgaacccgtaacggggcccctaacgttcccgggttccctttcccccccgtacgg

SEQ ID NO: 289991 - DNA, 535 bp, Homo sapiens
  misc_feature: GYAE6OF02FLVMJ.45.38.D05.1.454.CMB.1.raw
  modified_base (530)..(535): a, c, t, g, unknown or other
  misc_feature (530)..(535): n is a, c, g, or t
tcagacgcgatcgacacgaccggtgctcgatttagtatctgatagttgggtttgggtttagaacctatgaacattctgtaggggccactgtcttctccacggtgctccctttctgccctgactcagcctgcctccgtgtctgggtctcctggacagtcgatcaccatggcctgcactggaaccaacagtgatgttgggagttttagttttgtctcctggtaccaacaacaccccggcgaagcccccaaactaatcatttatagggacactaagcggccctcgggggtttcaagtcgcttctctggctccaagtctggcaacacggcctccctgacaatctctgggctccaggctcaggacgaggctgattatttctgttgctcatatgcagggaccagcactttgggtgttcggcgggagggaccagggttcgaccgtcctaggtcagccccgaaggctcgccccctggtcacctctcgttcccaccctcctctcgatccgcgtctgagcgggctggcaaggcgcatagnnnnnn

SEQ ID NO: 289992 - DNA, 534 bp, Homo sapiens
  misc_feature: GYAE6OF02FZQUM.45.38.D05.1.454.CMB.1.raw
  modified_base (106)..(106): a, c, t, g, unknown or other
  misc_feature (106)..(106): n is a, c, g, or t
  modified_base (529)..(534): a, c, t, g, unknown or other
  misc_feature (529)..(534): n is a, c, g, or t
tcagacgcgatcgacacgaccggtgctcgatttagtatctgatagttgggtttgggtttagaacctatgaacattctgtaggggccactgtcttctccacggtgcnccctttctgccctgactcagcctgcctccgtgtctgggtctcctggacagtcgatcaccatggcctgcactggaaccaacagtgatgttgggagttttagttttgtctcctggtaccaacaacaccccggcgaagccccccaaactaatcatttatagggacactaagcggccctcgggggtttcaagtcgcttctctggctccaagtctggcaacacggcctccctgacaatctctgggctccaggctcaggacgaggctgattatttctgttgctcatatgcagggaccagcacgttgggtgttcgggcggagggaccagggttcgaccgtccgtaggtcagcccaaggctcgcccctcggtcactctcgttcccacctcctctcgatcgcgtctgacgcgggctggcaaggcgcagtagnnnnnn

SEQ ID NO: 289993 - DNA, 746 bp, Homo sapiens
  misc_feature: GYAE6OF02IK4T4.45.38.D05.1.454.CMB.1.raw
  modified_base (159)..(159): a, c, t, g, unknown or other
  misc_feature (159)..(159): n is a, c, g, or t
  modified_base (235)..(235): a, c, t, g, unknown or other
  misc_feature (235)..(235): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggcccttttcncgccctgactcacgcctgccctccgtgtctgggtctcctggacagtcgatcaccatggcctgcactcggaaaccanagtgatggttgggtatttttagtttgtacttccgtaggtaaccaacgaaccaccccggacgaaacgacccccctaaaataactactaattttacgaacgggaacctaacgtaacgccggtacccgttacggggtttacaacgtcgtacttccgtcgtcggtctaccgaaagtctggaccaaacgccggtccctacccgtgaacctaagtccttacggtcgggcctaccgacggtcctacgaacgggtaacggacggtcgtagtaagttttaacgtttcgttgttggtacccttataagttacgttacggaccgtaaagggaccaaacggtccgtttaacggttggggttcggttaccggggacgggaacgggtacccgtaggtttaccggaccccggttacgtacgggtccgaacggtacccgtaacggggacccttcccggcccccggtttagtacccgtaaccgtttcgtaccccgggtttcccccgtcccttcccggttaccctcggg

SEQ ID NO: 289994 - DNA, 536 bp, Homo sapiens
  misc_feature: GYAE6OF02GQSLQ.45.38.D05.1.454.CMB.1.raw
  modified_base (443)..(443): a, c, t, g, unknown or other
  misc_feature (443)..(443): n is a, c, g, or t
  modified_base (514)..(514): a, c, t, g, unknown or other
  misc_feature (514)..(514): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaattttggggctgggtccgccagcccccagggaaggggctgggagtgggattggggactgtctactctagtgggaccacctattacagccccgtccctcaagactcgactggtgatctcaataaacacgtccaaagaaccaatttctccctgaggctgaactctgtgacccgccgcggacacgggccaaatnttactgtgcaagagagggcctggaattattcctttgaccatgggcctgggaccctggtcaccgtctcctcngcctcaccaggcccatcgtccc

SEQ ID NO: 289995 - DNA, 677 bp, Homo sapiens
  misc_feature: GYAE6OF02IHDSM.45.38.D05.1.454.CMB.1.raw
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggtagtttttagttttgtctctggtaccaacaacaccccggcgaacgccccaaactaatctatttataggacactaagcggccgtacggggtttcaagtcgtcttctctcggctccaagtctggacaacgacggcctcctgacaatctcgtgggctccgagctcgaggacgaggctgtatttacttcgttgttgcttactattagtgacgtaggggaccagcgtacgtttagggtcgttacggggccgggtaacgggtacccgtaaggggtttaccgacccggtttacccgttaaggggtacccgaaccggtaccccgtaaacggggtcccgttacccgggtacccccccgtttaccgggtaccccttaacccgtttcccgtttaaccccggttttacccccccgtaccccccttaccccgttacccgttacccggg

SEQ ID NO: 289996 - DNA, 570 bp, Homo sapiens
  misc_feature: GYAE6OF02IWOGJ.45.38.D05.1.454.CMB.1.raw
  modified_base (230)..(230): a, c, t, g, unknown or other
  misc_feature (230)..(230): n is a, c, g, or t
  modified_base (376)..(376): a, c, t, g, unknown or other
  misc_feature (376)..(376): n is a, c, g, or t
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacngtgatgttggagttttagtttgtctcctggtaccaacaacacccggtgaacgcccccaaactaactctatttatagggacactaaggcggtccctcgggggttcaagtcgcttctctgctcagtctgcacacggctcctgacatcnctggctccaggctcgaggacgagggctggatttattcttagttcgcttctatagttgcgtaagggaccaggccacgtttgggtcgttcggcgggtagggaccgtagggtacaccggtcctaggtcagcccgaaggtcctacggtcccccgtggtaccgtacgtcgttcccgttcccgtccctccgtcctaccgg

SEQ ID NO: 289997 - DNA, 819 bp, Homo sapiens
  misc_feature: GYAE6OF02H4F6D.45.38.D05.1.454.CMB.1.raw
  modified_base (234)..(234): a, c, t, g, unknown or other
  misc_feature (234)..(234): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtcctgggtcctcctggacagtcgaatccaccatcctctagcactggaaaccngctagtgtagttggttaggaattaactaacgttgtcctacgtacggtaaccaacgacgaccaaccgacgaaccaaaacccgaccccctaaaactctaacgttacgtaactttaagacggaacggtacgtaaacggtaacggtccggtacccgttacgggttaacggggtttactaacgttccgtactttcgtaccgtacggtaccttaccgtaagttaccgtacggaacctaaaccgtacccggtcccttacccgtacgaacctaacgttccgttccggtaccgggtaccctaaccggacggtacgtaacgggaaacgggtaaccggacggttaccgtaaggttaaacgtttaacgttacgtccggtcgttacggtaccttaacgtaacgttagtaccggtaacgttaagggttaaacgtttaacgttttacgggtttaggggttccggttaccggggaccggggtaaccgggtaaccgtaacggtaccggttaccggtacccggttaccggttaaccggtaccggtaaccggtaacccggtaacggttccccgttaccccggtacccccggttccggtaacccg

SEQ ID NO: 289998 - DNA, 676 bp, Homo sapiens
  misc_feature: GYAE6OF02HOHI4.45.38.D05.1.454.CMB.1.raw
  modified_base (425)..(425): a, c, t, g, unknown or other
  misc_feature (425)..(425): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttcttcgccctcgactcacgcctcgcctcccgtgtcgtcgggtcgtcctcggtacgagtcgatcaccactctcctcgcactacgaaccgacgcagtgagtggttgggtagttaattaaccttagttctccttggtaaccaacagcgacccacggacgaaacgaccccaacctacatcgtattatgaggcagtaacgcgccctacgtacgggttataactcgcttctctgctacagtctggcaacgcgcctccctagacatcctcgcggtcnccagggctaggacggaacggacggcttgaattttacgttacgtcggacttggaccttacgaacgttaagttccgggcgttaaacggggttaacgtttaacgttttaccgggttttttgggacgggttttccggggacggggtaacggggaaccctaaagggtccgtaccggttaacccggtcccgttaagggaccgttaccgaccccgtaaacgggcccctttaccgggtcccccccggttggtaaccccg

SEQ ID NO: 289999 - DNA, 592 bp, Homo sapiens
  misc_feature: GYAE6OF02G5JGG.45.38.D05.1.454.CMB.1.raw
  modified_base (271)..(271): a, c, t, g, unknown or other
  misc_feature (271)..(271): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggtagttttagtttgtctctggtaccaacaacnccccggcgaacgcccccaaataatcatttagaggacactaagccggcccgtcggggttcaagtcgtcttctcgtggcctaccgtaagtcctcggaccaacgaccggtcctcccctagaccaatcctcgtcgggcctccgaggcctacgacggacgaggctgtatttattctgttgctnatntgcgacggaccagctacgttgggtcgttcgggcggtacggaccgtaggtcgacccgtcgtacggtacacggcccgaaggtcctccggcccccgttcggtaccaccgttccgtcccgttccccgtcccttccctccgtccg

SEQ ID NO: 290000 - DNA, 636 bp, Homo sapiens
  misc_feature: GYAE6OF02HKPYE.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagacccctgtccctcacttgcagtgtctctggtcacctccatcagtagtagtcattaaagttttggggctgggtccgccacgcccccgaggggaacggggcgtggaggtggagttggggacttggtctactcgtaggtcgggacctacctattaccacgtccccgtccctacaacgacctcgactggtgactctacaactaaacacgtaccaaagtaacctaactttcctaccgtagacggtctagaactctgtcgaccgcgacggacacggactaaattacttacgtgtacgacgaagaggacgggacctaggtaatttacgtccgtttacgacctacggtcgggtacctacgggtaccgttcggtcctacccggttctcccgtacgtaccgcccttacccgaacccgtaaccgggcccctacgtccccggttccccg

SEQ ID NO: 290001 - DNA, 591 bp, Homo sapiens
  misc_feature: GYAE6OF02I0O5M.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaattttggggctgggtccgccagcccccaggggaaggggctggagtggattgggactgtctactctaggtcgggaccacctattacacgccccgtcctcaagactcgactggtgatctacaataaacacgtaccaacgaacctaattcctccctgacgctagaactctgtcgaccgccgcggaccacggacaaatacttactgtcgacaagagagggcctagggaatttatcctttagacctacgtcgggggacctcggggaacccgtggtcccacccggttacctccgtacgaccgtccctacccaacccgaacgggcccctacgttcccggttccccg

SEQ ID NO: 290002 - DNA, 552 bp, Homo sapiens
  misc_feature: GYAE6OF02IDWIW.45.38.D05.1.454.CMB.1.raw
  modified_base (278)..(278): a, c, t, g, unknown or other
  misc_feature (278)..(278): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggagtttttagttttgtctcgtggtaccaactaaccnccccggacgaacgcccccaaataatcatttataggacactaagcgcctggggttcagtcgcttctctgctcagtctggcacacgcctcctgacatctctcgggctccacggctcgaggacgaggctgtatttattctgttnctntatatgcagggcaagctacgttgggtcgtcgggcgggacgggaccgtaggttcgaccgttcgtaggtcgacggccgaacggcctcgcccctcggtcctacgttccgttcgttccccgccttccgtctccg

SEQ ID NO: 290003 - DNA, 530 bp, Homo sapiens
  misc_feature: GYAE6OF02IQ701.45.38.D05.1.454.CMB.1.raw
  modified_base (305)..(305): a, c, t, g, unknown or other
  misc_feature (305)..(305): n is a, c, g, or t
  modified_base (389)..(389): a, c, t, g, unknown or other
  misc_feature (389)..(389): n is a, c, g, or t
  modified_base (423)..(423): a, c, t, g, unknown or other
  misc_feature (423)..(423): n is a, c, g, or t
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttataaccttgtctcctggtaccaacagcacccaggccaaagcccccaaaatcatgatttanggaggcagtaagcgccctcgagggtttctaatcgcttctctgctccaagtctggcaacaccggcctccctagactaatcctcgngggcctcgaggctgaggcgaggctgattattacngctgctacatatgcgaggttagtagttacgtttgggtgttcggcggaggaccaagctcggacccgtcgtaggtcagcccaaggcctccggcccccgttggcctaccg

SEQ ID NO: 290004 - DNA, 541 bp, Homo sapiens
  misc_feature: GYAE6OF02F0SRU.45.38.D05.1.454.CMB.1.raw
  modified_base (285)..(285): a, c, t, g, unknown or other
  misc_feature (285)..(285): n is a, c, g, or t
  modified_base (311)..(311): a, c, t, g, unknown or other
  misc_feature (311)..(311): n is a, c, g, or t
  modified_base (443)..(443): a, c, t, g, unknown or other
  misc_feature (443)..(443): n is a, c, g, or t
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatcggcctgcactggaaccaacagtgatggttgggtagtttttagttttgtctccgtggtaccaacaaccaccccggngaacgcccccaaactcatgtatttanggaggcagtagccgcctcgagggtttctaatcgtcttctctggctcaagtctggacaacgaccggcctccgtgacctatctcgtggcctccgaggctggaggacgaggctagtattactactgctgctcatntgcgtaggtagtagttagtttggtgttcgggaggacggacagtcgtcgaccgtcgtggcacgaccgagccgtcgccccgtgtccactcgtcgtccccg

SEQ ID NO: 290005 - DNA, 670 bp, Homo sapiens
  misc_feature: GYAE6OF02IDQ9L.45.38.D05.1.454.CMB.1.raw
  modified_base (226)..(226): a, c, t, g, unknown or other
  misc_feature (226)..(226): n is a, c, g, or t
tcagacgcgatcgacacgaccggtgctcgatttagtatctgatagttgggtttgggggtcacaagaggcagcgctctcgggacgtctccaccatggcctgggctctgctgctcctcactctcctcactcaggacacagggtcctgggcccagtctcgccctgactcagcctgcctccgtgtctgggtctcctggacagtcgatcaccatctcctgcactggaaccngcagtgatggttgggagttataaccttgtcctcctggtaaccaacacgccacccaggaccaaacgacccccaaatcgaactgtattatggaggacagtaacgcggcctcgtaggggtttcaacgttcgcttctcgtcggcttaccgaagtctagggtaccaaccgtaccggtccctacccgtagtaaccaacttcgtaccggtcgggtccttaccgaacgggtctacgggaacgggtaccggacggtctaggtactttaacttactcgtctcgtccgtatagtactgaaccgtagggttacgttacgtttaacgtttgggtcgtttacggggaccgggtaggggaaccctaagggtccggtaaccggttacccggtaaccgttaacgggtacccaccgggtaccggaaccggttccgtaccccggttccccgtaccggttaccc

SEQ ID NO: 290006 - DNA, 605 bp, Homo sapiens
  misc_feature: GYAE6OF02I7QOX.45.38.D05.1.454.CMB.1.raw
  modified_base (302)..(302): a, c, t, g, unknown or other
  misc_feature (302)..(302): n is a, c, g, or t
  modified_base (332)..(332): a, c, t, g, unknown or other
  misc_feature (332)..(332): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctccgtggacagtcgatcaccatggcctgcactggaaccaacagtgatggttgggtattttagtttgtctcctggtaccaacaccacccggcaacgccccaaatatctattanaggacactagcggcccgtggggttcagtcncttctctgctcagtctgcacncgcctccngacatctctgggcctccgagctcgaacggacgagctgtatttactttctgttcgtctctatatcgacgacggaccaggcgtaccgttgggttcggttaccgggacgggtacgggtaccgtaggggttcccgtaccggttcccgtaggtccgacggtaccccgtaagggtccctacccggtcccccgtaggttacccgtaccttccggttaccgttcccccgtaccccgttccctccgttacccg

SEQ ID NO: 290007 - DNA, 614 bp, Homo sapiens
  misc_feature: GYAE6OF02HVY7C.45.38.D05.1.454.CMB.1.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggtagttttagtttgtctctggtaccaacaacacccggcgaacgcccccaaactaactctaatttataggacactaagcggcccttcggggtttcaagtcgcttctctgctcaagtctggacaacacggcctcctgacaatctctgggcctccgaggctcgacggacgacggctgtatttatttctgtttcgcttacattacgtgacgaacgggacctaggtactacggttgggttcggtttaccgggcgggtaacgggtaccgtagggttcgaaccgttccgtaggtccgacgcccgtaacgggtcctccggtcccccgttcggtacctaccgttccgttcccggttaccccgtccccttccgtccgtacccg

SEQ ID NO: 290008 - DNA, 725 bp, Homo sapiens
  misc_feature: GYAE6OF02JJASK.45.38.D05.1.454.CMB.1.raw
  modified_base (222)..(222): a, c, t, g, unknown or other
  misc_feature (222)..(222): n is a, c, g, or t
tcagacgcgatcgacacgaccggtgctcgatttagtatctgatagttgggtttggggagtgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtntctctggtgactccatcagtagtagtcaataagttttgggctgggtccgccacgccccctaggggaacgggcgtggaggtggtagttgggacgtgtcgtactcgtaggtcgggaccctacttactacacgtccccgtccctacgaacgtacctcgaccttagggtcgtaattcgtactaaacgtaaacctacgtaccgaaacgtaaaacctaacgtttcctacccgttacggaacggtaccttacggtaaaccttcgttaccggtacgacccgggtccggaccggtaaccgaccggtaacctaaacgtaacttacgtacgtacgaacaacgaacggtacgggtacctaggtaaacttacgttccgtttacgaacccgtaacggtccgggtaccgtacgggtaacccggttcggtacccggtacccgttacgtccccgtaccgtaaccggtaccccttacccgtaaccccgaaccgggccccgttaacgtcccggttacccccg

SEQ ID NO: 290009 - DNA, 641 bp, Homo sapiens
  misc_feature: GYAE6OF02IPL12.45.38.D05.1.454.CMB.1.raw
  modified_base (233)..(233): a, c, t, g, unknown or other
  misc_feature (233)..(233): n is a, c, g, or t
  modified_base (276)..(276): a, c, t, g, unknown or other
  misc_feature (276)..(276): n is a, c, g, or t
  modified_base (366)..(366): a, c, t, g, unknown or other
  misc_feature (366)..(366): n is a, c, g, or t
tcagacgcgatcgacacgaccggtgctcgatttagtatctgatagttgggtttgggatgctttctgagagtcacggacctcctgtgcaggaacatgaagcacctgtggttcctcctcctgctggtggcggctccggatgcgtcctgtcccagctgcacctgcaggagtcgggccaggactggtgaacgccttcggacgccctgtccctctacgttgctagtcgtctcgtggtnacctccatcgagtagtagtacattaaagtttgggctgggtccnccgtacgaccccgaggggacgggctaggagtcggagttggactgtctacgtcgtagcggacctacgttaagttacgacgtcccgtcctanaacgtctcgtactggtcgatctacaataacgacgtacaaacgaacctattcctacgtgacgtctagtaacgtgtcgacgaccgtccggacggtaacgacggtaacctaaagttaccgttaacgtcgggtaacgtaacgtaacgaaggtacggtacctagggtaacttacgtccgtttacgacgtacgtcgggtaccgtcggtaaccgtcggtaccgtaccgtcgtccgtacgaccgttaccgacctacggaccgtccctaggtcccgttaccccg

SEQ ID NO: 290010 - DNA, 657 bp, Homo sapiens
  misc_feature: GYAE6OF02HFY2T.45.38.D05.1.454.CMB.1.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctccgtggacagtcgatcaccatggcctgcactcggaaccaacagtgagttggttagggttagtttttagttttgtcttccgtggtaaccaactaaccgaccccggacgaaccgacccccaaactaactactaatttagtacggacacgtaacgccggcccgtcggggttcaagtcgtcttctcgtcgctcgagtcgtgaccaacgaccgccctacccgtcgaacctaatccgtcgtcgggcctccgacggtcctacgacggacgaggtctagtaatttacgtttcgttgttgtcctagtattacgtcgacgacggtaccagtaccgttacgttgggttcggtccgggcgggtaacgggccgttacgggtcgaacccgttcgtacgtacgacggtacccgaggtcctaccggtcccccgttacggtcctaccgttccgtccgttaccccctaccgttccctcgtaccg

SEQ ID NO: 290011 - DNA, 555 bp, Homo sapiens
  misc_feature: GYAE6OF02HN2M8.45.38.D05.1.454.CMB.1.raw
  modified_base (370)..(370): a, c, t, g, unknown or other
  misc_feature (370)..(370): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagtttgtctcctggtaccaacaaccaccccggcgaacgccccccaaactaactcatttatagggacactaagcggccctcggggttcagtcgcttctctgctcagtctggcaacacgctccngacatctctggctccagctcaggacgaggctgattatttctgttgctcatatgacgagggaccagctacgttgggtgttcggcggagggtaccgaggttcggaccgtccgtacggtcacggtacccgaaggtcctcgcccccgtcgggtaccacgttcctccgttccccacccttcctccgtccg

SEQ ID NO: 290012 - DNA, 557 bp, Homo sapiens
  misc_feature: GYAE6OF02G2UV9.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaattttggggctgggtccgccagcccccagggaagggctggagtggattgggactgtctactctagtgggaccacctattacagcccgtcctcaacgactcgactggtgatctacaataaacacgtaccaagaaccaattctaccctagacggctagactctgtcgaccgcgcggacaccggaccaaattacttactgtagcaagagagggcctaggtaattagtcctttgacctacgtcgggcctacgggacctggtccaccgtctcctcacgcctaccaccacggcccacgtcgtcctcccctcgg

SEQ ID NO: 290013 - DNA, 638 bp, Homo sapiens
  misc_feature: GYAE6OF02IWYER.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaattttggggctgggtccgccacgcccccgagggaaggggctggagtggattgggactgtctactcgtagtgggaccacctattacacgcccgtcctcaagacctcgactggtgatctacaataaacacgtaccaagaaccaattctccctagaggctacgaactctgtgacccgcggacggacaccggaccaaattacttactagtgacgaaagaggagggccttaggtaatttaactccgttttaggaaccctaacgtcggggtaccctacggggtaacccttcgggtacctacccggtccttacccgtccgaacggtccccgttaccccgaacccggtaacgggtccccctaaggttccccgggttaccctttccccccggtacgg

SEQ ID NO: 290014 - DNA, 877 bp, Homo sapiens
  misc_feature: GYAE6OF02J0JUT.45.38.D05.1.454.CMB.1.raw
  modified_base (233)..(233): a, c, t, g, unknown or other
  misc_feature (233)..(233): n is a, c, g, or t
tcagacgcgatcgacacgaccggtgctcgatttagtatctgatagttgggtttggggggggtcgacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactcggaaccaacngtgatggttggtagttttagtttgtctccgtggtaccaacaaccgaccccggcgaacgacccccaaataactctaatttagacggactactaacgccggtacccgtacggggtttacaacggtcgtaccttcgtcgtcggtcctaccgtaacgttccgtagggtacctaaaccgaccgggtcccttaccccgtacggaacctaacgttccttaccgtacggggtcccttacccgaacgggtcctaccgaacgggtaccggtaacggtcccgttaggtacttttaacgttttcgttcggtttacggtaccttacgttaacgtttacgtcggtaacccggtaacggggtaccctaacgggtacccgttaaccgggtttcgggggttaccggtttacccgggggtaccggggtaaccggggttaacccgttaacgggggttttcccggaaaccccgggtttccggttaaccggggttacccgtaaccgggttaacccccggtaaacggggttcccggttaccccggtaaccccccccgggttttcggggtaacccccgtttaacccggttttccccgggttacccccgggttttccccccccgggtaccccccgttttaccccggttaccccgtttaacccccgggg

SEQ ID NO: 290015 - DNA, 600 bp, Homo sapiens
  misc_feature: GYAE6OF02FYGHX.45.38.D05.1.454.CMB.1.raw
  modified_base (356)..(356): a, c, t, g, unknown or other
  misc_feature (356)..(356): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaattttggggctgggtccgccagcccccagggaagggctggagtggattgggactgtctactctagtgggaccacctattacagcccgtcctcaagctcgactggtnatctacaataaacacgtaccaagaacccaattctccctagacggctagaactctgtgacccgccgcggacacggccaaattacttactgtcgacaagaggagggcctagggaactttacgtccgtttagacctacgtcggggtcctacggggaaccctgggtaccacccggttcctaccgtccgacgtccctacccgaacccgaacggggccccagtcccgggttccctttcccccgtaccggg

SEQ ID NO: 290016 - DNA, 714 bp, Homo sapiens
  misc_feature: GYAE6OF02JJD8Z.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtcactccatcagtagtagtcaattaaagtttggggtctgggtccgtcacgacccccgagggaaggggcgtggaggtggagttgggactgtctacgtcgtaggtcgggaccaccgtatacacgtcccgtccctcaacgactcgacgtggtgtatctacaaactaaacacgtaccaaagaaccctaattacctcccgtagacggtactacgtaactcgtacgtacgacccggtccggaccggaccgaacccggtaaccgtaaacttacgttacgtcggtacgaaccgtaaaggacgggtacgggtaccgttaggtaacgtttaccgttaccgtttacgaccgtaaccgggtcgggtacccgttaccggggtacccgtcgggttaccctacccggttcccgtaccgtccgtaacccgtccctaacccggaaccccggtaaccggtaccccgttaccggtttccccggttaccccgttccccccggtaccgg

SEQ ID NO: 290017 - DNA, 582 bp, Homo sapiens
  misc_feature: GYAE6OF02GB5QS.45.38.D05.1.454.CMB.1.raw
  modified_base (438)..(438): a, c, t, g, unknown or other
  misc_feature (438)..(438): n is a, c, g, or t
tcagacgcgatcgacacgaccggtgctcgatttagtatctgatagttgggtttgggggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaattttggggctgggtccgccagccccagggaagggctggagtggattgggactgtctactctagtcgggaccacctattacacgcccgtcctcaagactcgactggtgatctacaataaacacgtaccaaagaacctaattcctccctgacgctgaactcgtgtcgaccgccgacggacacggacaaatattactgtcgacaagngacggcctaggaattactccttagacctacgtcgggcctagggtaaccctggtaccaccgtctccgtcacgtcctaccaccgacgggccctagtcccggtcccttcccccgtaggccctacccgtccctaccaacgcgtacccg

SEQ ID NO: 290018 - DNA, 572 bp, Homo sapiens
  misc_feature: GYAE6OF02FX0GB.45.38.D05.1.454.CMB.1.raw
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccagggactggtgaagccttcggagacccctgtccctnacttgcagtgtctctggtnactccatcagtagtagtcattaaattttggggctgggtccgccagcccccagggaaggggctggagtggattgggactgtctactctagtgggaccactattacagcccgtcctcaagactcgactggtgatctacaataaacacgtaccaagaaccaattctccctgacggctagaactctgtcgaccgccgcggacacggaccaaatattactgtgcaagagaggcctaggaatttatcctttagacctacgtcggggtcctagggaccctggtcctaccgttcctcctcgacgtccctcccgaccgaacggccctagtcccggttccctccccgtccgg

SEQ ID NO: 290019 - DNA, 555 bp, Homo sapiens
  misc_feature: GYAE6OF02J1DON.45.38.D05.1.454.CMB.1.raw
  modified_base (231)..(231): a, c, t, g, unknown or other
  misc_feature (231)..(231): n is a, c, g, or t
  modified_base (391)..(391): a, c, t, g, unknown or other
  misc_feature (391)..(391): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctccgtggacagtcgatcaccatggcctgcactggaaccacngtgatgttgggattataaccttgtctcctggtaccaacagcacccaggcaaacgccccaaactcatgatttatgaggcagtaagcggtccgtcggggtttcaagtcgcttctctggctacgagtctggacaacgacggtcctcctgacatctctggctcngcctcgaggacaggctgattacgtttcnggttcnctctagtctagcgacggcagcgtacgttgggtcgttcggcggtacgggaccttgggtacgtaccggtcgttacggcgaccgtacccggaggtcgtcccggaccccgttacggccgtacctcgttccccgg

SEQ ID NO: 290020 - DNA, 610 bp, Homo sapiens
  misc_feature: GYAE6OF02G10EG.45.38.D05.1.454.CMB.1.raw
  modified_base (382)..(382): a, c, t, g, unknown or other
  misc_feature (382)..(382): n is a, c, g, or t
  modified_base (409)..(409): a, c, t, g, unknown or other
  misc_feature (409)..(409): n is a, c, g, or t
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
  modified_base (456)..(456): a, c, t, g, unknown or other
  misc_feature (456)..(456): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggtagttttagttttgtctcctggtaccaacaacacccggacgaacgacccccaaactaactctatttagtagggacaacgtaagccggtcccgtcgggggtttacaacgtccgtcttcgtctggctcaagtctgacaacncggcctccagacaatcctctcgggtcnccgaggcctcgacggacgaggctagtatttattcgtgttncttnatngtacaggaccagcgtacgttgggtcgttcgggcggtaggaccgtagggttcgaccgtcgtaggtcaccggacccgtaacggtcctaccggtcccccgttacggtacctaccgttccggttccgttcccccgtcccgttcccttaccgtacccgg

SEQ ID NO: 290021 - DNA, 572 bp, Homo sapiens
  misc_feature: GYAE6OF02GVTUA.45.38.D05.1.454.CMB.1.raw
  modified_base (464)..(464): a, c, t, g, unknown or other
  misc_feature (464)..(464): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagttttgtctcctggtacctaacaaccaccccggcgaaacgccccccaaactaactcaatttatagggacactaagcggcctcggggtttcaagtcgcttctctggctcaagtctgcaacacggcctcctgacaatctctggctccaggctcaggacgaggctgattatttcgtgttcgcttcatatgcagggaccagctacgttgggtgttcggnggacggaccgtaggttcgaccgtccgtaggtcacgacccgaagggccttcggccccccgttcggtacctaccgttccgttccgttcccccacccttcccgtcctccgg

SEQ ID NO: 290022 - DNA, 766 bp, Homo sapiens
  misc_feature: GYAE6OF02F0KYH.45.38.D05.1.454.CMB.1.raw
  modified_base (213)..(213): a, c, t, g, unknown or other
  misc_feature (213)..(213): n is a, c, g, or t
  modified_base (251)..(251): a, c, t, g, unknown or other
  misc_feature (251)..(251): n is a, c, g, or t
tcagacgcgatcgacacgaccggtgctcgatttagtatctgatagttgggtttggggggggtcacaaggaggcagcgctcgtcgggacgtctccaccagtcggccgtggctctgctgctcctcactctcctcactcaggacacgaggactcggtcgggtccctttctcgccctgacctcacgcctgccctccgtgtcgtgggtctccgtgacngtcgatccaccagtcggcctgccacgtcggaaaccacngtagattgggttagggttagtttttagttttgtccttccgttaggtaaccctaaacaaccccgaccccggacgaaacccgaccccctaaaacgtaactcctaattttaacgaacgggaacctaaccgttaaacggcccggtcccgggtttcgggggtttaccaacggttccggtactttccgtcgtcggtcctacgtaacgttccgtaggaccaaacggtcccggccctttacccgtacgaacctaacgttcctacgtcgggtcctaccgaggtcctacggaacggacggacggtctaggtactttagtttccgtgttcgctactaagtacgtcgacgaccgggacacgtctacggttgggtcggttcgggacggtacgggacgttacggtacgtaccgtcgtaacggtcgaaccggtaccgaacggtcctacccggtccccccgttacgggttaccctaccggtttcccggttaccccggttcccccgtccccgtttacccgtacgttacccgg

SEQ ID NO: 290023 - DNA, 567 bp, Homo sapiens
  misc_feature: GYAE6OF02IY082.45.38.D05.1.454.CMB.1.raw
  modified_base (231)..(231): a, c, t, g, unknown or other
  misc_feature (231)..(231): n is a, c, g, or t
  modified_base (341)..(341): a, c, t, g, unknown or other
  misc_feature (341)..(341): n is a, c, g, or t
  modified_base (421)..(421): a, c, t, g, unknown or other
  misc_feature (421)..(421): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacngtgatggttggtagttttagtttgtctctggtaccaacaacacccgcgaacgacccccaaataatctatttagtaggacactaagccgccgtcggggttcagtcgcttcnctgctcagtctgcaacacgcctccgtgactatctacgtcggctccgagctacgagacgagtctgtattatttcgtgttcncttctatagtcgacgacgggaccagctacgttagggtgttcgggcgggacggtaccgagggttcgaccgttacgtaggtcacgaccgaaggtcctccggccccgttcgacctcctccgttccgttccccgccttcccgtcctccgg

SEQ ID NO: 290024 - DNA, 702 bp, Homo sapiens
  misc_feature: GYAE6OF02GD4LX.45.38.D05.1.454.CMB.1.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatcggcctgcactcggaaccaacagtgatggttgggtagtttttagttttgtcttcctggtaccaacaaccgacccgcgaacgcccccaaactactcatttagtagggacactaacgccggtccgtcgggggtttacaacgtcgtccttctcgtcggcctacgagtcgtacgacaaccgtaccgccctaccgtacgaactactcgtcgtcggtcctaccgacgtcgtacgaacggacggacggtctagttagtttactttacgttgttcgtcttactaagtagttcggacgtaacgggacctagtaccgttacggttcggggttacgggtccggggtacgggtaacgggtaccggttacggttaccggtacccgttacggtacggttacgaacccggtacccggtaacggtcccgtacccggtcccccggttacggtacccgttacccgttaccgttccccgttaccccctccccgttccttacccgtaccgg

SEQ ID NO: 290025 - DNA, 730 bp, Homo sapiens
  misc_feature: GYAE6OF02GFAF2.45.38.D05.1.454.CMB.1.raw
  modified_base (544)..(544): a, c, t, g, unknown or other
  misc_feature (544)..(544): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctcgccctgacctcacgcctgcctccgtgtctgggtctcctggacagtcgatcaccagtcgcctgcactacggaaccaacagtgtagttggttgggttagtttttagtttgtccttcctggtaacccaaacaaccgaccccggacgaaaccgacccccaaaacttaactactattttaagaacgggtaactacgtaacggccggtcccgttacgggggtttacaacggtccgtacttcctcgtggtcctacgtaacgttcgtagggacctaaaccgtacccggtcctacccgtagaacctaacgttcctcggtcggtccctaccggacggtctaccggaacgggaccggacggtcgtagttaacttttactttcgttggttcgacttntaacttagtcgaacgacggtaccaggtccttaggttgggtcgttcgggacgggtacgggtacctacgggttcgtaccggtacgttacggccgacggtacccgacggtcccgttacccggtccccgttacggtaccttacccgttccggttccccggtttaccccgccctttcccgttcgtacccgg

SEQ ID NO: 290026 - DNA, 591 bp, Homo sapiens
  misc_feature: GYAE6OF02GP2VV.45.38.D05.1.454.CMB.1.raw
  modified_base (357)..(357): a, c, t, g, unknown or other
  misc_feature (357)..(357): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgattggttgggtagttttagtttgtctccgtggtaccaacaacacccggcaacgacccccaaatatctattagaggacactaagcgccgtcgggttcagtcgcttctctgctcagtctgacacncgcctcctgacatctctcggctccgagctcgaggacgacggctagtatttatttcgtgttagtctatatagtgaccgagggaccagctacggtttcgggttcgttccggggcgggtacgggtaccgtacggttaccgtaccggttacgtacggtcgacggtacccgaaggtcctccggccccgttcggtccgaccgttccgttccggttccccgtcccttcccgtaccgtccgg

SEQ ID NO: 290027 - DNA, 767 bp, Homo sapiens
  misc_feature: GYAE6OF02HTNAS.45.38.D05.1.454.CMB.1.raw
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgtattggttgggttagtttttagtttgtccttccgtcggtaaccaacaaccgaccccggacgaaccgacccccaaacttaactactaatttagaacggaacctaacgtaaggccggtcccggtttcggggttacaacggtcgtcttccgtcgtcggtctaccgtaagtcgtcgggaccaacgaccggtccctccgtacgaacctaacttcctcggtcggtcctaccgacggtcctacggaacggacgacggtctagtaacttttatttccgttagttcgcttactaagtttagtcggaaccgtaacgggtaaccacggtacccgtttaagggttttcggggtacgggttacccggggaccggggtaacgggtacccggttaaggggttacccggaacccgggtttccggtaaccggttacggaacccggttaccccgggaacgggttcccggtcccccgttacccccgggtttaccggtcctacccgtttaccggttccccggtttaccccccgtccctttcccgccgtttaaccgg

SEQ ID NO: 290028 - DNA, 696 bp, Homo sapiens
  misc_feature: GYAE6OF02ILRUC.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagtccttcggagaccctgtccctcacttgcagtcgtctctggtcactccatcagtagtagtactattaaagtttgggcttcgggtccgccacgccccgagggaacgggctggagtgagttggactgtctacgtctaggtcggacctactatacgacgccccgtcctacaagctcgactggtgatctacaactaacacgtaccaaacgaacctaatttcctaccgtagacggtctagtaaccttcgtacgtcgacccggccggtacggaccgacggtaacctaaattacgttaacgtgtacgaacgtaacggacggaacgggtccgtaagggtaactttaccgttaccgttttaacggaacccgtacggttacggggtacccgttaccggggtaacccgtttcgggtacccgttaaccccgttccttacccgtacccgacccggttcccctaacccggtaacccggtaacccggggtacccccttacggttcccccggtttaccccccg

SEQ ID NO: 290029 - DNA, 713 bp, Homo sapiens
  misc_feature: GYAE6OF02IFIHL.45.38.D05.1.454.CMB.1.raw
  modified_base (228)..(228): a, c, t, g, unknown or other
  misc_feature (228)..(228): n is a, c, g, or t
tcagacgcgatcgacacgaccggtgctcgatttagtatctgatagttggtttgggggggtcacaagaggcagcgctctcggcacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaanagtgagttggttgggtagtttttagtttgtctcgtggtaaccaacgaaccaccccggcgaaaccgaccccctaaaactaatcctaattttacgaaggaactaacgtaaacgccggtacccgtcggggttttaccaaggtccgtctttcctacgtcggtccttaccgaaagtccgtacggaccaaaccgtaccgggccccttaccgagtaaccaaacttccgtcgttcgggcctttccgacggtcctacgacggacgtagggcttaggtattttacgtttcgtgtttcgcttactaacgtatcgacgtacggaccacgtcgtagttgggtcgttccgggacgggacgggtaacctagggttacgaaaccggttccgtaacggtcgtaaccggtacccgtaagggtcccgttacccggtaccccccgttcgggttacctaacccgttccggtttacccctcccccgttaccccgtccctttacccgg

SEQ ID NO: 290030 - DNA, 646 bp, Homo sapiens
  misc_feature: GYAE6OF02JOMLH.45.38.D05.1.454.CMB.1.raw
  modified_base (159)..(159): a, c, t, g, unknown or other
  misc_feature (159)..(159): n is a, c, g, or t
  modified_base (346)..(346): a, c, t, g, unknown or other
  misc_feature (346)..(346): n is a, c, g, or t
  modified_base (591)..(591): a, c, t, g, unknown or other
  misc_feature (591)..(591): n is a, c, g, or t
tcagacgcgatcgacacgaccggtgctcgatttagtatctgatagttggtttgggggggtcgacaagaggcagcgctctcgggacgtctccaccatggcctgggctctgctgctctcactctcctcactcaggacacaggatccgtgggccctttctgnggcccttgactccagccctgcctccgtggtccagggtctcctgggaccagtccgaatcgacccattgcctagcacttggaaccaactggtgtattgtgggactttagtttcgactactcggtaccaagaccaccccggtataagccccctaaatagtccaattcccgaagtacgaccttttaacggnacgtaccgtacggtcgtacgtcgtcgtcgtctcgtacgtacgtacgtacgacgtaccgtacgtaccgtacgtacgtactacgtcgtcgtcgtcgtcgtacgcgacgacgacgtacgtacgtagtgttagttcttgtcgtacgtactacgtacgtacgacgacgtacgtacgtcggtcgtacggtcggtacggtacggtacggtacggtacggtacgtacgtacggtaccgtacggtccgtacggnggaccggtaccggtccgtccgtccgtccgtccgtcccgtcccgtccttccgtccg

SEQ ID NO: 290031 - DNA, 633 bp, Homo sapiens
  misc_feature: GYAE6OF02GX73N.45.38.D05.1.454.CMB.1.raw
  modified_base (232)..(232): a, c, t, g, unknown or other
  misc_feature (232)..(232): n is a, c, g, or t
  modified_base (427)..(427): a, c, t, g, unknown or other
  misc_feature (427)..(427): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatcggcctgcactggaaaccaanagtgatggttgggattttagttttgtctcctggtaccaacaacaccccggcgaacgcccccaaataatcatttatagggacactaagcggcccgtcggggtttcaagtcgtcttctctggtctccaagtctggcaacacggcctccctgacaatctctgggcctccgagctcgaggacgaggcgtgtattatttnttgttgctcactatcgacgaggtaccagacgtaccgttagggttcgtttcggggacgggtacgggaccgtacgggttacggacccgttaccgtacgggttaccgacggaccccgtaagggtccgtaccggtcccccccgttcggttacccgtaaccgttcccgttcccggttcccccgtcccccgttccccgttcccgttacccgg

SEQ ID NO: 290032 - DNA, 630 bp, Homo sapiens
  misc_feature: GYAE6OF02FXP4K.45.38.D05.1.454.CMB.1.raw
  modified_base (306)..(306): a, c, t, g, unknown or other
  misc_feature (306)..(306): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggtagttttagttttgtctcctggtaccaacaacacccggcgaacgccccaaactaatcatttanagggacactaagcggccgtcggggttcagtcgtcttctcgtcggctccaagtctgctaacacgcctcctgacaatctcgtcgggctccgagctcgacggacgaggctgtatttagtttctgtttacgctactattacgtgacgagggacctaagcgtacggtttgggtacggtttcgggacgggtacggggtaacctacgggttacggacccgttccggtacgggttccaccggccccgaaagggtccctccggtccccccgttcgggttaccctaccgttccggttcccggtttcccccgcccctttcccgtccgttacccgg

SEQ ID NO: 290033 - DNA, 635 bp, Homo sapiens
  misc_feature: GYAE6OF02F1P2W.45.38.D05.1.454.CMB.1.raw
  modified_base (373)..(373): a, c, t, g, unknown or other
  misc_feature (373)..(373): n is a, c, g, or t
  modified_base (439)..(439): a, c, t, g, unknown or other
  misc_feature (439)..(439): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggtagtttttagttttgtctcctggtaccaacaaccaccccggcgaacgacccccaaactaatcaatttatagggacactaagcggccgtcggggtttcaagtcgcttctctggctccaagtctcggcaacncggcctccctgacaatctcgtcgggctccaggctcgaggacgaggctgatttatttctgttgcttntagtatacgcgacgggaccagtctacggttgggtaggtttcgggacggggtacggaccgtagggttacgaccggtccgttacgggtcgaacgggtccccgtaaacgggtccctcccgggtccccccgtttcggtacccgtaccgttcccggtttacccggtttcccccgccccccgtttccgttcccttacccggg

SEQ ID NO: 290034 - DNA, 544 bp, Homo sapiens
  misc_feature: GYAE6OF02G0TWA.45.38.D05.1.454.CMB.1.raw
  modified_base (432)..(432): a, c, t, g, unknown or other
  misc_feature (432)..(432): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggtagtttttagttttgtctcctggttaccaacaacaccccggcgaagcccccaaactaatcatttatagggacactaagcggccctcgggggtttcaagtcgcttctctggctccaagtctggcaacacggcctccctgacaatctctgggctccaggctcaggacgaggctgatttatttctgttgctnatatgcagggaccagcacgttgggttgttcgggcggagggccagggttgaccgtcctaggtcagcccgaaggctcgccccgtcggtccactctcgttcccacctcctctccg

SEQ ID NO: 290035 - DNA, 598 bp, Homo sapiens
  misc_feature: GYAE6OF02HBM4W.45.38.D05.1.454.CMB.1.raw
tcagacgcgatcgacacgaccggtgctcgatttagtatctgatagttggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagttttgtctcctggtaccaacaacaccccggcgaacgcccccaaactaactcatttatagggacactaagcggcctcggggtttcaagtcgcttctctgctcagtctgcacacgcctcctgacaatctctgggctccacggctcgaggacgaggctgattatttctgttgctctatactgcagggaccagcgacgttcggggttgttccgggcgggtacgggaccgtagggttcgacccggttccgttacgggtccacggtacccgtaaacggccgtccggccccccgttccggtacccgtacgttcccgttaccggtttcccccggtccccgttcccttccgttcccgg

SEQ ID NO: 290036 - DNA, 629 bp, Homo sapiens
  misc_feature: GYAE6OF02ILCXC.45.38.D05.1.454.CMB.1.raw
  modified_base (229)..(229): a, c, t, g, unknown or other
  misc_feature (229)..(229): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtcccctcacttgcagtgtctctggtnactccatcagtagtagtcattaaagttttggggctgggtccgccacgccccccagggaagggctggagtggattgggactggtctactctagtgggaccacctattacacgcccgtccctcaagactcgactggtgatctacaataaacacgtaccaagaaccaattctccctgagctgaactctgtcgaccgccgcggacacggaccaaattacttactgtgacaaggaggaacgggtcctagggaactttacgtaccgttttagacccgtacgtcgggggtaccgtacggggaacccgttgggtaccctacccggttctaccccgttccgaccgtccccttacccgaacccgaaccggggtccccaacgttcccgggttcccttccccccgtaccggg

SEQ ID NO: 290037 - DNA, 553 bp, Homo sapiens
  misc_feature: GYAE6OF02IIXOE.45.38.D05.1.454.CMB.1.raw
  modified_base (307)..(307): a, c, t, g, unknown or other
  misc_feature (307)..(307): n is a, c, g, or t
  modified_base (546)..(546): a, c, t, g, unknown or other
  misc_feature (546)..(546): n is a, c, g, or t
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggagttttagttttgtctcctggtaccaacaacaccccggcgaaagccccccaaaataactcaatttanaggactactaaagcggcctcggggttcaagtcgcttctctggctccaaagtctggcaaacacggcctcccgtgacaatctctgggctccaggcctcacggacgaagctgtacttagtttctgttgctcatatgcagggaccagcacgttggtgttcggcggaggactaggttcgacgtccgaggtcacgccgaaagcttccggccccgttcggctacgtcctcgttcccgacccttccnctaccgg

SEQ ID NO: 290038 - DNA, 675 bp, Homo sapiens
  misc_feature: GYAE6OF02GX50S.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtcccctcacttgcagtgtctctggtgactccatcagtagtagtcattaaagttttggggctgggtccgccacgcccccagggaagggctggagtggagttgggactgtctactctaggtgggaccactattacacgcccgtccctacaacgactcgacgtggtgatctactaaataaacacgtaccaaacgaaccaacttcctacccgtgacggtctacgtaactcgtagtcgacccgccggtacgggaaccgaaccgggacctaaaacgttactttaaccgttgtacgacgaaaggaggacgggccgtaaggtaactttacgttaccttttacgaccctacgggttcgggtacccgttacggggtaaccccttgggtaccctacccggttcctacccgtccgacgtaccccgtacccgaacccggaaccgggtacccctacggttcccggttccccgttcccccgtaccgg

SEQ ID NO: 290039 - DNA, 675 bp, Homo sapiens
  misc_feature: GYAE6OF02H8LMF.45.38.D05.1.454.CMB.1.raw
  modified_base (327)..(327): a, c, t, g, unknown or other
  misc_feature (327)..(327): n is a, c, g, or t
tcagacgcgatcgacacgaccggtgctcgatttagtatctgatagttgggtttgggtttagaacctatgaacattctgtaggggccactgtcttctccacggtgctccctttctgccctgactcagcctgcctccgtgtctgggtctcctggacagtcgatcaccatggcctgcactggaaccaacagttatgttgggagtttttagttttgtctcctggtaccaaacaacaccccggcgaacgcccccaaactaatcatttatagggacactaagcggcccttcggggggtttacaagtcgcttctctggctcaagtctggcaacncggcctcctgacatctctgggcctcaggctcaggacgaggctgatttatttctgttgcttcattgtgacgagggtaccagctacgtttggggtaggtttccgggacgggtagggaacccgtagggtttcgacccggttccgtagggttaccgaacggaccccgtaagggtccttaccggccccccgtgggtaccctaaccgtttcccgttacggtttccccccaaccccgtttcccgttcccgttaccggtaccttccggacccgtttccgacggtaccgggtccggggtaccgtcgggtaccggaaacgggcccggttacgaacgttacggctagtcgacacgtcgc

SEQ ID NO: 290040 - DNA, 569 bp, Homo sapiens
  misc_feature: GYAE6OF02G2RYB.45.38.D05.1.454.CMB.1.raw
  modified_base (308)..(308): a, c, t, g, unknown or other
  misc_feature (308)..(308): n is a, c, g, or t
  modified_base (361)..(361): a, c, t, g, unknown or other
  misc_feature (361)..(361): n is a, c, g, or t
  modified_base (368)..(368): a, c, t, g, unknown or other
  misc_feature (368)..(368): n is a, c, g, or t
tcagacgcgatcgacacgaccggtgctcgatttagtatctgatagttgggtttgggggggtcacgaagaggcagcgctctcgggacgtctccaccatggcctggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagtttgtctccttgtaccaacaaccaccccggcgaacgcccccaaaactaactcaatttanaggacactaagcggcctcggggtttcagtcgcttctctgctcagtctggcacncgctccngacatctctggctccaggctcgacggacggaggctagtatttatttctgttcgcttcattattcgcacgggaccagctacgttgggtcgttcggcgggagggtacctagggttcgaccgttcgtacggtcacgcccgaaggccttccggccccgtcggtcctaccgtccgttaccgttcccccgcccttcccgtccgtccg

SEQ ID NO: 290041 - DNA, 594 bp, Homo sapiens
  misc_feature: GYAE6OF02G5PZI.45.38.D05.1.454.CMB.1.raw
  modified_base (209)..(209): a, c, t, g, unknown or other
  misc_feature (209)..(209): n is a, c, g, or t
  modified_base (228)..(228): a, c, t, g, unknown or other
  misc_feature (228)..(228): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctnacttgcagtgtctctggtnactccatcagtagtagtcaattaaagttttggggactgggtccgccagcccccagggtaaggggctgggagtggattgggactgtctactctagtgggaccactattacagcccgtcctcaacgactcgactggtgatctacaataaacacgtacaagaaccaattctaccctgacggctacgaactcgtacgtcgaccgccgacggacaaccggacctaaattacttacgtagtagacgaagagacgggcctaggtaacttagtcctttagacctacgtcgggcctagggaccctggtcctaccgtctacctctacgcctaccgaaccgacggtacccacgtcccggttaccttccccgtaccgg

SEQ ID NO: 290042 - DNA, 579 bp, Homo sapiens
  misc_feature: GYAE6OF02FVU1B.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaatttggggctgggtccgccagcccccagggaaggggctggaggtggagttgggactgtctactctagtgggaccacctattacacgtcccgtccctcaagacctcgactggtgagtctacaaataaacacgtaccaaagaaacctaactttctccctgacggctagaactctgtcgaccgccgcgacacggaccaaatcttactgtcgacaagagagggccgtaggtaattacgtccgtttagacttacgtcgggcctagggtaccctggtccaccgtctcccgtacacgtccctccgaccgaacgggccctacgtccggttccccg

SEQ ID NO: 290043 - DNA, 587 bp, Homo sapiens
  misc_feature: GYAE6OF02HJX48.45.38.D05.1.454.CMB.1.raw
  modified_base (306)..(306): a, c, t, g, unknown or other
  misc_feature (306)..(306): n is a, c, g, or t
  modified_base (373)..(373): a, c, t, g, unknown or other
  misc_feature (373)..(373): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggtagttttagttttgtctcctggtaccaacaacaccccggcgaagcccccaaataactcatttanagggacactaagcggcctcggggttcaagtcgcttctctggctccaagtctggcaacacggcctccngacaatctctgggctccaggctcgaggacgaggctggtattatttcgtgttgctcatatgcagggaccagctacgttggggtcgttcgggacggacgggtacctagggttcgacccgttccgtaagggtccacggacccgtaaggtccctccggccccccgttggtacccgaccgttccgttccggtttccccccgcccttcccgtccttccgg

SEQ ID NO: 290044 - DNA, 650 bp, Homo sapiens
  misc_feature: GYAE6OF02JERJ4.45.38.D05.1.454.CMB.1.raw
  modified_base (381)..(381): a, c, t, g, unknown or other
  misc_feature (381)..(381): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaagttttggggctgggtccgccacgccccccgaggggaacggggtctgggagtggtagttgggactggtctacgtcgtaggtgggacccacgttattacacgtccccgtcctcgaacgactcgactggtnactctacaataaacacgtaccaaacgaacctaatttcctcctaggacgtcctagaactcgtagtcgacccgtccggccggaaccgaccggaccaaattcttacgtcgtagacgaaggacggtacgggccttagggaactttacgttcccgtttagacccgtacggtcggggccccgttagggaccccgttgggtccctaacccgttcgtacccgtaccgacgtacccctaccgacccggaaccgggccctacggtcccggtttaccccg

SEQ ID NO: 290045 - DNA, 561 bp, Homo sapiens
  misc_feature: GYAE6OF02G4PO6.45.38.D05.1.454.CMB.1.raw
  modified_base (359)..(359): a, c, t, g, unknown or other
  misc_feature (359)..(359): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaattttggggctgggtccgccagcccccagggaagggctggagtggattgggactgtctactctagtgggaccactattacagcccgtccctcaagactcgactggtnatctacaataaacacgtaccaagaaccaattcctcctagacggctagaactctgtgaccgccgcggacacggcaaatattactgtgacaagagagggcctaggaactttatcctttgaccgtacgtcggggtcctacgggaaccctggtccaccggtcctcccgtcacgccctccgaccgaacgggccctagtccggtcccc

SEQ ID NO: 290046 - DNA, 633 bp, Homo sapiens
  misc_feature: GYAE6OF02JKU54.45.38.D05.1.454.CMB.1.raw
  modified_base (545)..(545): a, c, t, g, unknown or other
  misc_feature (545)..(545): n is a, c, g, or t
tcagacgcgatcgacacgaccggtgctcgatttagtatctgatagttgggtttgggggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcaataaagttttgggctgggtccgcacgccccgagggagggctggagtggagttgggactgtctacgtctaggtcgggaccactattacacggtcccgttccctacaacggtactccgactggtgactctacaataaaccacgtaccaagaacctaatttcctacctgacggtctacgtaactctagtcgaccgccggtacggacaccggactaaatacttacgtgtacgacgaagtggacggtacttaggtaaacttcgtacctttacggacctacgtacggggtctacgggacccgttggtaccctaccgttccnccgtccgacgtaccctacgaaccgacgggtaccctagttcccggtccctcccgtcgaccctcccctaccgtacgtaaccgcgtacccg

SEQ ID NO: 290047 - DNA, 553 bp, Homo sapiens
  misc_feature: GYAE6OF02FY0AS.45.38.D05.1.454.CMB.1.raw
  modified_base (527)..(527): a, c, t, g, unknown or other
  misc_feature (527)..(527): n is a, c, g, or t
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccacagtgatggttgggagttttagttttgtctcctggtaccaacaacaccccggcgaacgcccccaaactaactcatttatagggacactaagcggccctcgggggtttcaagtcgcttctctggtctccaagtctggcaacacggcctccctgacaatctctgggcctccgaggcctcgacggacgaggctgatttatttctgttgcttcatatgcgaggaccagcgtacgttgggtgttcggcggagggacctaggttcgaccgtcgtaggtcacgaccgaaggctccgccccgtgtaccncttctccgttccccgcctcctctcgg

SEQ ID NO: 290048 - DNA, 628 bp, Homo sapiens
  misc_feature: GYAE6OF02H4G2D.45.38.D05.1.454.CMB.1.raw
  modified_base (209)..(209): a, c, t, g, unknown or other
  misc_feature (209)..(209): n is a, c, g, or t
  modified_base (313)..(313): a, c, t, g, unknown or other
  misc_feature (313)..(313): n is a, c, g, or t
  modified_base (362)..(362): a, c, t, g, unknown or other
  misc_feature (362)..(362): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctnacttgcagtgtctctggtgactccatcagtagtagtcattaaagttttgggctgggtccgccacgccccagggagggctggagtggattgggactgtctacgtntagtggaccacctattacgacgtcccgtcctacaagactcgactggtanatctacaataaacacgtaccaagaacctaattccaccctggacgtctagaaccttcgtagtcgaaccgcccgacggaccaccggaccaaaattctttaacgtgtgactaaggaggacgggtcctaggtaatttactccgttttacgacctacgttgggcccgttacgggaacccgttggtcccgtaccggtctcccgtacgtacgtcccgtacccgaaccgtaaccgggtcccctaaggtcccggttcccttaccccgtacccggg

SEQ ID NO: 290049 - DNA, 795 bp, Homo sapiens
  misc_feature: GYAE6OF02JX62O.45.38.D05.1.454.CMB.1.raw
  modified_base (125)..(125): a, c, t, g, unknown or other
  misc_feature (125)..(125): n is a, c, g, or t
  modified_base (169)..(169): a, c, t, g, unknown or other
  misc_feature (169)..(169): n is a, c, g, or t
  modified_base (231)..(231): a, c, t, g, unknown or other
  misc_feature (231)..(231): n is a, c, g, or t
  modified_base (391)..(391): a, c, t, g, unknown or other
  misc_feature (391)..(391): n is a, c, g, or t
  modified_base (449)..(449): a, c, t, g, unknown or other
  misc_feature (449)..(449): n is a, c, g, or t
  modified_base (507)..(507): a, c, t, g, unknown or other
  misc_feature (507)..(507): n is a, c, g, or t
tcagacgcgatcgacacgaccggtgctcgatttagtatctgatagttgggtttggggggggtcacaagaggcagcgctctcgggacgtctccaccatggcctgggctactgctgctcctcactcnctcactcaggacacaggatccgtgggtccctttctgccctactnacgtcctgcctcgtgtctggtcaccttggaccagtcgacgacctagtcggccaaacgttccnggaacccaacgagtacgtagtggttagggtgttttaggtttagttacgttccttggtaccctaacgtaaccaccccggaccgaaccgggtacccaaccctaaacgtacacttaacgttaacgtaccggaactcgtaacggccttttacttttttacgggngtttaacccgtcttcgtcgtcgtactcctaagtcacccgttaaccgacgtccttaccncccgaagtcgtccttggacgtccctaggccgtactaggaccgagtctcgtagaccccngtacttcgttgttacgtacgtactacgtacgaccgtacggtaccggtacgtacgtacgttacgggttagggttacgggttaccgggtaccgggtaaccgggtacggttacgggttacccggttacccggaacgggttaccggtaccggtacccggtaccggttacccgaaccggttcccccggttaaccccggttgggggtaccgtttacccgttcccggtttccccgggttccccccgttacccgttacccgtacccgggtaccgttcccggtacccggttacccgg

SEQ ID NO: 290050 - DNA, 602 bp, Homo sapiens
  misc_feature: GYAE6OF02I1AK6.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctccggatgcgtcctgtcccagctgcacctgcaggagtcgggcccaggactggtgaagccttcgggagaccctgtccctcacttgcagtgtctctggtgactccatcagtagtagtcaattaaagttttggggctgggtccgccagcccccagggaaggggctggagtggattgggactgtctactctaggtgggaccacctattacacgcccgtccttcaagactcgactggtgactctacaataaacacgttaccaaagaacctaatttcctccctagacggcttagaactctgtacgacccggccgtacgggacaccggaccaaattacttacgtgtcgactaagacggaagggtcctaggtaacttacttccgtttagacctacgtcgggccgtacgggaccctggtaccaccgttctaccgtctacgcctccgacgaacgggcccagtccggtccctccccgtaccgg

SEQ ID NO: 290051 - DNA, 591 bp, Homo sapiens
  misc_feature: GYAE6OF02FTB2R.45.38.D05.1.454.CMB.1.raw
  modified_base (229)..(229): a, c, t, g, unknown or other
  misc_feature (229)..(229): n is a, c, g, or t
  modified_base (363)..(363): a, c, t, g, unknown or other
  misc_feature (363)..(363): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactgggtgaagccttcggagaccctgtccctcacttgcagtgtctctggtnactccatcagtagtagtcaattaaagttttggggctgggtccgccagcccccagggaaggggctggagtggagttgggactgtctactctagtgggaccacctattacagcccgtcctcaagactcgactggtnatctacaataaacacgtaccaagaaccaattctccctagacgctagaactctgtcgaccgcgcggacaccggaccaattatactgtcgacgaagaggagggcctaggtaattattcctttagaccgtacgtcgggccgtacgggacccgtggtacctccggtcctccctccgtacgtccctaccgaccgaccgggtcccctagtcccggttacccttcccccgtccgg

SEQ ID NO: 290052 - DNA, 568 bp, Homo sapiens
  misc_feature: GYAE6OF02FPYB6.45.38.D05.1.454.CMB.1.raw
  modified_base (228)..(228): a, c, t, g, unknown or other
  misc_feature (228)..(228): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtnactccatcagtagtagtcataaattttggggctggtcgccagcccccagggaagggctggagtggattgggactgtctactctagtgggaccactattacagcccgtcctcaagactcgactggtgatctacaataaacacgtaccaaagaaccaattcctaccctgacggctagaactctgtcgaccgcgcggacacggccaaattattactgtgcaagagaggcctaggtaattattccttgaacctacgtcgggccgtcgggaaccctgggtaccaccggtctccgtacacgtccctaccgaccgacgggtccccagtccggtccttcccccgtcgg

SEQ ID NO: 290053 - DNA, 606 bp, Homo sapiens
  misc_feature: GYAE6OF02G39KX.45.38.D05.1.454.CMB.1.raw
  modified_base (337)..(337): a, c, t, g, unknown or other
  misc_feature (337)..(337): n is a, c, g, or t
  modified_base (363)..(363): a, c, t, g, unknown or other
  misc_feature (363)..(363): n is a, c, g, or t
  modified_base (452)..(452): a, c, t, g, unknown or other
  misc_feature (452)..(452): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagcctttcggagaccctgtcccctcacttgcagtgtctctggtgactccatcagtagtagtcattaaagttttggggctgggtccgccagcccccgagggaagggctggagtggattgggactgtctactctagtgggaccacctattacncgcccgtcctcaagactcgactggtnatctacaataaacacgtaccaaagaaccaacttcctcccgtgacgggctagaacttcgtgtcggacccgcgcggacacggaccaaattnttacgtgtagacaagaggaggcctaggaatttactccgtttgaccctacgtcggggaccgtcgggaacccgtggtaccgtaccggttcctacctacgacgtcccctacccgaccgaacgggccctaacgtcccggttccttccccccgtaccgg

SEQ ID NO: 290054 - DNA, 704 bp, Homo sapiens
  misc_feature: GYAE6OF02JZ69U.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagcataagtttgggctggtccgcacgccccgaggagggctggagtggatgggactagtctacgtcgtaggtcgggtacctacctaattaccgacgtccccgttaccctacgaaacgaccgttcggaaccgtggtagactcttacaaattaaaccgaccgtaccgtaaacggaacctaactttcctaccctaggacggccttaggtaacctctggtaccgtaccggcccggacggaaccgaaccggtaacctaaacgttacttaacgtcgtacgaccgaaaggaaggaccgggtacccgttagggtaaactttacgttaccgtttacgacccgtacgttcgggggaccctacggggtaaccccgttcgggtaaccctacccggttccttacccgtaccgaccggtcccttacccgaacccggtaacccgggtccctaaccggttcccggtttaaccccccg

SEQ ID NO: 290055 - DNA, 630 bp, Homo sapiens
  misc_feature: GYAE6OF02HBPWU.45.38.D05.1.454.CMB.1.raw
  modified_base (231)..(231): a, c, t, g, unknown or other
  misc_feature (231)..(231): n is a, c, g, or t
  modified_base (255)..(255): a, c, t, g, unknown or other
  misc_feature (255)..(255): n is a, c, g, or t
  modified_base (257)..(260): a, c, t, g, unknown or other
  misc_feature (257)..(260): n is a, c, g, or t
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (301)..(301): a, c, t, g, unknown or other
  misc_feature (301)..(301): n is a, c, g, or t
tcagacgcgatcgacacgaccggtgctcgatttagtatctgatagttggggtttggggggtgtggtggtactccgactcccggccttggacgaggctagattagtttctgttgactccagtattgctaggaccagtcacttgggtgtcggcggaggtaccaggttcgaccggtcctaggtcagccaaggcctgcccctgtcactctgtcccacctctctcggatcgcgtcngagcggactggcaaggcacatgantnnnncaganagatactgntgacagcatacnggtacanccgatacnctgactactacgtcgcgactacgtccgtaaccgggtactcccgggtactacggtacctacgtacgaacgggttacgcgtaacgggtccgtacgacggtaacgttacgttacgttaaccgacgttcgtaacgtacgttacgacgtacgtacgtacgtacgtacgacgtacgtacgtacgtacgtacgtacgtacttacgttacgtacgtacgtacgtacgtacgtacgtacgtacgtacgtaccgtacgtacgtacgtacgtacgtacgtacggtacgtacgtacgtacgtacgtacgtacgtacgtacgtacgtacgtacgtacgtacg

SEQ ID NO: 290056 - DNA, 866 bp, Homo sapiens
  misc_feature: GYAE6OF02JQ674.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgcgtggtggcggtccgtccggatcgccgtcctcgtcccgagtctcgacctaccgtgacgagggtacggtcccgggacccgaaggtacgtggtaggaaccgtccgttacggaccgtaccccgttcgtccctactacgttgcgtagtcgtcctcgtggtacacctctactacgtagttacgtactattaaagtttagggttcggcggtccggtcccaccgaccccgacccgggaaggggacggtcggtaggtaggtaggttaggtcggtacttcgttacctacgttgtacgggtaccggtaaccctaacgttaacgtaccgcccggtccccgttaccaacgaaccgtcgtaccgtacggtggtactactacgtaaactaaaacgtaacccgtaaccggtaaacaaaaccgtaaaccctttacgttcccgtaacccggtaaggtacccgttacgtaaaccgttaacttccggttacggacccggaccccggtcccggtaaaccgaaccgaacccggttaaaacttaaaccgtttagttaccgagtaccgaacgtaaacgggaccgggtacgtaacccggtaagttaacctttccgttaccgtaaccgaccggtccggggtaccggtacggttacccgggtaccgtttacccggtacctacccgtttcccgtaccgtaacccggtcccgtaccccgtaaaccggaaccccggtaccggtccccttaaccggtttcccccggtccccccgg

SEQ ID NO: 290057 - DNA, 692 bp, Homo sapiens
  misc_feature: GYAE6OF02IAUI5.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggccaggactggtgaagccttacggacgacccctgtccctcacttgcagttcgtctcgtggtcgtacctcatcagtagtagtacattaaagtttgggcgtgggtccgccacgaccccgagggacgggcgtggagtggagttcgggactgtctactcgtaggtcggacctaccgtatacacgccccgtcctacgacgtactcgtacttaggtcgtactcgtaactaaagtaaacctacgtaacccaaagtaaaccctaatttccctacccgtaggacgtaccgttagtaaacttcgtaggtaccgacccggtccggaccgggaaccaccggtaacctaaacgtacttacgtagtacgaacgaacgggaggtaaccgggcgttagtaaactttccttacgtttaccgacgtacgggtccggggtacgtaccgggtaacccgttcgggtaccctaccgttcccgtcctccgtaccgtcccgtacccgacggaaccccgggtcctacggtcccgttacccccgg

SEQ ID NO: 290058 - DNA, 568 bp, Homo sapiens
  misc_feature: GYAE6OF02FTOE6.45.38.D05.1.454.CMB.1.raw
  modified_base (307)..(307): a, c, t, g, unknown or other
  misc_feature (307)..(307): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (552)..(552): a, c, t, g, unknown or other
  misc_feature (552)..(552): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggtagttttagtttgtctcctggtaccaacaaccacccggcgaacgcccccaaactaatcatttanaggacactaagcccggccgtcggggttcagtcgcttctctggctcagtctgcaacacgcctcctgacatctcgtcgggctccgagctcgacggacgaggctgtatttagtttctgttcnctntatatgcgaggaccagctacgttgggtcgttcgggcggtacgggaccgtaggttcgaccgtcgtaggtccgacgcccgtaaggcctccggtccccgtcggtccacgttccgtccgttaccccncccgttcctcctaccg

SEQ ID NO: 290059 - DNA, 619 bp, Homo sapiens
  misc_feature: GYAE6OF02I5P2Y.45.38.D05.1.454.CMB.1.raw
  modified_base (374)..(374): a, c, t, g, unknown or other
  misc_feature (374)..(374): n is a, c, g, or t
  modified_base (414)..(414): a, c, t, g, unknown or other
  misc_feature (414)..(414): n is a, c, g, or t
  modified_base (437)..(437): a, c, t, g, unknown or other
  misc_feature (437)..(437): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatcggcctgccacgtcggaaccaacagtgattggttgggtagtttttagttttgtctctggtaccaacaaccaccccggcgaaccgcccccaaactatctaatttatagggacacgtaagcggcccgtcggggttacagtcgcttctgtggctcagtctgcaacncgcctcctgacactctctgggactcagtctcgacggacgnggctgatttacttctgttctctntatatgacacgggtaccagtcctagttacggggttcggttccggggtacggtacggggtaccgtagggttcggtacccggttccgttagggctaccggtaccgaacggtccgtaccggtccccgtcggttaccctaccgttccggttacccgttccccgtacccgtttcccgtaccttcccg

SEQ ID NO: 290060 - DNA, 694 bp, Homo sapiens
  misc_feature: GYAE6OF02IHHPJ.45.38.D05.1.454.CMB.1.raw
  modified_base (242)..(242): a, c, t, g, unknown or other
  misc_feature (242)..(242): n is a, c, g, or t
tcagacgcgatcgacacgaccggtgctcgatttagtatctgatagttgggtttggggggtgtgggctcagaagcagagttctgggggtgtctccaccatggcctggacccctctctggctcactctcctcactctttgcatagggtctgtactttcttctgggctgactcaggagtctgctgtgtctgtggccttgggacagacagtcaagatcacatcgccacggagacacgcctacaggnggcactatgacaaacgtggtaaccaagaagaacggccgggacacggcccctcttacttgtctagttggtttaacggaaaaaccgcccggtccgtccgggactacccgacgaccgtattctcgtcgactcctacctacgaacgaacacacgtcttaccttcgaaccactaccgtacgtacgggctacgacggacggaaacggtagtggaacggtcgtagtaaccgttatttacgttcggacgtaacgaccaacgtaccgggaaccaactaaacgtaagttacggttaagttcggttttacgacccggtacccgggtaaccaacggttacctacccggttaccgttacggtaccaaccggtacccgaaggtcccgtacccggtacccccgttacggtacccttaccgttcccgttacccggttacccccgtacccttccctaccgttaacccgg

SEQ ID NO: 290061 - DNA, 732 bp, Homo sapiens
  misc_feature: GYAE6OF02H302Y.45.38.D05.1.454.CMB.1.raw
  modified_base (617)..(617): a, c, t, g, unknown or other
  misc_feature (617)..(617): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctcgccctgactcagcctgcctccgtgtctgggtctctggacagtcgatcaccatggcctgcactcggaaccaacagtgagttggttagggtagtttttagttttgtccttccgttacggtaacctaacaaaccgacccccgggacgaaaccgaccccccctaaaacttaactacctaagttttacgtaacggggaacctaacgtaaacggcccgggtccccgttacggggggttttaccaagggttccgtactttccgttactcggccttaccgaaaggttcctacggccaaaccgacggtccctacccctggaacctaactcttacgtcgggtcctccgacggtccgtacgagggaccggacggctagtatttacgtttcgttacgttgtctctagttatcgacgtaacgggacctagtcgtacggtttgggtcggttccggggcgggtacgggtaccngggttacgacccggttcgtacggtcgaccgtacccgaacgggtccctaccggtcccccgttcggtcccgtacctccgttcccgttcccccgtacccgtttcccgtaccgtacccg

SEQ ID NO: 290062 - DNA, 561 bp, Homo sapiens
  misc_feature: GYAE6OF02F05XT.45.38.D05.1.454.CMB.1.raw
  modified_base (306)..(306): a, c, t, g, unknown or other
  misc_feature (306)..(306): n is a, c, g, or t
  modified_base (426)..(426): a, c, t, g, unknown or other
  misc_feature (426)..(426): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatggttgggtagttttagttttgtctcctggtaccaacaacaccccggcgaacgcccccaaactatcattanaggacactaagcgcctcggggttcaagtcgcttctctggctccaagtctggcaacacggcctcctgacaactctctgggctccgaggctcgaggacgagctgtattatttctgttcgctnatatgcagggccagctagttggtgtcgggcggacggtaccgtaggtcgaccgtccgtaggtcacgacccgaaggcctccggtcccccgtcggtcctaccgttccgtccgttccccgtcccttcccgtccttcccg

SEQ ID NO: 290063 - DNA, 588 bp, Homo sapiens
  misc_feature: GYAE6OF02IL88C.45.38.D05.1.454.CMB.1.raw
  modified_base (229)..(229): a, c, t, g, unknown or other
  misc_feature (229)..(229): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgccactggaaccngcagtgatggttgggtagttttagttttgtctcctggtaccaacaacaccccggcgaacgacccccaaactaactcatttatagggacactaagcggccgtcggggtttcaagtcgcttctctggctcaagtctggcacacgcctcctgacatctcgtcggctccgaggctcgaggacgagctgtatttacttctgttcgcttctattacgtgcgacgggaccagcctacgttgggtgttcgggcggtacgggcctagggttcgccgttaccgtggtcacggcccgtaacgggcctacccggtccccgttcggtacctaccgttccgttcccggtttcccccgtcccgttccctcccgg

SEQ ID NO: 290064 - DNA, 632 bp, Homo sapiens
  misc_feature: GYAE6OF02I5EBG.45.38.D05.1.454.CMB.1.raw
  modified_base (299)..(299): a, c, t, g, unknown or other
  misc_feature (299)..(299): n is a, c, g, or t
  modified_base (602)..(602): a, c, t, g, unknown or other
  misc_feature (602)..(602): n is a, c, g, or t
tcagacgcgatcgacacgaccggtgctcgatttagtatctgatagttgggtttgggggtcacaagaggcagcgctctcgggacgtctccaccatggcctgggctctgctgctcctcactctcctcactcaggacacgaggatcggtcggtcccttttctcgccctgacctcacgtcctgccctccgtgtcgtgggtcctccgtggacagtcgatccaccagtcggcctgccacgtcggaaacccaacgagtgattggttagggtagtttttagtttgtctccgtggtaaccaacaaccnccccggacgaaccgacccccaaactactactaatttagaggaccacgtaacgccggtcccgttcggggttacaaggtccgtcttctcgtcggcctcaagtctcggacaacgccggcctcctacgacactcctcgtcggtcctccgagcctacgacggacgagtctagttattcttctgttcgctctagtacgtcgacgacgggacctaggcttacgggttggttcggtccgggacgggtacggtaccgtgggtccgaccgttcgtacggtcacggaccacggtcctccggtccccgtgtaccnccgttcgtcccgtcccgccttccgtctcgg

SEQ ID NO: 290065 - DNA, 740 bp, Homo sapiens
  misc_feature: GYAE6OF02HRK1R.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagacccctgtccctcacttgcagtgtctctggtgactccatcgagtagtagtactaattaaagtttggggcgtcgggttcccgaccaccggcccccgaagggggaacggggtctgggaggtggtagttcggggacttcgtcttactcgtaggtcggacctacctattacacgtccccgtcctacaagtacctcgtacgtggtgtacttactacaaactaaacgtacccgtaaccaaacgtaaaccctaactttccctacccgtaggacggtaccttagaaccttcgtcgtacggacccgccggacggaccgaccggaacctaaagttactttacgtgtacgaacgaaaggagggtaaccgggtccgtaagggtaaacttttaccgttaccgtttacgaacccgtacgggttccgggggtacccggttaccgggtaaccccggtttcgggtaacccttaccccggttccttaccccgtacgacccgttaccccgtacccgaaacccggtaaccgggccccctaggttccccgggtttacccccc

SEQ ID NO: 290066 - DNA, 835 bp, Homo sapiens
  misc_feature: GYAE6OF02ITZW3.45.38.D05.1.454.CMB.1.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtcgggccctttctcgccctgactcagcctgcctccgtgtcgtgggtctcctggactagtcgatcaccagtcggcctgcacgtaggaaaccaacgagtgtagtggttaggggttagtttttagttttcgtccttaccgtacggttaaccaaaccgtaaccgtaacccccgggacgtaaaccggtaacccccccctaaaaattaactaccgttaacgtttaagtaacgggaacctaaacgtaacggcccggtaccccggtttacgggggtttacctaacggttccggtccttttacgtccggttagggtacccttaccgtaaggttccgtacgggtacccaaacgtcccgggtacctaccccgtagaaacctaacgttcccgtacgtcggggtacctaccgacggtacctacggaacgggtaccggtaacggtcctttaggttaacgttttaacgttttccggttcgttaccggtactacgtaacgtttacgtacggtccgtaaggttacggttacggtttacgtttgggttacggtaccgggtacggaacgggttaaccgacgtccgttacggtaacccgttacgtacgggttccgaaccgtaccggtaaccggtcccgttaccggtccccccgtaggttccctaacgttcccgttaccgttaccccgtacccttacccgtgtaacccgg

SEQ ID NO: 290067 - DNA, 697 bp, Homo sapiens
  misc_feature: GYAE6OF02JS70E.45.38.D05.1.454.CMB.1.raw
  modified_base (312)..(312): a, c, t, g, unknown or other
  misc_feature (312)..(312): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctccgtggacagtcgatcaccatggcctgccactcggaaccaacagtgattggttggtagttttagtttgtctccgtggtaccaacgaacgacccggcgaacgccccctaaatatctaattanaggactacgtaagccggtaccgtcggggttacaagtcgcttctcgtcggtctaccgagtcgtcggacaacgccggtcctcctagacatctcgtcggcctcgagtcgtcgacggacgacgtacgtcgtattactttcgtacgttcgtctacgtagttagtacgtcgacggtaccgacgtacgtacgttgggttacccccccggttgggtaccgggtacgggtaccggtacgggttaccggtaccggttaccgttacgggtaccgtaccggtacccggtaaccgggtacccggttaccggtacccccgttcccgggttacccgtacccgtttacccggtttcccggttaccccgttacccccggttacccgttcccggttaacccgg

SEQ ID NO: 290068 - DNA, 707 bp, Homo sapiens
  misc_feature: GYAE6OF02J0F7P.45.38.D05.1.454.CMB.1.raw
  modified_base (364)..(364): a, c, t, g, unknown or other
  misc_feature (364)..(364): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagcccttcggagacccctgtcccctcgacttgcagttcgtctctggtgactccatcagtagtagtcaattaagttttggggctgggtccgccagcccccgaggggaacgggctggagtggtattgggactgtctactcgtaggtgggacctactattaccgacgtccccgtcccttanaacgtacctcggaaccgttgggtacgtacttccgtaacaaacttaaaacgccgttaaccaaacgaacctaaaccttcctacccgttaggacggtactacggtaaacctcgttacgtcggaacccggaccgtaccgggaacctaccggacctaaagttactttacgtgtacgacgaacgtagggtacggccgttaaggaactttcgtaccgttacgaccgtaacggtcgggtaaccgtacgggtacccgttcggtaccgtaccgtccttccctacgaccgtacccgtacccgaaccgtaccggtacccctaacggttcccggttacccgttcccccgtaaccgg

SEQ ID NO: 290069 - DNA, 672 bp, Homo sapiens
  misc_feature: GYAE6OF02FN1MJ.45.38.D05.1.454.CMB.1.raw
  modified_base (304)..(304): a, c, t, g, unknown or other
  misc_feature (304)..(304): n is a, c, g, or t
tcagacgcgatcgacacgaccggtgctcgatttagtatctgatagttgggtttggggggggtcacaagaggcagcgctctcgggacgtctccaccatggcctgggctctgctattcctcaccctcctcactcagggcacagggtcctgggcccagtctgccctgactcagcctgcctccgtgtctgggtctcctggacaggcgatcaccatctcctgcactggaaccagcagtgacgttgttattataactatgtctctggtaccaacaacacccaggcaaacgcccccaactcatgtatttangatgtcagtaatccggccctcgtaggggtttctgtatcgctttctcgtcggtcctaccgtaagtcgtggaccaaaccgacccggtccctccccgtacgaaccctacgttccgtaccgttcggggcctcccgaggtccgtagggtaacgggaccgagggtcctagtaactttaacttacctggtaccgtacgtacctactattagtccgacgaacccgcgtaacgactaagttccggtaaccttacgtttaacggttccgttacggggaccggggtaacgggaacccaaacgggtccttaaccggtaacccggttaccgttacgggtcccgtaaccggaccccccggtaagggtcccgttacccccggg

SEQ ID NO: 290070 - DNA, 631 bp, Homo sapiens
  misc_feature: GYAE6OF02H3L9G.45.38.D05.1.454.CMB.1.raw
  modified_base (352)..(352): a, c, t, g, unknown or other
  misc_feature (352)..(352): n is a, c, g, or t
  modified_base (368)..(368): a, c, t, g, unknown or other
  misc_feature (368)..(368): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtcccctcacttgcagtgtctctggtgactccatcagtagtagtcaattaaagttttggggctgggtccgccacgcccccgagggagggctggagtggagttgggactgtctactcgtaggtggaccacttactacacgcccgtaccctnaacgactcgactggtntatctactaaataaacacgtaccaaagtaaaccctaattctacccgtagacggctacgaacttctacgtcgaacccggccgcgggaaccaccggaccctaaaattcttaactgtgaacgtaaggacggtagggtacctagggaactttactccgtttagaccctagtcgggcctacgggaacccttggtaccaccgttcctcctccgtacgaccccaccgtaacccgaacgggcccctagtcccggttccctacccccgtcgg

SEQ ID NO: 290071 - DNA, 683 bp, Homo sapiens
  misc_feature: GYAE6OF02IIJNT.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtcccctcacttgcagtgtctcgtggtgactccatcagtagtagtcaattaaatttttggggctgggtccgccacgcccccgagggaagggctggagtggattgggactgtctactctagtcggaccactattacacgcccgtcctcaagactcgactggtgatctacaaataaaacacgtccaaaacgaacctaacttctaccctgaacggtctagaactctgtacgacccggccgccggaacaccggacctaaaattacgtttaacgtgttacgactaaaggaggacggggtacctagggtaaactttacgttaccgttttacgaccctaacgggtcggggacccgttacggggtaaaccccgtttcggtaccgtaaccccggttccttaccccgtaccgaaccggttccccttacccgaacccgtaacggggtcccccctaacggtcccggtttacccctttcccccccggtaccggg

SEQ ID NO: 290072 - DNA, 573 bp, Homo sapiens
  misc_feature: GYAE6OF02G0EN6.45.38.D05.1.454.CMB.1.raw
  modified_base (230)..(230): a, c, t, g, unknown or other
  misc_feature (230)..(230): n is a, c, g, or t
  modified_base (447)..(447): a, c, t, g, unknown or other
  misc_feature (447)..(447): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtnactccatcagtagtagtcataaattttggggctgggtccgccagcccccagggaaggggctggagtggattggggactgtctactcgtagtgggaccacctaattacagccccgtccctcaagactcgactggtgatcgtacaataaacacgtaccaaagaaccaatttcctccctgacgctagaactctgtcgaccgccgcggacacggccaaatnttactgtgacaagagacgggcctaggaatttattcctttagacctaacgtcggggacctacggggaaccctgggtccaccgttcgtcctcgacgccctccgaccaacgggccctagtccgttcccc

SEQ ID NO: 290073 - DNA, 673 bp, Homo sapiens
  misc_feature: GYAE6OF02GXF0R.45.38.D05.1.454.CMB.1.raw
  modified_base (518)..(518): a, c, t, g, unknown or other
  misc_feature (518)..(518): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactgggtagaagccgttcggacgaccctcggtcccctcgacttgcctagtcgtcctcgttgggtcacctccatcaggttaagtacgtctaatttaaagttttcggggcgtcgggtccgccgacggcccccgaaggggaacgggcgtggaggtggaggttggacgtgtctacgtcgtaggtcggaccacttactacgacgtcccgtccctacgaacgtaccgtcgacgtgtacgactctacaaactaaacgaccgtacaaacgaaacctaacttccgtacctaggacgtcgtacgtaactcgtgtcgaccgccgacggaccgacgacaattactacgtgtnacgaagagacggtctaagtacttacgttcttacgaccgtcggtcgggtaccgtacgggtaacccttcggtaccgtaccgtccgtccgtacgtaccgtcccctaaccgacccgtaacgggtcccctacggttcccggttcccgtcccccgtcccgg

SEQ ID NO: 290074 - DNA, 724 bp, Homo sapiens
  misc_feature: GYAE6OF02JIWC1.45.38.D05.1.454.CMB.1.raw
  modified_base (206)..(206): a, c, t, g, unknown or other
  misc_feature (206)..(206): n is a, c, g, or t
tcagacgcgatcgacacgaccggtgctcgatttagtatctgatagttgggtttggggatgctttctgagagtcacggacctccgtgtgcaggaacatgaagcacctgtgttcctctctgctggtgcggctccggatgcgtcgtgtcccagctgcacctgcaggagtcgggcccaggctggtgagccttggacgtaccctgtccctntacgttgactaggtcgtctgtggtacgtacctccgaatcgagttagtagtactaattaaagtttcgggcgttcggggtccaccgtacgcccccgaaggggaacggggtcgtagggtaggtggtacgttagggacttgtacgtacgttacgtaggtacgggaccacgttagttacacggtccccgtcctacgaacgtacgtacgacgtggtaccgtatactaactaactaacctacgtaccaaacgaacctaactttccgtaccgtagtacggtcgtaacgtaaccgttcgttcggttacgacccgggtcccgaccggaccgaacccgggtaacctaaaacgtttaacttacgtacgtcggaacgtaacggaacggtacggtacgtaaggtaactttaccgttcgttacgtaccgtaacggtcgggtaccggttacggtaccgtcggtacccgtaccgtccgttcctcgtaccgtcctacccggaaccgtacccggtaccctacggttcccgttccccg

SEQ ID NO: 290075 - DNA, 625 bp, Homo sapiens
  misc_feature: GYAE6OF02JHQAF.45.38.D05.1.454.CMB.1.raw
  modified_base (279)..(279): a, c, t, g, unknown or other
  misc_feature (279)..(279): n is a, c, g, or t
  modified_base (443)..(443): a, c, t, g, unknown or other
  misc_feature (443)..(443): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagtttgtctcctggtaccaacacaccccggngaacgcccccaaataatctaatttagagggacactaagccggccgttacggggttactaagtcgtcttctctcggctccaagtctgacaacaccggtcctcctgacaactctcgtgggacctccaggtctagaggacgaggtctagtattacttactagctacnctactatactgacgtaggttacgtagttacgttttgggttcggttacgggcgggaacgggtaccgaacgtcgtacggtacccgttaccgtacgggttacacggtacccaacggtcgaccccggtccccgttaccggtaccgtacccttccgttcccggtttccccgaccccgttcctacccg

SEQ ID NO: 290076 - DNA, 623 bp, Homo sapiens
  misc_feature: GYAE6OF02F14KR.45.38.D05.1.454.CMB.1.raw
  modified_base (380)..(380): a, c, t, g, unknown or other
  misc_feature (380)..(380): n is a, c, g, or t
tcagacgcgatcgacacgaccggtgctcgatttagtatctgatagttgggtttgggggggggtcacaagaggcagcgctctcgggacgtctccaccatggcctgggctctgctgctcctcactctcctcactcaggacacaggatcgtgggccctttctgcccctgactcagcctgcctccgtgtctgggtctcctggacagtcgatcaccatcggcctgcactcggaaacccaacagtgattggttgggttagttttagttttgtcttccgtggtaccaacaaccaccccggcgaacgccccccaaactaactcattatagggacacgtaagccggccgtcggggtttacaagtcgcttctctggctcagtctgcaacncgcctcctgacactctctcgggctccgagtctacgacggacgaggctgtatttagtttcctgttcgctctatagttgacgagggaccctagcctagttgggtcgttcggggacgggtaggaccgtagggtacggtaccgtaccgttaggtaccgacgtacccgaacgggccgtacccgcccccgttcggtacccgtaccttccgttccggtttacccccgtccccttcccgtccgttacccgg

SEQ ID NO: 290077 - DNA, 548 bp, Homo sapiens
  misc_feature: GYAE6OF02FO6TO.45.38.D05.1.454.CMB.1.raw
  modified_base (425)..(425): a, c, t, g, unknown or other
  misc_feature (425)..(425): n is a, c, g, or t
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttgggagttttagttttgtctcctggtaccaacaacaccccggcgaagccccccaaaactaatccatttatagggacactaagcggccctcgggggtttcaagtcgcttctctggctccaagtctggcaacacggcctccctgacaatctctgggctccaggctcaggacgaggctgattatttctgttncttcatatgcagggaccagcacttgggtgttcgggcgggagggaccaggttgaccgtccgtaggtcagcccgaaggcctcggccccctggtccacgtcctcgttccccgccttccctctccgg

SEQ ID NO: 290078 - DNA, 678 bp, Homo sapiens
  misc_feature: GYAE6OF02ID2QQ.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactgggtgaagccttcggagaccctgtccctcacttgcagtgtctcgtggtgactccatcagtagtagtcagttaaagttttggggctgggtccgccacgccccgagggaacggggctggagtggagttgggactgtcgtactcgtaggtcgggaccaccgtattacacgcccgtccctcaacgctcgactggtgatctacaaactaaacaccgtaccgaaacgaacctaacttcctacccgtacgaggtcctaggtaaaccttcgttcggtaccggtacccggcccggtaccgggaaaccgaacccgggtaccaaaaactttactttaacgtggtacgtacgaaaggaggtaacggggtccttaagggtactttaacgttcctttacgaacctacggtcggggtcccgtaacgggtaccctgggtaccctaccgtcttccctagaccggtccctacccgacgaccggccctacgtcccggtaccgttcccccgtaccgg

SEQ ID NO: 290079 - DNA, 582 bp, Homo sapiens
  misc_feature: GYAE6OF02FINRL.45.38.D05.1.454.CMB.1.raw
tcagacgcgatcgacacgaccggtgctcgatttagtatctgatagttggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggatccagcggtgacgtttactgtttttaagtatgtctctggtatcagcaacaccaggcaaacgcccccaaactcatctatttactgatgtacaataactcggccctcgaggggtttctcatcgcttctctcggctcgaagtctggactaagtaccggtccctccctgacctatctcgtcgggcctccgacggctaggaacgacgtaggctagtatttacttacgtgcagcactatattatttacgttcgtttaccacgttacgggttacgttcgggacggtacgggaccgtaaggttaccggacccgttaccgtacggtaccacggtaccctaagggtcctccgtcccccgtcggttaccc

SEQ ID NO: 290080 - DNA, 540 bp, Homo sapiens
  misc_feature: GYAE6OF02I132N.45.38.D05.1.454.CMB.1.raw
  modified_base (291)..(291): a, c, t, g, unknown or other
  misc_feature (291)..(291): n is a, c, g, or t
  modified_base (435)..(435): a, c, t, g, unknown or other
  misc_feature (435)..(435): n is a, c, g, or t
tcagacgcgatcgacacgaccggtgctcgatttagtatctgatagttgggtttggggggggtcacaagaggcagcgctctcgggacgtctccaccatggcctgggctctgctattcctcaccctcctcactcagggcacagggtcctgggcccagtctgccctgactcagcctgcctccgtgtctgggtctcctggacaggcgatcaccatctcctgcactggaaccagcagtgacgttggtatataactatgtctctggtaccaacaacacccaggcaaagcccccaaancatgatttatgatgtcagtaatcgccctcgagggtttctgatcgcttcgtctggctcaagtctggacaacgacggccctccctgaccactcctcgtgggcctacgagctggacggacgaggctgtattatactgcagctcatcngcacgtcagtccagtgacttactaagtcgttacgggacgggaacgggacccaagtcgtacggacccgttcgtaacggtccgaacgcccgtaaggtccctacccgg

SEQ ID NO: 290081 - DNA, 816 bp, Homo sapiens
  misc_feature: GYAE6OF02JNRON.45.38.D05.1.454.CMB.1.raw
tcagacgcgatcgacacgaccggtgctcgatttagtatctgatagttgggtttggggggggtcacaagaggcagacgctctcgggacgtctccaccatggcctgggctctgctgctcctcactctcctcactcaggacacgaggatcggtgggtccctttctcgccctgactccacgcctgcctcgtgtctgggtctccgtggacagtcgactcaccagtggcctgccaccgtggaaaccctaacgtagtacgtagttaggtttcgggtagtttttacgttttcggtccttcccgtacgggtaaccaaaccgtaacccgacccccgggtacgaaacccgacccccctaaaacttactaccgtaactttaacgacgggtaactaccgtaacggcccggtacccgggttacgggggtttaccaacggttccggtcctttccgtccgttccggtacccgttaccgtaagttcccgtagggtaccctaaccgtacccgggtcccttcccgtacgacctaacgttccgtccgtccgggacctccggacggtccgtcggaacggtacgacggttccgtagttaacgtttactttcgttcggtttcgtccttacggtaacttaggtcggaccgtaacgggacctacggtacgttacggttcgggtccggttacggggaccggaaccgggtaccgacgttacggacggttaccccgtaggtaccggtccgacccggtaccggtaacgggttcccttacccggaccccgttccggtaaccctcctttcccggttacccccgtccccgttcccgttacccgttcgg

SEQ ID NO: 290082 - DNA, 816 bp, Homo sapiens
  misc_feature: GYAE6OF02HU5E9.45.38.D05.1.454.CMB.1.raw
  modified_base (126)..(126): a, c, t, g, unknown or other
  misc_feature (126)..(126): n is a, c, g, or t
tcagacgcgatcgacacgaccggtgctcgatttagtatctgatagttgggtttggggggggtcgacaagaggcagcgctcgtcgggacgtctccaccatggcctgggctctgctgctcctcactcncctcactcaggacacaggatcggtcgggtccctttctcggccctggacctcagtccctgccttccggtgtccgtgggtcctccgtggaccagtcgatccaccagtcggctggctagacggaaaccacgagtgagtaggtttcgggtagtttttagtttgtccgtcgtacggtaaccaacgtaaaccgaccccggacgtaaaccgacccccctaaaactaactacttaacgtttaacgtaacggaaccaacgttaacggccggtccccggtttacgggggtttacaaacggttccgtacttcgttcggtacgaccttaccgtaacgttccggtacggactaaaccgacggtcccgtaacccttacggaactaacttccgttcggaccgggttcaccgtacgggtaccttacgaaccgggtacggtacggtctagttaactttacgtttcgttcggttacgttcgacgtaactttacggagtaaccgtacggtaccggagttaaccgtaggggtttcggttcggggttaaccgggcggggtaccgggtaccgtaacgggggttccgtaacccgttcgggtttaacgcccgtaggtaaccccggtaacgggtccctacccgggtccccgttacgtacccgttaccgttccccgtacccggtttccccctacccgtacccgttcccgtacccgg

SEQ ID NO: 290083 - DNA, 673 bp, Homo sapiens
  misc_feature: GYAE6OF02JC8I7.45.38.D05.1.454.CMB.1.raw
  modified_base (310)..(310): a, c, t, g, unknown or other
  misc_feature (310)..(310): n is a, c, g, or t
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacacgtgattggttgggtagtttttagttttgtctcctggtaaccaacaaccacccagcgaacgacccccaaataatcaattanaggacactacgcggccgttcggggtttcagtcgtcttactctggcctcgaacgtctaggacaaccgaccggcctccgtagactaacttcctacggtcggcctcccgaggtccgtcgaacggaccggtaggtcttagtactttatttccgtgttcgtacttctaatagtcgcgtacgggacctacgtcgtacgtttcggggtgttccgggacggggtaacgggtccgtagggttcggtacccgttccgttaacgggccgtaaccggtcccggaaacggttccgtaccccggtaccccccggttggttcccgtaccgtttccccggttaccgtttacccccgtacccccgttcccgtttacccgg

SEQ ID NO: 290084 - DNA, 568 bp, Homo sapiens
  misc_feature: GYAE6OF02IH59O.45.38.D05.1.454.CMB.1.raw
  modified_base (209)..(209): a, c, t, g, unknown or other
  misc_feature (209)..(209): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctnacttgcagtgtctctggtgactccatcagtagtagtcataaattttggggctgggtccgccacgcccccgagggaagggctggagtggagttgggactgtctactcgtagtcgggaccactattacacgcccgtcctcaagctcgactggtgatctacaaataaacacgtaccaaagaaccaattcctcctgagctgaactctgtcgacgccgcggacacggaccaaaattnttacngtagacaaggagagggcctaggaaactttcttaccgtttgaacctacgtcggggccttagggaccctggtccaccgtctcctcacgcctaccacgacggccctatccggtcctccccgtcgg

SEQ ID NO: 290085 - DNA, 680 bp, Homo sapiens
  misc_feature: GYAE6OF02HQ7J6.45.38.D05.1.454.CMB.1.raw
  modified_base (329)..(329): a, c, t, g, unknown or other
  misc_feature (329)..(329): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggacgaccctgtccctcacttgcagtgtctcgtggtgacctccatcagtagtacgtcaattaaagttttgggcgtcgggtccgccacgcccccgaggggaagggcgtggaggtggagttgggactgtctacgtntaggtcgggacctactattacgcgtccccgtcctacaacgactcgacgtggtatatactacaaactaacgacgtaccaaaacgtaacctaactttaccctacccgtagacgtactacgtaaccttcgttcggtaccgacccggtacccggacggaaccgaaccggtaacctaaagttaacttaccgtagtacgaacgaaggacggtacgggtaccgttaggtaactttacgttccgtttacgaacccgtacggtccgggtaccgttacgggtacccgttcggtaccctccgttccgtccgtaccaccgtccctaccgaccgtaacccggcctacgttcccggttacccccg

SEQ ID NO: 290086 - DNA, 723 bp, Homo sapiens
  misc_feature: GYAE6OF02G2NLG.45.38.D05.1.454.CMB.1.raw
  modified_base (209)..(209): a, c, t, g, unknown or other
  misc_feature (209)..(209): n is a, c, g, or t
  modified_base (228)..(228): a, c, t, g, unknown or other
  misc_feature (228)..(228): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcggcccaggactggtgaagccttcggagaccctgtcccctnacttgcagtgtctctggtnacctccatcagtagtagtcaagttaaagttttggggacgttgggttcccgaccaccgacccccgacggggaaggggcgtggaggtggagttgggctgtcctactcgtaggtcgggaccctaccgtagttaccgacgtccccgtccctaccgtaacgaccttcggtaaccgtcggttacgtacgttacctactaaaactaaaactaaccggtacctaaaacgaaaccctacttaccctaccctaggtacgaccgttacggtaaccttcgtacggtcgaacccggtccgaccggacgaaccggaccctaaagttacttaacgtgtgtacgaaaggtagggacggaccggttagtaactttacttccgtttcgaaccgtcggtcggaccgttaccggacccgttcgtaccgtaaccgttccgtcccgtaccgtaccgtcccctaccaacccggtaccggaccccgtacgttcccgggttcccctttccccggtcccgg

SEQ ID NO: 290087 - DNA, 618 bp, Homo sapiens
  misc_feature: GYAE6OF02FYK9N.45.38.D05.1.454.CMB.1.raw
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
  modified_base (476)..(476): a, c, t, g, unknown or other
  misc_feature (476)..(476): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccagggactggtgaagccttcggagacccctgtccctnacttgcagtgtctctggtnactccatcagtagtagtcaattaagttttggggctcgggtccgccacgccccccgaaggggaacggggctcgggaggtcgggagttgggactggtctactcgtaggtcgggaccactattacgacgcccgtccctcaacgactcgactggtgtactctacaactaaacacgtaccaagaaccaattcctcctgacggtctacgtaactctgtcgaccgccgacggacacggaccaaattacttacngtgacaaggagacggcctaggtaactttatccgttcgacctcgtacgggccgtacgggacccttggtacctacccggttctcccgtacacgtccctaccgacccgacgggcccctacggtcccggttcctacccccgtccgg

SEQ ID NO: 290088 - DNA, 258 bp, Homo sapiens
  misc_feature: GYAE6OF02FPG46.45.38.D05.1.454.CMB.1.raw
  modified_base (240)..(240): a, c, t, g, unknown or other
  misc_feature (240)..(240): n is a, c, g, or t
  modified_base (246)..(258): a, c, t, g, unknown or other
  misc_feature (246)..(258): n is a, c, g, or t
tcagacgcgatcgacacgaccggtgctcgatttagtatctgatagttgggtttggggggtgtggtggtctccactcccgccttgacgaggctgattatttctgttgctcatatgcagggaccagcacttgggtgttcggcggagggaccaggttgaccgtcctaggtcagcccaaggctgccccctggtcactctgttcccaccctctctcgatcgcgtctgagcgggctgggcaaggcncatagnnnnnnnnnnnnn

SEQ ID NO: 290089 - DNA, 657 bp, Homo sapiens
  misc_feature: GYAE6OF02IV7AD.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagcctttcgggagaccctggtccctcacttgcagtgtctctggtcgactccatcagtagtagtcattaatttgggctggtccgccacgccccgagggagggctggagtggagtggactgtctactcgtagtcgggacctaccgtattacagtcccgtacctcaagtctcgacgtggtagtatctacaataacgacgtacaagaacctaattcctaccgtagtacgctacgaactctcggtcgaccgccgacggacacggaccaaagttattaccgtagtacgactaaagggacggtaacgggtaccgtagggtaaactttacgttacccgtttacggacccgtaacgggtcggggtacccgtaccgggtaacccgtacgggttaccgtacccggtcccttacccgaccgtccggacccttacccgacccgaacgggtccctaagtacccggttccttcccccggttaccgg

SEQ ID NO: 290090 - DNA, 696 bp, Homo sapiens
  misc_feature: GYAE6OF02GPQPC.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcattaaagtttgggctgggtccgccacgcccccgagggaacggggctgggaggtggagttgggactgtctactcgtagtgggaccactattacgacgtccccgtccctacgaacgactcgactcggtgactctaacaactaaaacacgtaccaaacgaaacctaattcctcccgtagtacggctacgtaactcgtagtacggacccgtcgaccggaaccgaccggaaccgtaaattactttaccgtcgtagaccgaaggacggacgggtaccgttaaggtaacgtttacgttccgtttacggacctaaccggttcggggtaccgtacggggtaacccgttcgggtaccctacccggttccttacccgtaccgtaccgtccccgtacccggaacccgaacccgggggtaccctaccggttaccccggtttccccgttaccccgtacccccgg

SEQ ID NO: 290091 - DNA, 620 bp, Homo sapiens
  misc_feature: GYAE6OF02HZ7EM.45.38.D05.1.454.CMB.1.raw
  modified_base (404)..(404): a, c, t, g, unknown or other
  misc_feature (404)..(404): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatgcctgcactggaaccaacagtgattggttgggtagttttagttttgtctcctaggtacccaacaaccaccccggcgaacgaccccccaaacgtaactctaatttacgtagggaacctacgtaaggccggtccccgttcgggggtttaccaacggttccgtcctttcgtcgtggcctaccaagttctggcaacncggtcctccctagacctatctcgtcgggactccgaggctacgacggacgaggcgtagtattacttttctgttcgcttcattatgacgaggacagctacgtttgggtcggttcggacggtacggaccgtaggtcgaccgtcgtaggtcacgacccgaaggtcctccggtccccgtcgtccgtacctcgttcccgttcccgtcccttccctcgtcccg

SEQ ID NO: 290092 - DNA, 749 bp, Homo sapiens
  misc_feature: GYAE6OF02ITNDS.45.38.D05.1.454.CMB.1.raw
  modified_base (197)..(197): a, c, t, g, unknown or other
  misc_feature (197)..(197): n is a, c, g, or t
  modified_base (212)..(212): a, c, t, g, unknown or other
  misc_feature (212)..(212): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcgctccggatgcgtcctgtcccagctgcacctgcaggagtccgggcccaggactggtgaacgccttcgganaccccttgtcccctnacgttgcagtgtctcgtggtacacctccatcgagtagtagtcaatttaagtttgggcgtcggtccgccacgccccgaggggacgggcgtaggagtggagttgggactggtcttacctgtacggtacgggacctaccgttacttaaccgaccgtccccgtcccttacgaacgtaccgttacgaccgttagggttctattacctaactaaacgtaaaaccgaccgttaacctaaaacgtaacccttaacgtttccctacccgtaggtacgtactacgtaacctcgtcggtacgacccgaccggacgaaccgtacggaaccctaaaagttcttacgtcgtacgacgtaaaggacggacggtcgtaggtaactttacgttccgttacgtaaccgtcgggtacccggtacggtacccgggtaaccgttcggtaccgtaccccggttccgttcccgtaccgtacccgtaccccttacccgaaccggtaacccggtcccccgttaacggtttccccggttacccccgttcccccggtaacccgg

SEQ ID NO: 290093 - DNA, 758 bp, Homo sapiens
  misc_feature: GYAE6OF02JH1AD.45.38.D05.1.454.CMB.1.raw
  modified_base (260)..(260): a, c, t, g, unknown or other
  misc_feature (260)..(260): n is a, c, g, or t
tcagacgcgatcgacacgaccggtgctcgatttagtatctgatagttgggtttggggctttctgagagtcaccggacctcctgtgcagggaacatgaagcacctgtggttcctcctcctgctggtggcggctcccggatgcgtcctgtcccagctgtcaccttgcaggagtcgggcccaggtactggtgaacgtccgttacgggagaccccttggtccccctgacggttggcctaaggttcggtcggttctacgggttanaacctccatcgagtagtacggtcctaattaacgtttggggaccttgggtccgacccacgtcccccggtaaggggaacggggtccttaggggacgggtcggtagttacgggggtacctggttcgtaaccggtcttaagggtcgggaaccctaccgttagtttaaccgcggtaccccgtcccgtacgtaaacgaccgtccggtacgttcgggtggtaacttcctactaaaccgtaaaccgtaccggtaaccctaaacggtaacccttaagttaccccgtcctagtacggtacctacgtaaccttcgtacggtcgacccgtaccggccggaactacccggactaaagttcttacgtcgtacgacgaagtacggcggaacctggtaaacgttcgtaccgtttagaccgtacggtcggtaccgtaggtaacccgttgtccgtaaccgtcctacgtacgacgtcctacaccggacggccctaggtcccggtctccccggtacgg

SEQ ID NO: 290094 - DNA, 765 bp, Homo sapiens
  misc_feature: GYAE6OF02JSOV6.45.38.D05.1.454.CMB.1.raw
  modified_base (155)..(155): a, c, t, g, unknown or other
  misc_feature (155)..(155): n is a, c, g, or t
  modified_base (210)..(210): a, c, t, g, unknown or other
  misc_feature (210)..(210): n is a, c, g, or t
tcagacgcgatcgacacgaccggtgctcgatttagtatctgatagttgggtttgggggggtcacaagaggcagcgctctcgggacgtctccaccatggcctgggctctgctgctcctcactctctcactcaaggcacaggatcgtggccctttcngccctgactcgagcctgcctcgtgtctgggtctcctggacacgtcgatccaccgngtcggcctggcacgtcggaaaccaagtgtgagttggttagggtaatttttgtttgtccttaccgttcggtaacctaaacgacccgaccccgggtacgtaaacccggaccccctaaaattactaccgttaagtttaacgtaacggggactaacgtaacggcccgggtacccggtttacgggggttttacaaacggttccggtaccttttccgtcgttacggggtacctaccggtaagttcccgtgggtaccctaacggtaccggtcccgtaccgtaggaacctaaagttcccgtcgtacggggcctaccgacggcttacggaacggacgtacggtcttaggtacttttacgttcgtagttacgtacttcgtagttacgcgttacggacggacctaggtaccttgggttacggtcggtcgggacgggacggttaaccgtcgggttaccgtacggttccgtaggtaccgtacggtacccggtaaggttcccgtaccgtccccggttacggtaccttaccgttcccgtacccttacccggtacccttcggtcctaacgg

SEQ ID NO: 290095 - DNA, 629 bp, Homo sapiens
  misc_feature: GYAE6OF02HJ0KM.45.38.D05.1.454.CMB.1.raw
  modified_base (231)..(231): a, c, t, g, unknown or other
  misc_feature (231)..(231): n is a, c, g, or t
  modified_base (374)..(374): a, c, t, g, unknown or other
  misc_feature (374)..(374): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagcctttcggagacccctgtcccctcacttgcagtgtctctggtnactccatcagtagtagtcaattaaattttggggcttgggtcccgccacgcccccgaggggaaggggctggagtggagttgggactgtctactctaggtcggaccacctattacacgtcccgtccctcaacgactcgactggtnatctacaaataaacacgtaccaacgaaacctaattcctaccgtgacgtctagaactctgtcgaccgcgcgacacggacaaattactacgtgtgacaagagacgggcctagggtaactttacgttccttacgacctacggtcggggtacccgtacgggtaaccccgttggtaccgtacccggttcctcccttaccgacgtccccttacccgaccgaaccgggccccaacggttccggttcccttcccccgtaccgg

SEQ ID NO: 290096 - DNA, 763 bp, Homo sapiens
  misc_feature: GYAE6OF02GOAVN.45.38.D05.1.454.CMB.1.raw
  modified_base (160)..(160): a, c, t, g, unknown or other
  misc_feature (160)..(160): n is a, c, g, or t
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
tcagacgcgatcgacacgaccggtgctcgatttagtatctgatagttgggtttggggggggtcgtacgaagaggcagcgctctcgggacgtctccaccatggcctggctctgctgctcctcactctcctcactcaggacacaggatcgtgggccctttcngccctgactcagcctgcctcgtgctgggtctcctggactgtcgatcaacntcggcctgcactcggaaccaactgtnatggttaggtagttttagtttgtcttccgtggtacctaacgtaaccgtacccggcgtaaacgacccccctaaaacttacgtaccattttaacgacggacctaacgttaaccgccggtacccgtcggggtttcaacggttccgtactttcgtccttacgggtcctaccgtaacgtcgtaggtccaaacgaccggtccctaccctaggacctaacttacctcggttcgggacccttccggtaggaccgttacccggaacgggtaccggtacgggtacttacggacgttttaccgtttacgttcgttacggtcccttgttaactacttacggactacggggtaccgtaacgtccgtaacggtttgggttcggttaccgggtaccgggaacgggttaccgtacggttacggtacccgttacgtaccggttcgtaacgtcccgggtaaacggtccgttacccggtaccccggttcgtttacccgaccgtttccgtcccggttacccgtaccccgttcccttccggttacccg

SEQ ID NO: 290097 - DNA, 539 bp, Homo sapiens
  misc_feature: GYAE6OF02HES4O.45.38.D05.1.454.CMB.1.raw
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
  modified_base (387)..(387): a, c, t, g, unknown or other
  misc_feature (387)..(387): n is a, c, g, or t
  modified_base (415)..(415): a, c, t, g, unknown or other
  misc_feature (415)..(415): n is a, c, g, or t
  modified_base (536)..(536): a, c, t, g, unknown or other
  misc_feature (536)..(536): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcaccatggcctgcactggaaccaacagtgatgttggagttttagtttgtctcctggtaccaacaacaccccggcgaacgacccccaaactaatcatttataggacactaagcggccctcgggggttcaagtcgcttctctggctcagtctggcaacncggcctccngacaatctcnggctcngctcaggacgaggctgattattctgttncttcatagtgcagggaccagctacgttgggtgttcgggcggtagggacctagggttcgaccgtcgtaggtcagcccgaaggcctcgccccgtcgtcacgtctcgtccccgccttcccgttntcg

SEQ ID NO: 290098 - DNA, 647 bp, Homo sapiens
  misc_feature: GYAE6OF02GRNVB.45.38.D05.1.454.CMB.1.raw
  modified_base (229)..(229): a, c, t, g, unknown or other
  misc_feature (229)..(229): n is a, c, g, or t
  modified_base (537)..(537): a, c, t, g, unknown or other
  misc_feature (537)..(537): n is a, c, g, or t
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctcgtgtctgggtctccgtggacagtcgatcaccatggcctgcactaggaaccaangtgatggttagggtagtttttagtttgtccttccgtaggtaaccaacaaccgaccccggacgaacgaccccctaaaatatactaatttaagaggacaacgtaacggccggtacccggttcgggggtttacaacgttccgtctttcctcgtcggtacctaccgtaagtctagggaccaaacgaccggtccctacccgtagaacctaacttcctcgtacgggcctccgagtctacgaggacgagctagtaattcgtttctagttcgctagtatagtcgacgacggacagtctacggttggtcgttacggnggacgtacgtaggtccgaccgtcgtagtcacgtaccgaaggtccctaccggtccccgttggtacctacgtccgtttaccccgtaccccacccgttcccgtaccgtacccg

SEQ ID NO: 290099 - DNA, 831 bp, Homo sapiens
  misc_feature: GYAE6OF02ITG1O.45.38.D05.1.454.CMB.1.raw
  modified_base (307)..(307): a, c, t, g, unknown or other
  misc_feature (307)..(307): n is a, c, g, or t
tcagacgcgatcgacacgaccggtgctcgatttagtatctgatagttgggtttgggggactttcttgagagtcacggacctcctgtgcaggaacatagaagcaacctgtggttcctcctcctgctggtggcggctccggatcgcgtcctgtcccagctgcactgcaggagtcggccacggctggtcgaacgtccgttacggacgtacccgtcgtcccctctaccgttcgctagtcgtctcgtggtcgacctccgactcgtagtacggtacgtactaagttaaacggttttcgggcgttcgggtcccnccgacggacccccggaaggggaacggggtcgtcgggtaggtcggtaggttacgggtacgttacggttacttacggttaccgtacgggtacggaacccctaacgttacgttaacccgacccgtaccccgtaccttacgaaacggtaccgtccgtaaccgttgggtacgtaacgtcctaaacgtaaacgtaaaaccgtaccggtaaccaaaacgtaaacccgtaactttacccgtcccgtaggtacggtacctacgtaaacccgttcgtacggttaccggacccggtaccgaccgggaaccgtaaccgggaaaccctaaagtttaccgttacgtacggtacgtaacgaagtaccgggaacgggttaccttaaggttaaacgttacgttacccgttaacgaccgtaaccgggtggtacccgttagggtaccccgttaggtaccctaccggtcgttacccgagtaacccgtcccgtaacgaccggtaaccggtcccgttaaggttccccggtacccttacccgaccgg

SEQ ID NO: 290100 - DNA, 673 bp, Homo sapiens
  misc_feature: GYAE6OF02FN32G.45.38.D05.1.454.CMB.1.raw
  modified_base (433)..(433): a, c, t, g, unknown or other
  misc_feature (433)..(433): n is a, c, g, or t
tcagacgcgatcgacacgaccggtgctcgatttagtatctgatagttgggtttgggggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcaataaagttttggggcttgggtccgccacgccccgaggggaaggggtctggagtggattgggactgtctactctagtcggaccactattacacgcccgtcctacaacgctcgactggtgatctacaaactaaacacgtaccaaagaacctaatttctaccctgacgtctagaactctgtacgaccgcgcggacacggacaaatntactgtacgacaaggacggaggtcctagggtaacttacgttcctttacgacccgtacggttcggggtccgttacggggtaaccctgggtacccgtacccgttccgtacccgtacgaccgtcccgtaacccctaaccggaaccggggtccccctaagggtttcccccggttacccctttaccccccggtcggtacccctaccccccgttcccgtaacccgtaaacggtcccgtaaccccgg

SEQ ID NO: 290101 - DNA, 691 bp, Homo sapiens
  misc_feature: GYAE6OF02GXSB0.45.38.D05.1.454.CMB.1.raw
tcagacgcgatcgacacgaccggtgctcgatttagtatctgatagttgggtttgggggggggtcacaagaggcagcgctctcgggacgtctccaccatggcctgggctctgctgctcctcactctcctcactcaggacacaggtcctgggcccagtctgccctgactcagcctgccctccgtgtcgtgggtctccgtaggacagtcgatcaccatcctcctgcactggaaccagcagtgagttcggttagggaagttactaacttgtcttccgtacggtaaccaacacgaccacccgaaggaccaaaccgacccccaaaatcgaatacgtaatttagaggacggacaacggttaagcccggtaccctaggttaacggggttttacaacgtcgtccttcgtacgtggtcctaccgaagttcgtacggactaacccgtcgtacccttccgtaacaacgttaactccgttaccggtcgggtaccgttacccggtacgtccggttacgggaacgggacggacggtacgttagtaacgttttacgttaacgtcgggtcttacgtacgtaacttacgttagtccgaggtaaggttaacgttagttaccgtttgggtacgttcgggagggtacggacgtacgtcgtacgtaccgtacgtacgtcgtacgaccgtacgccgtacctcccgtccgtaccg

SEQ ID NO: 290102 - DNA, 703 bp, Homo sapiens
  misc_feature: GYAE6OF02IPD2X.45.38.D05.1.454.CMB.1.raw
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctccgtggacagtcgatcaccatcggcctgcactggaaccaacagtgatgttggtagttttagtttgtctcctggtacccaacgaaccaccccggtacgaacgacccccaaactaactctaatttacgaggacaactaagccggtcccgttcggggttacaagtcgtcttcgtactggctcctaagtctggtaccaacgtaccggtccctaccctcggaaaccctattcccgtcgttgggacccttaccgaacgtacgtacggaacgaacggacggctagtatttaacttacgtcgacagtacaacgtataattaatttacgttcgtttaccgtaacgttcgggttaagtttccgggacggtacgggtaaccgtaaggttaccggtacccgttaccggtttacggaccgtaccgacccggaaacggtccgtacccggttacccccgtcggtacccttacccgttaccgtttcccgtttaccccccgtacccgtttccccgtccgttacgtacccg

SEQ ID NO: 290103 - DNA, 641 bp, Homo sapiens
  misc_feature: GYAE6OF02HQHFK.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtgcggctcccggatgcgtcctgtcccagctgcacctgcaggagtcgggcccagggactggtgaagccttcggagaccctgtccctcacttgcagtgtactcctggtcgactccatcagtacgtagtcataaagttttggggctgggtccgccacgccccgagggaacgggctggacgtggatgggactgtctactctagtggaccacgtattacacgccgtccctacacgactcgactggtcatctcaactaacacgtacaagaaccattctccgtagacggtctacgacttctggtcgacccggccgtacggaacaccggaccaaattacgttactcgtgacaagaggacgggtaccgtaggtacttagttccctttcggacccgtacggttacggggccgttacggggaaccccgttgggttacccgtaacccggtcgttacccgtcgaccgttacccctaccgaaccccggaaggggccccctaaggttcccgggttccctacccccgttccggg

SEQ ID NO: 290104 - DNA, 691 bp, Homo sapiens
  misc_feature: GYAE6OF02HBNJ5.45.38.D05.1.454.CMB.1.raw
  modified_base (155)..(155): a, c, t, g, unknown or other
  misc_feature (155)..(155): n is a, c, g, or t
  modified_base (232)..(232): a, c, t, g, unknown or other
  misc_feature (232)..(232): n is a, c, g, or t
  modified_base (338)..(338): a, c, t, g, unknown or other
  misc_feature (338)..(338): n is a, c, g, or t
tcagacgcgatcgacacgaccggtgctcgatttagtatctgatagttgggtttgggggtctacaagaggcagcgctctcgggacgtctccaccatggcctgggctctgctgctcctcactctcctcactcaggacacaggatcgtgggccctttntcgccctgactcagcctgcctccgtgtctgggtctcgtggacagtcgatccacagtcggcctgccactggaaccaangtgatggttgggtattttgtttgtctctggtacacaacgaccgcgacgaccccaactatctattataggacactaacgcggtcccgtcggggttcaacgtctcttntcgtgtctaccgacgtctggactaacaccggtcctacccgtgacctaaactccgttcgtacgggctaccgaggtccgtcgaacgggacgacgggtaccgtcggttaatttaacgttttacgttcgtttcgccgttacgtaacttagttcgacggttacggaaccgtcgacgttacgttacggggttccggtttcggggacggtaccgggtaacgtacggttcccggtaccgtaccgttacgggtcaaccgggtaccccggaaccgggtccgtacccgggtcccccggttaccggtcccgtaacgttcccggttcccgttacccccgtaccccgttaccctcccggttacccgg

SEQ ID NO: 290105 - DNA, 682 bp, Homo sapiens
  misc_feature: GYAE6OF02JKCYM.45.38.D05.1.454.CMB.1.raw
  modified_base (259)..(259): a, c, t, g, unknown or other
  misc_feature (259)..(259): n is a, c, g, or t
tcagacgcgatcgacacgaccggtgctcgatttagtatctgatagttgggtttgggggacctcctgtgcaggaacatgaagcacctgtggttcctcctcctgctggtggcggctcccggatgcgtcctgtcccagctgcacctgcaggagtcggacccaggactggtgaagccttcggagaccctgtccctcacttgcagtgtctctggtgacctccatcagttagtagtcaattaaagttttgggggctcggggtccnccacgcccccgaggggaagggggctgggtagtggagttaggggacttggtcctactctaggtgggaccactattacacgcccgtcctcaagctacgactggtgatctacaaactaacacgtaccaagaaccaacttctacccgtagacggctagactctacgcgaccgcccgacggaacgaccggaccaaattacttacgtgtagacaaggtagcgggtacctgggtaattacttacctttacggacccacgggttacggggccgtacgggtaacccgtcgggtacctacccgtacttccgaccgtacgcccctaccgaacccgtaacccgggtacctacggttccccgggttaccccgtttccccggtccggtaccccgtaccccccgttacctaccccggtacggtaacccgtaccccggg

SEQ ID NO: 290106 - DNA, 670 bp, Homo sapiens
  misc_feature: GYAE6OF02ITR1H.45.38.D05.1.454.CMB.1.raw
tcagacgcgatcgacacgaccggtgctcgatttagtatctgatagttgggtttgggggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcaattaaagttttggggctgggtccgccgacgccccgaggggaaggggcgtggagtggagttgggactgtctactctagtggaccactattacagcccgtcctcaagactcgactgtgatctacaataaacacgtaccaaagaacctaatttcctaccctagaggctagtaactacgtcgtacgacccggtccgaccggacgaaccggaccaaagttacttactggtgacgaaagacggacgggcctaggtaactttacttaccgtttagaaccgtacggttacgggggtccgtacggggtaacccgttcgggtacccttaacccggtccttcccgtaccgacgtcccttaccgaacccgtaaccgggacccctacggtccccggttaccctttcccccgtacggaccctaccccgttccctaacccgaacggactacccgg

SEQ ID NO: 290107 - DNA, 826 bp, Homo sapiens
  misc_feature: GYAE6OF02G2WFG.45.38.D05.1.454.CMB.1.raw
  modified_base (158)..(158): a, c, t, g, unknown or other
  misc_feature (158)..(158): n is a, c, g, or t
  modified_base (207)..(207): a, c, t, g, unknown or other
  misc_feature (207)..(207): n is a, c, g, or t
  modified_base (226)..(226): a, c, t, g, unknown or other
  misc_feature (226)..(226): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttcngccctgactcagcctgcctcgtgtctggtctcctggacagtcgatcacntggctgcacgtggaaccanagtgagtggttgggtatttttagtttgttctccgttcggtaaccaacgtaaccgaccccggacgaaccgaccccccaaaagtaactactaactttaagtacgggaactaacgtaacgccgggtacccgtttcgggggttacaacgttccgtcgtttccgtccgtcggcctaccgtaagtccgttacggacctaaaccgtccggtccctttaccccgtacgaacctaaacgttcccgttccggtacgggtcccgtttccgacgggtacctaccggaacggtaacccggtagggttccgtagttaacgttttacttttccgttaggtttcgtaccgttataaacgtttacgttacgaccgggttaacggaacccgtggttaaccgttcgggtttacggggtttcggggttacccgggtaccggggttaccggggacccggtttacggggttacccgtacccgggtttacctacgggggttacccgaccggaccccggtaaaccgggttccgttaccccggtacccccggtttacggttacccgtacctttacccggttaccccggttccccccggtttacccgttacctccgggttacccgg

SEQ ID NO: 290108 - DNA, 732 bp, Homo sapiens
  misc_feature: GYAE6OF02FW5F0.45.38.D05.1.454.CMB.1.raw
  modified_base (256)..(256): a, c, t, g, unknown or other
  misc_feature (256)..(256): n is a, c, g, or t
tcagacgcgatcgacacgaccggtgctcgatttagtatctgatagttgggtttgggggacctctgtgcaggaacatgaagcacctgtggttcctcctcctgctggtggcggctcccggatgcgtcctgtcccagctgcacctgcaggagtcgggccaggactggtgaacgtccttcggacgacccttgtccctcacttgcagtgtctcgtggtgactccatcagtagtagtcaattaagttttgggctagggtccnccacgaccccgaggggaacgggcgtggaggtcggagttcgggactcgtcttacgtcgttaggtcgggacctaccttacttacgaccgccccgttccctacgaacgtacctcgacgttggtacgtacttcgtacaaaactaaaccgaccgtaacccgaaacgtaaaccctaactttaccctacccgtaggacggtcctaacgtaccgttcgttacggtacggacccggtccggaccggaacgaaccgggtaacctaaatttacgttacgtggttacgacgaaaggacgggtacggccgttaggtaacttacttccgtttacgaccgtacggtaccgggtccgtacgggaacccgttcggtacctaccgtcctacctccgaccgtccctaccgaccggtaaccggcccgtaacgttcccggttcccttaccccgcgtacccctaccccttacccgtacccgaacgtccctaaccccgg

SEQ ID NO: 290109 - DNA, 687 bp, Homo sapiens
  misc_feature: GYAE6OF02J0C8I.45.38.D05.1.454.CMB.1.raw
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
  modified_base (410)..(410): a, c, t, g, unknown or other
  misc_feature (410)..(410): n is a, c, g, or t
  modified_base (465)..(465): a, c, t, g, unknown or other
  misc_feature (465)..(465): n is a, c, g, or t
tcagacgcgatcgacacgaccggtgctcgatttagtatctgatagttgggtttgggggctttctgagagtcacggacctcctgtgcaggaacatgaagcactgtggttcctctcctgctggtgcgctccggatgctctgtcccagctgcacctggcaggcgtcggcccaggactgggtgaacgtcctttcgggatacccctgtccctcactttggccagttcgtntctagggtnacctccattccgagttagtatcaagtttaagtttgggcttggtccgacaccggccccgaggggaacgggtcgtgggaggtaggtaattcggggactggtaccttactcgtaaggtcggaacctaccgtaattacgacgtccccgtcctagaacgacctcgacgtgtacagtcctanaactaacacgtaccaaagaacttaacgtctacccgtagtacggactagaaccttntacgtacggacccgaccgtacggaacgtaccggaacctaaagttacttaccgtgtacgacgaaagtacggaggaccgttagaagttttactcgttaacgaccgtacggtacgggccttaacgggtaccgttcgacctaccggttcctacttccaaccggtccctacccggttaaccgaccgggtaccctacggtttacccggttccctaccccggttaccgg

SEQ ID NO: 290110 - DNA, 696 bp, Homo sapiens
  misc_feature: GYAE6OF02IFVEY.45.38.D05.1.454.CMB.1.raw
  modified_base (141)..(141): a, c, t, g, unknown or other
  misc_feature (141)..(141): n is a, c, g, or t
  modified_base (201)..(201): a, c, t, g, unknown or other
  misc_feature (201)..(201): n is a, c, g, or t
  modified_base (237)..(237): a, c, t, g, unknown or other
  misc_feature (237)..(237): n is a, c, g, or t
  modified_base (487)..(487): a, c, t, g, unknown or other
  misc_feature (487)..(487): n is a, c, g, or t
tcagacgcgatcgacacgaccggtgctcgatttagtatctgatagttaggtttggggggtcacaagaggcagcgctctcgggacgtctccaccatggcctgggctctgctgctcctcactctcctcactcaggacacaggntcggtcgggtccctttctcgccctgactcagcctgcctcgtgtcgtggtcctcgtggacngtcgatcaccgatcggctgcacgtacggaaccaacnggtagtagttggttgggttagtttttagtttcgtcgttccgtacggtaaccaacgtaacccgaccccggacgaacccgaaccccctaaacttaactacttacgtttagtaacgggtacctaacgtaacggccggtcccggttacgggttacgaacgttcgtcctttacgtcgtcgtcgtacctagtcgtcgacaacgtccggctccgtagactactcgtcgcggtcctacgcgcgtacgacggtaccggngtcctagttactttacgtttcgtcgttcgacttacgtagtacgtcggacgtacgggactacgtacgttacgggtttagggtacggtccgggacgggtacgtaccggtaggttccgtaaccgtcgttacgcgaccgtccggaacgtcccgtcccggtcccgtaccgttcgtacccttccgttcccgttcccgccgttccccgtcgtccgg

SEQ ID NO: 290111 - DNA, 683 bp, Homo sapiens
  misc_feature: GYAE6OF02HUXCJ.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagacccctgtccctcacttgcagtgtctctggtcgactccatcagtagtagtctaattaaagtttggggctcggggtccgcctacggacccccgaaggggaacggggcgtagggagtgggtagttgggacttcgtcgtactcgtaggtcgggacctacctaacttacacgtcccgtcccactaacgactcgacgtggtagatctacaaactaaacacgtaccaaagaacctaattcctacctggacgtctacgtaactcgtacgtcgacccgcggaccggtaacaccggaactaaagttacttacgtacgtagacgaaggagggacgggtccgtaggtaactttacgttacctttacggaaccgtcgggttacggggaccggttaccgggtaaccgttccgggtaccctacccggtttcctccgttaccgaccgtccctacccgaaccggtaaccgggtacccttaccggttcccgttacccccgg

SEQ ID NO: 290112 - DNA, 642 bp, Homo sapiens
  misc_feature: GYAE6OF02HMW34.45.38.D05.1.454.CMB.1.raw
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
tcagacgcgatcgacacgaccggtgctcgatttagtatctgatagttgggtttgggggggggtcacaagaggcagcgctctcgggacgtctccaccatggcctgggctctgctgctcctcactctcctcactcaggacacaggatcgtgggccctttctgccctgactcagcctgcctccgtgtctgggtctctggacngtcgatcacatggcctgcactggaaccaanagtgatgttgggtagtttttagtttgtctctggtaccaacaaccaccccggacgaacgacccccaaactatctatttagaggacaacgtaaggccggtcccgtcggggtttcaacggtcgctttctcgtggctaccgagtctggacaacgccggtcctcccgtagactactctcgtgggcctcgcgctacgacggacgagctagtatttacgtttcttgttcgcttctattagtcggacgacgggaccagtaccgtacggtttggggtcggtttccggggacgggtacgggaccgttagggttccgaaccggttcgtacgggtccacggacccggaaggccgtccggtcccccgttcggtacccgtaccttcccggtcccggtttcccccgtcccgttccctcccgtacccgg

SEQ ID NO: 290113 - DNA, 612 bp, Homo sapiens
  misc_feature: GYAE6OF02FHX38.45.38.D05.1.454.CMB.1.raw
  modified_base (345)..(345): a, c, t, g, unknown or other
  misc_feature (345)..(345): n is a, c, g, or t
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
tcagacgcgatcgacacgaccggtgctcgatttagtatctgatagttgggtttgggggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaattttggggctgggtccgccacgccccgagggaaggggctggagtggattgggactgtctactctagtcgggaccacctattacagcccgtccctcaagactcgactgggtnatctacaactaaacaccgtccaacgaaccaatttcctacctgagctcgaactctgtcgaccgccgcggacaccggaccaaatnttacgngtcgcaaggagacgggcctaggaacttacgtcctttagacccacggtcggggcccttaggggaaccccttggtacccaccgttcctcctacgacgtccctaccacccggaaacgggccccaacgtccgtccctttcccccgcggtcccacccccgtccctacccgaagaccgtacccg

SEQ ID NO: 290114 - DNA, 716 bp, Homo sapiens
  misc_feature: GYAE6OF02HA5VG.45.38.D05.1.454.CMB.1.raw
  modified_base (262)..(262): a, c, t, g, unknown or other
  misc_feature (262)..(262): n is a, c, g, or t
  modified_base (712)..(712): a, c, t, g, unknown or other
  misc_feature (712)..(712): n is a, c, g, or t
tcagacgcgatcgacacgaccggtgctcgatttagtatctgatagttgggtttgggtttagaacctatgaacattctgtaggggccactgtcttctccacggtgctccctttctgccctgactcagcctgcctccgtgtctgggtctcctggacagtcgatcaccatggcctgcactggaaccaacagtgatgttgggtagtttttagtttgtctcctggtaccaacaacaccccggcgaacgcccccaaatcatgatttanggagggcagtaagcggccctgaggggtttcaatcgcttctctggctcaagtctggacaacacggcctcctgacaatctcgtgggctccgaggctaggacggacgaggtctaggtatttattacgtgctgcttacattagtcgacgtaagggttacgtaaggtttacggttttgggttacgggtttcggggacgggtaaggggaaccctaagggtcccgtacggttaaccccggttacccgttaacggggttaccgaaccggtacccccggtaaacgggccgttaccccggccccccgtttcggtaccccgtaaccgttccgttacccggtttacccccctaccccgtttcccgttcccgttacccggtacgtttcccggtacccgtttcgtaccgggacgggttcccgggacgttcgggaccgaacggggtcccgtacgtaacggtacgntacg

SEQ ID NO: 290115 - DNA, 714 bp, Homo sapiens
  misc_feature: GYAE6OF02IM2LE.45.38.D05.1.454.CMB.1.raw
  modified_base (269)..(269): a, c, t, g, unknown or other
  misc_feature (269)..(269): n is a, c, g, or t
tcagacgcgatcgacacgaccggtgctcgatttagtatctgatagttgggtttgggggctttctgagagtcacggacctcctgtgcaggaacatgaagcacctgtggttcctctcctgctggtggcggctccggatgcgtcctgtcccagctgcacctgcaggagtcgggcccaggactggtgaagccttcggacgaccctgtccctcacttgcagtgtctcgtggtcactcatcagtagtagtctaattaagtttgggctcgggtccnccgacgccccgaggggaacgggcgtggacgtggtagttcgggactgtctacgtcgtaggtcggacctactagttaccgacgtccccgtcctacgaacgtactcgacgttggtacacttctactaaactaaaccgtaccgtaaccgaaacgtaacctaacgttccctccgtaggtacggtaccgtacgtaaaccttcgttacgtaccggacccggccggaaccggtaaccgaaccggtaaccttaaagttacgtttacgtacggtacgaacgtaacggacgggtaacgggtaccgttaaggtaactttacgttccgtttacgacccgttacgggtccgggtacccgtacgggtaacccgttcggtacctacccgtccgtaccctcgtaccgtcccgacccgtaccggtaaccggcccttacggtcccgttcccgtacccgtcccgg

SEQ ID NO: 290116 - DNA, 674 bp, Homo sapiens
  misc_feature: GYAE6OF02JJ4IJ.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgccagtgtctctggtgactccatcagtagtagtcaagttaagtttggggctgggtccgcctacgcccccaggggaagggctggagtggattgggactgtctactcgtagtggaccactatacacgcccgtcctcaagactcgactggtgatctacaataaacacgtaccaaacgtaacctaacttcctaccctgacggtctacgaaaccttctcggtacggacccgaccggtacggaccgaccgggtaacctaaagttacgtttacctaggtcgacaaggtacggacgggccttagggaacttttacgtcccgtttagaccctacggtcggggtacccgtacggggaaccccgttcggtacccgtacccggttccgttacccgtacgacccgtacccgttacccgaacccgaaccgggtaccccttaacggtccccggttacccttccccccggtacccgg

SEQ ID NO: 290117 - DNA, 808 bp, Homo sapiens
  misc_feature: GYAE6OF02JFTXV.45.38.D05.1.454.CMB.1.raw
  modified_base (158)..(158): a, c, t, g, unknown or other
  misc_feature (158)..(158): n is a, c, g, or t
  modified_base (779)..(779): a, c, t, g, unknown or other
  misc_feature (779)..(779): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttcngccctgactcagcctgccctccgtgtctgggtctccgtggacagtcgatccaccatcggcctgccacgtggaaaccaagacgtgagttggttgggtagtttttagttttgtctccgttggtaaccaaacaccgtaccccggcgaaccgacccccaaactaacgtctaagtttaagtacggtacaacgtaacggccggtcccgttacgggggtttcaaacggttccgtcctttaccgtcgttcggtaccgttaccgaacgttccggttacggacctaaaccggtaccggtacccgttacccgtaacggtaacctaaacgttccgttccgtaccggggtacccttacccggtaacggtccgttaacggaacgggtaccggaggttccgtacgttactttaacgtttcgttcgttcgtctacgtattacgtcggaccgtacgggaccagtacgttacggttcgggttacggtccggggtaaccgggtacgggtaccgttaaggggttcccgtaaccggtttaccgtacggtaccgacccggtacccggtaaaggtcccgttaccccgggtacccccggttaccggttaacccttcccggttacccgtttccccggttacccccnccccggtttacccgttccccgtaacccgg

SEQ ID NO: 290118 - DNA, 574 bp, Homo sapiens
  misc_feature: GYAE6OF02GK24J.45.38.D05.1.454.CMB.1.raw
  modified_base (226)..(226): a, c, t, g, unknown or other
  misc_feature (226)..(226): n is a, c, g, or t
  modified_base (257)..(257): a, c, t, g, unknown or other
  misc_feature (257)..(257): n is a, c, g, or t
  modified_base (266)..(266): a, c, t, g, unknown or other
  misc_feature (266)..(266): n is a, c, g, or t
  modified_base (298)..(298): a, c, t, g, unknown or other
  misc_feature (298)..(298): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (437)..(437): a, c, t, g, unknown or other
  misc_feature (437)..(437): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggcacagggtcctgggcccagtctgccctgactcagcctgcctccgtgtctgggtctcctggacagtcgatcaccatctctgcactggaaccngcagtgatgtggagttataaccttgtctccngtaccaacngcaccaggcaaagccccaaactcatgtattanggaggcagtagccggcctcgtaggggtttctaagttcgtttactcgtgctcaagtcgtgcacncgcctccngacatctacgtcggctccgnggtcnggacggacgtaggtctacgtattactacgtgtctcgtctacgnttagcgtacgtagggtttagtacgttacgtttggtcggttacgggcgggttaacggaccgaggtcctacggtaccggttaccgttacggtctaaccggcccgtacggccttcccggaccccgttcggtacttacccg

SEQ ID NO: 290119 - DNA, 802 bp, Homo sapiens
  misc_feature: GYAE6OF02H0HKT.45.38.D05.1.454.CMB.1.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctccgtggacagtcgatcaccatgacctgcactaggaaccaacgagtgatggttgggtagttttagtttgtcttcctggtaccaacaaccaccccggacgaacgacccccaaataactactaatttagtaagggaacaacgtaaacgccggtcccgtagggggtttaccaacggtcgtcgttctacgtggacctaccgaaagttctcgggacaaaccgaccgggtccctacccgtagaacctaacgttcttccgtggggaccttcccgaagggtacctcggaacggaaccggtaacgggtcgttacggttaaattttacgttttaccgttcggtttacgaccgtttacctaaagtttacgttacggaccggtaacggggtaaccctaaacggtccgttaaccgggtttgggggttaccgggttttacccgggggacgggtaacgggggtaaccgtaaggggtttaccggtaaccccgggttaccgttaacgggtccgtaacccgggaaccctaaaccggggtcccttaacccgggtccccccgttacgggttccctaaccgttcccgttccgtttaccccccctaaccccgtttcccgttaccgttaacccgg

SEQ ID NO: 290120 - DNA, 748 bp, Homo sapiens
  misc_feature: GYAE6OF02INNIL.45.38.D05.1.454.CMB.1.raw
  modified_base (511)..(511): a, c, t, g, unknown or other
  misc_feature (511)..(511): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtccgggcccaggacgtggtgaacgccgttcggacgtaccctgtcccctctacttgctagtgtcttcgtggtcgtactccgactctagtacgtagtctaagttaaagtttgggcgttcgggtcccgccgtacgacccccgaggggaacgggcgtggaggtaggtacgttcgggacgtcggttactacgtacgtaggtacgggaacccttaaccgttaacgttaccgaccggtaccccgttccctactaaacggtacctacggtacgtgggtacgtagttccgtaacgaacttaaaaccgtacgtaaccaaacgtaaacctaaacttccgtacccgtgtaccggtnttaaccgacttcgagtaacggaaccgccgaacggaaccaaccggtaacttaaagtacgtttacgacgtacgaacgtaaggtacggacgggtacctaagggtaactttagtccgtttacgaaccgttacggtcgggtaccttaccgggaaccgttcgggtacctccggtccgtacctcgccgtacccgtacccgaacggtaccggtcctaccggttccgttccccgttacccgtaccg

SEQ ID NO: 290121 - DNA, 585 bp, Homo sapiens
  misc_feature: GYAE6OF02HWW8L.45.38.D05.1.454.CMB.1.raw
  modified_base (263)..(263): a, c, t, g, unknown or other
  misc_feature (263)..(263): n is a, c, g, or t
  modified_base (578)..(578): a, c, t, g, unknown or other
  misc_feature (578)..(578): n is a, c, g, or t
  modified_base (580)..(580): a, c, t, g, unknown or other
  misc_feature (580)..(580): n is a, c, g, or t
  modified_base (583)..(585): a, c, t, g, unknown or other
  misc_feature (583)..(585): n is a, c, g, or t
tcagacgcgatcgacacgaccggtgctcgatttagtatctgatagttgggtttgggtttagaacctatgaacattctgtaggggccactgtcttctccacggtgctccctttctgccctgactcagcctgcctccgtgtctgggtctcctggacagtcgatcaccatggcctgcactggaaccaacagtgatgttgggagtttttagttttgtctcctggtaccaacaacaccccggcgaacgcccccaaaataatcatttanagggacactaagcggccctcgggggtttcaagtcgcttctctggctccaagtctggacacacggcctcctgacaatctcgtcggctccgaggctcgaggacgaggctgtatttattctgtttcgctcatatgacgacgggacagctagtttgggtgttcgggcggagggacctagggtcgaccgtcgtaggtcacggacccgaaggtcctcggccccgtggtaccaccgttccgttccgttccccgtcccttccgtcctccggtactccgccgttctggacggtcgggcgtcggaccgaacggcgacgagtacgnangtnnn

SEQ ID NO: 290122 - DNA, 703 bp, Homo sapiens
  misc_feature: GYAE6OF02G3MBT.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcattaatttgggctgggtccgccacgcccccgaggggaacgggcgtaggagtggagttgggactgtctacgtcgtagtcgggacctacctattacgacgtcccgtaccctacaacgtctcgactgtgatctacaactaacacgtacaagaaccaattcctacctagacgcttacgtaacctcgtcggtcgacccggtccggccggaaccgaaccggacctaaacgttaactttacgtacggttacggacgtaaaggaacgggacgggtaccggttaacggtaagttttaccgttccgttttacgaacccgttaacggttcggggtacccgttaccggggtaaccccgttagggttacccgtacccggttccctacccgtaccgtaccgtaccccgtacccgtacccggaaccgggtcccctaaccggttcccggttaccccgttaccccccgtccggg

SEQ ID NO: 290123 - DNA, 604 bp, Homo sapiens
  misc_feature: GYAE6OF02F860W.45.38.D05.1.454.CMB.1.raw
  modified_base (421)..(421): a, c, t, g, unknown or other
  misc_feature (421)..(421): n is a, c, g, or t
  modified_base (456)..(456): a, c, t, g, unknown or other
  misc_feature (456)..(456): n is a, c, g, or t
  modified_base (467)..(467): a, c, t, g, unknown or other
  misc_feature (467)..(467): n is a, c, g, or t
  modified_base (539)..(539): a, c, t, g, unknown or other
  misc_feature (539)..(539): n is a, c, g, or t
  modified_base (569)..(569): a, c, t, g, unknown or other
  misc_feature (569)..(569): n is a, c, g, or t
  modified_base (590)..(590): a, c, t, g, unknown or other
  misc_feature (590)..(590): n is a, c, g, or t
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctccgtggacagtcgatcaccatggcctgcactggaaccaacagtgatggttgggtagttttagtttgctccgtggtacaccaacacccgccgacgacccaaccaatacattatagtacgactaagacggcccggtacgggtttcggtaacgtcgtacttcttctggtctcctacgtacgtcgtacgacaccggccgtccctacgtacaactactcgtcggtccgtccacgtcncctaggggaacgtcgcgtacgtagttaacttttcnggttgcctacngtaactgccgacgggaaccaggctacgtggggttagtcggcgggaacggagtacgtcggacctcgtacggtnacgaccgtaacgcgtcctcccccggtcgtntcttaccgtccggttaccccnccctcgtctaccgg

SEQ ID NO: 290124 - DNA, 683 bp, Homo sapiens
  misc_feature: GYAE6OF02JNWWR.45.38.D05.1.454.CMB.1.raw
  modified_base (229)..(229): a, c, t, g, unknown or other
  misc_feature (229)..(229): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtccagctgcacctgcaggagtcggccaggactggtgaagccttcggagtaccctgtccctcgacttgctagtgtctcgtggtnactccatcagtagtagtcaattaaagtttgggctcgggtccgccgacgaccccgaggggaacgggcgtggagtggtacgttgggactgtctactcgtaggtcggaccacgttactacgcgtccccgtcctagaacgtactcgacgtggtacgtatctacaaactaacgaccgtacaaacgaacctaattcctccgtagacggctacgaccttcgtcgtacgacccggtccgacggtaaccgaacggacctaaagttcgtttacgtggtacgacgaaagcggaacgggtccgtaggttaaactttcgttacccgttaggtaacccctacggggtacgggttacccgacggggttaaccctcgggtaccacccggtttccgtacctacggacccgttccacccggtaacccgaacgggttcccaccggtttcccggttacccttcccccgtacggg

SEQ ID NO: 290125 - DNA, 682 bp, Homo sapiens
  misc_feature: GYAE6OF02F23E8.45.38.D05.1.454.CMB.1.raw
  modified_base (298)..(298): a, c, t, g, unknown or other
  misc_feature (298)..(298): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgacctccatctagtagtagtcattaaagtttggggctgggtccgccagcccccaggggaacgggctggngtggagttggactgtctactctagtgggaccacctattacacgccccgtcctcgaacactcgactggtgatctacaataaacacgtaccaacgaacctaacttcctccctgacgcgtagaaccttctacggtcgaacccgccggacccggaccgaaccgggaccaaaagttacttaaccgttgtacgaccgaaaggtagggaccgggtaccgtagggtaaactttacgttaccgtttacgtaacccgtacgggttacggggcccggtttaccggggaacccgttcgggtacccggtaacccgttcccgttaccctaccgaccggttacccgtaccccgaaacccggtacccgggtaccccgttaccgtcccggtttaccccccg

SEQ ID NO: 290126 - DNA, 720 bp, Homo sapiens
  misc_feature: GYAE6OF02GD6HV.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctcgtggtgactccatcagtagtagtcaattaaagtttggggctgggtccgccacgcccccgaggggaacggggctggaggtggattggggactggtctactcgtaggtcgggaaccaccttattacgacgtccccgttccctcaacgtactcgacgttggtagactcctactaaacgtaaaacctaccgtaaccgaaaacgaaaccctaaatttcccgtacccgtaggacgggtaccttacggtaaccttccgtaggtccgaaccccggtccggaccgggaaccacccgggacctaaattacgttacttggtacgaccgaaggacggacgggtccgttagggtaaactttacgttcccttaggaccctacggtcggggtacccttaccggggtaacccttgggtacccgtaccggttccgtcccgtacctaccgtccctaacccggtacccgaacggggtcccctaacggtttcccggttcccgttacccccgtcccgg

SEQ ID NO: 290127 - DNA, 660 bp, Homo sapiens
  misc_feature: GYAE6OF02FLII1.45.38.D05.1.454.CMB.1.raw
  modified_base (228)..(228): a, c, t, g, unknown or other
  misc_feature (228)..(228): n is a, c, g, or t
  modified_base (306)..(306): a, c, t, g, unknown or other
  misc_feature (306)..(306): n is a, c, g, or t
  modified_base (456)..(456): a, c, t, g, unknown or other
  misc_feature (456)..(456): n is a, c, g, or t
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcacatggcctgcactggaaccaanagtgattggttgggatttttagttttgtctcctaggtaccaacaaccaccccggcgaacgaccccaaactatcattanaggacactaagcggcccgtcggggtttacagtcgtcttctcgtggctccaagtctcggacacgtaccggcctccctagactaactctcgtcgggcctccgaggctacgaggacgaggcttaggtatttactttcgtggtttacgccttanacgttagtcgaccgaacggggtaaccaggaccttacgggtttcggggtcggtttccgggacgggacgggttacccgtagggtttaccgaccgtttccgtacggtcgaaccggtacccgtaacgggtcctcccgggtaccccgttccggtaccttaccgttcccgttacccgttcccccgtacccctttcccggtccgtacccgg

SEQ ID NO: 290128 - DNA, 810 bp, Homo sapiens
  misc_feature: GYAE6OF02IEZRA.45.38.D05.1.454.CMB.1.raw
  modified_base (164)..(164): a, c, t, g, unknown or other
  misc_feature (164)..(164): n is a, c, g, or t
tcagacgcgatcgacacgaccggtgctcgatttagtatctgatagttgggtttgggggggtcacaagaggcagcgctctcgggacgtctccaccatggcctgggctctgctgctcctcactctcctcactcaggacacgaggtactcggtcgggtcccttttcncgccccgtagacctcagtccctgcccttccgtgtccgtgggtccctacctggacctagtcgactccacctagtcggtcctaggcctacggtacggaaacccagtaggttgacgtttaggggtttcggggttaattttttcgtttcgttcccgttacgtacggtaaccaaccgtaacccggaccccggtacgaaacccgtacccccctaaaattacttaacccgttaagttttaacgacgggtaacctaaccggtaacggcccggttacccgggtttccgggttaacaaccggttcgtctttacgtcgtcggtacctaaccgtaagttcccggacggaacaacccggtaccgtcccgttacccgtagtaaacctacgttccgtccggtacggccctcgtaacggtccgtacgacggtacgacggtactagttacttacgtttcgtacgttcgtcctactagtacgtaccgtacgacggtccaacggttcgtcggttacggttcgggttaccgggacgggtaccgggtacgtcggttaccggttaccgtccggtacgtccgaccggtccggtaaccgtcccgtaccgtcccccgtcgtacccgtaccgttccgttccggttacccccgtccgttacccgtcgtcccgg

SEQ ID NO: 290129 - DNA, 607 bp, Homo sapiens
  misc_feature: GYAE6OF02F0M87.45.38.D05.1.454.CMB.1.raw
  modified_base (228)..(228): a, c, t, g, unknown or other
  misc_feature (228)..(228): n is a, c, g, or t
  modified_base (368)..(368): a, c, t, g, unknown or other
  misc_feature (368)..(368): n is a, c, g, or t
  modified_base (382)..(382): a, c, t, g, unknown or other
  misc_feature (382)..(382): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtnactcatcagtagtagtcaattaaagttttgggctgggtccgccgacggcccccgaaggggaacggggctgggagtggattgggactgtctacgtcgtagtcggacctactatacagcccgtcctacaagctcgactggtnatctacaataaacncgtacaagaacctaattctaccctggacgtactagaacttcgtcgtcggacccgccgaccggaaccgacggaacctaaacttactttacgtgtacgacaaaggacggacggtctaggtattacgttccttgacctcggtcggccgtcggacccgttcggtccaccgtctcctacgaccgtcccgacacccggaacggtcccacgtcccggttcccttccccgtcg

SEQ ID NO: 290130 - DNA, 756 bp, Homo sapiens
  misc_feature: GYAE6OF02JTOIY.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtgcggctccggatgcgtctgtcccagctgcacctgcaggagtccgggcccaggacctgggtagaacgtcctttcggacgtaccctgtcccctcacttgcagtcgtctcgtggtcacttccatccgagtacgtagtcaagttaaagtttgggcttcgggtccgccgacggcccccggaggggtaacgggtctagggtaggtaggagttcgggactcggtctacgtcgtaggtcgggacctaccttattacgcgtacccgtcctagaacgtactccggacgttgggtactagttacctactaaacgtaaaaccgtaccgttaacccaaaagaaacccttaagtttcccgtacccgttaggaacggtcctacgtaaccttcgttacggtacgacccggccgtacgggaaccaccgggtaaccttaaaagttacgtttaccgtacggttaccgaacgaaacggtacgggtacgggttacctagggttaaactttcgttaccgtttacgaacccgtacggtcgggtaaccgttaccgggtaacccgttacgggtcctacccggttcctccttacgaccgttaccctaccgaacccggtaaccgggtccctacggttcccggttccccttcccgaccgg

SEQ ID NO: 290131 - DNA, 619 bp, Homo sapiens
  misc_feature: GYAE6OF02JSXYC.45.38.D05.1.454.CMB.1.raw
  modified_base (156)..(156): a, c, t, g, unknown or other
  misc_feature (156)..(156): n is a, c, g, or t
  modified_base (273)..(273): a, c, t, g, unknown or other
  misc_feature (273)..(273): n is a, c, g, or t
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
  modified_base (338)..(338): a, c, t, g, unknown or other
  misc_feature (338)..(338): n is a, c, g, or t
  modified_base (461)..(461): a, c, t, g, unknown or other
  misc_feature (461)..(461): n is a, c, g, or t
  modified_base (521)..(521): a, c, t, g, unknown or other
  misc_feature (521)..(521): n is a, c, g, or t
tcagacgcgatcgacacgaccggtgctcgatttagtatctgatagttgggtttgggggggtcacaagaggcagcgctctcgggacgtctcaccatggcctgggctctgctgctcctcactctcctcactcaggacacaggatcatgggccctttcngccctgactcagcctgcctccgtgtctgggtctcctggacagtcgatcaccatcccctgcactggatccagcggtgacgttactgtttttaagtatcgtctcgtggtatcagcaacnccagacaaacgcccctaancaactctattacncgtatgtcaataagtccggcctcgtaggtttcncgactcgcttactctggtcctacctaggtctagtacaagtaccggcctccgtacgtacacttctcgtcggcctacgacgctacggtaagacgtaggctaggtaactttcgtaactcgacgtanactaacgtataacgttattacggttacctttaccgtagtaccggggttacttaccggggngggtaaacggtaccgttaacggttcggaccggttacggtacgttacgggtaccctacccgtaaacgggtcctaccccgggtaccctccggttaacccg

SEQ ID NO: 290132 - DNA, 971 bp, Homo sapiens
  misc_feature: GYAE6OF02FHNL2.45.38.D05.1.454.CMB.1.raw
  modified_base (157)..(157): a, c, t, g, unknown or other
  misc_feature (157)..(157): n is a, c, g, or t
tcagacgcgatcgacacgaccggtgctcgatttagtatctgatagttgggtttggggggggtcacaagaggcagcgctctcgggacgtctcaaccatggcctgggctctgctgctcctcactctcctcactcaggacacaggatcgtgggccctttngccctgactcagcctgcctcgtgtctgggtctcctggacagtcgatcaccagtcggcctgaccacgtacggaaacccaacgtaggtagagttcgggtttaggggtttaagtttttttaggtttttacgttccgttacccgttcgggtaaccctaaaccgaaacccgtaaccccccgggaccgtaaacccgacccccccgtaaaaacttaaccgttacttaacgttttaacgtaacgggtaacctaaccgttaaacggcccggtaccccggtttaccggggggtttttaccaaacggttccggttaccgttttccgttaccggttcggtacccttaccggtaaacgtttcccggttacgggaccctaaacccggtacccggtacccctttaccccgtacggtaaacctaacgttacccgttaccgtacggggtacccttacccggtaacgggtacccgttacccggtaacggggtaaccggtacgggtaccgttacggttaaacgtttacgttttaccggttcggttaccgtaccgttaccgttaaagttacgttacggaccggaaccgggtaaccgaacggtaccgttaccgggtttacggggtttacggggttccggggtaccggggtaaccgggttaaccggtaacgggtttacccggtaacccggtttacccggttacgggttacccgaaccggtacccgtaaaccgggtcccgtacccggttacccccccggttacggtaccccgttacccgttacccggtttccccgttaccccccgttaccccgtttaccccgttaccgttaccccgg

SEQ ID NO: 290133 - DNA, 764 bp, Homo sapiens
  misc_feature: GYAE6OF02GAOH9.45.38.D05.1.454.CMB.1.raw
  modified_base (220)..(220): a, c, t, g, unknown or other
  misc_feature (220)..(220): n is a, c, g, or t
tcagacgcgatcgacacgaccggtgctcgatttagtatctgatagttgggtttgggggggggtcacaagaggcagcgctctcgggacgtctccaccatggcctgggctctgctgctcctcactctcctcactcaggacacaggatcggtgggtccctttctgccctgactcagcctgcctccgtgtcgtgggtctctggacagtcgatcacatcggcctncactggaaaccaacagtgtatggtagggattactaccttgtctcgtagtaccacagcaccgagaccaaccgaccccaactacatagtattagtaggaggactaaggtaacgcccggtacctacggtacggggtttacctaacgtcgtccttacgtcgtcggtcctaccgtaacgttcgtcggaccaaccggtacccgtacccgttcccgacgtacctaacgttcgtccggtacgggtcctccgtacggtcgtacgggagggtacgtacgggtccttaggttaactttaacggtccgttacgccgttctacctacgtagttacgtacggtacggttaacggtttacggtttaacgggttttacggttttcgggtttacgggtttccggggtaaccgggggaaccgggtttaacccggaacggtttaccgggttacccggtaaacccggtttccgggtaaaccggttaccggtaacccgggaacccggtaaccggttccccggttacccccggtaccccggttacccgggttacccttaccccggg

SEQ ID NO: 290134 - DNA, 736 bp, Homo sapiens
  misc_feature: GYAE6OF02GU5DP.45.38.D05.1.454.CMB.1.raw
  modified_base (142)..(142): a, c, t, g, unknown or other
  misc_feature (142)..(142): n is a, c, g, or t
tcagacgcgatcgacacgaccggtgctcgatttagtatctgatagttgggtttgggggtcacaagaggcagcgctctcgggacgtctccaccatggcctgggctctgctgctcctcactctcctcactcaggacacgaggtntcggtcgggtccctttcgtcgccctgactcacgcctgccctcgtgtcgtggtcctccgtggacagtcgatcacctagtcggcctgctacgtacggaaaccagagttgagttgggtttgggttaagtttttacggtttcgtcgtaccgtacggtaaccaaaccgaaaccgaccccggacgaaccgtaaccccctaaataactcgtaacgtttaagaacggtaacctaacgtaaccggtccggtacccgggtttacggggttaactaacggtccgttcgtttccgccgttaggtcctacgtaacgttcgtagacctaccgaccggtccctccgtacgaactatcccgtgtccgggacctccgacgtcgtcggaacggtacgacggtcttacgttaactttacgtttcgttacggttccgtcttagtaactgtacgacgtacggacgtacgtaccgttggttgggtaccggttacggacgggtaacggtcgttacgtcgtacccgttcggtacgtcgaccggtaccggacggtacctcccggtcccttaacggtcctaccggttccctcccgtaccctccccgtacttaccgtaccg

SEQ ID NO: 290135 - DNA, 779 bp, Homo sapiens
  misc_feature: GYAE6OF02HL34K.45.38.D05.1.454.CMB.1.raw
  modified_base (161)..(161): a, c, t, g, unknown or other
  misc_feature (161)..(161): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacgaggatcggtcgggtccctttntcgccctgactcagcctgcctccgtgtctcgggtctcgtggactagtcgtatccaccagtcggcctgacctacgtacggaaaccaacgagtgagttggttgggttaagtttttgtttgtacctcgtacggtaccaaacgaaccgacccggacgaaccgaccccctaaataactacttaatttagaacggactaacgtaacggtcccggtcccggtttacggggtttacaacggttccgtcctttcgtcgtacggtcctaccgtaagtcgtcggaactaaccgccggtccctacctagaactactctacggtcggtcctacgacggtcctacgacggacggtacgtcgtagttactttacgttcgttgttacgtctaacgttagtacgtacgtacggacggtaaccacggtaccgttaacgggtttccggggttccgggttaccggggacggggtaacccggggtaccgttaaccggggttacgtaccccggttaccggtaacggtacccggaaccgggtcccgtaacggggtccctacccccggtccccggtttccgacccgtttacccgttccgttaccccgttaccccccgtacccttccggttaccggtacccgg

SEQ ID NO: 290136 - DNA, 726 bp, Homo sapiens
  misc_feature: GYAE6OF02GVANT.45.38.D05.1.454.CMB.1.raw
  modified_base (198)..(198): a, c, t, g, unknown or other
  misc_feature (198)..(198): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctcgtgtctgggtctcctggacngtcgatcaccatcggcctgcactcggaaccaacagtgaactggttcgggtagtttttagtttgtcctccttggtaacccaaacaaccgaccccggacgaaaccgacccccctaaaaataactactaattttaagaacgggtacctaacgtaacggccgggtcccgttacgggggttttaccaaacggttcgtactttccgtcgtcggtccttaccaacggttctaggacaaaccgaccggtccctcccgtagacctaagtacctcgtcgggacctccgaaggtcctacgacgggaccgaacgggcttagtaatttactttacgtggtttacgcttacgtagtaacgttggaaccgacgggtaccaggccgtaaggtttcgggtacggttccgggcggtaacggggaaccgttagggttccgaacccgttccgtaggtaccgacgacccggtaaaggcctaccggtcccccgtacggtacacccgttaccgttcccggttacccccgtccccgttactaccgttaccgg

SEQ ID NO: 290137 - DNA, 670 bp, Homo sapiens
  misc_feature: GYAE6OF02IJC5X.45.38.D05.1.454.CMB.1.raw
  modified_base (348)..(348): a, c, t, g, unknown or other
  misc_feature (348)..(348): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcaattaaagttttggggcttgggtccgccacgcccccgaggggaagggctggagtggagttggggactgtcgtactcgtaggtcgggacctacctattacncgtccccgtcctcaacgactcgacttggtcgtatctacaaataaaccacgtaccaaacgaacctaacttcctccctgaacggtctagaacttctgtcgacccgccgacggaccacggacctaaagttacttacgtgtcgacaaggacggtacgggccttaggtaaactttcttaccgtttacgacccgtacggttccggggacccgttacgggaaccccgtttcgggtacccttacccggttaccttcccgtaccgtaaccgtccccttacccggaaccccggtaaccggggtccccttaccggttccccggtttacccccg

SEQ ID NO: 290138 - DNA, 667 bp, Homo sapiens
  misc_feature: GYAE6OF02GFR09.45.38.D05.1.454.CMB.1.raw
  modified_base (383)..(383): a, c, t, g, unknown or other
  misc_feature (383)..(383): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtgcggctcccggatgcgtcctgtcccagctgcacctgcaggagtcgggcccaggactggtgaacgcctttcggacgaccctgtcccctcacttgcagtgtctctggtgactccatcgagtagtagtcattaaatttggggctgggtccgcctacgcccccgaggggaacgggcgtggacgtgggattgggactgtctactcgtagtgggacctactattacgacgtccccgtccctagaacgacgtcgtacgtgggtnacgttctacgaactaaacgaccgtaaccaaacggaacctaacgtttccacccgttagaacgtccgtagaaccttcgtagttccggacccgtccggtacggaaccaccggaccaaagttacttaactgtagacgaagtaaggaacggtccgtaggtaactttatcccgtttaggaccctacggttcggggccctacgggtaacccgtggtacccgtaccggttcctccgtaccgaccgtacccctccgtaacccggaaccggtccgtaccgttacggtacccccg

SEQ ID NO: 290139 - DNA, 799 bp, Homo sapiens
  misc_feature: GYAE6OF02G8L0H.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctccggatgcgtcctgtcccagctgcacctgcaggagtcgggcccaggactgggtgaagccttcggacgaccctgtccctcacttgcagtgtctcgtggtgactccgatcagtagtagtcaattaaagttttcggggcttggggtaccgccacggtcccccgaaggggtaaggggcctgggacgtggtagttcgggacttgtctacgtcgtaggtcgggacctacgttattaccgacgtccccgtaccctacgaacgtaccgtaccgtaacgttcgggtagtacgttccttaaacgtaaaacgttaaaaacccgccggtaaaccctaaaacggtaaacccctaaacgttttcccgtacccgttaggaaccggtaccttaacggtaaccgttaccgttacgtaccggacccggtcccggaaccgggaaccgtaacccgggaaccctaaaacgttacgtttaacgtacggtacgacgtaaaggaacgggaacgggtaccgttaagggtaactttcgttaccgttcgtaaccgtaaccggttcggggaccgtccggggtaacccgttcggtaccgttacccggttccgtaccggttaccaccggtcccgtaacccggaacccgtaccgggtaccccgtaacggttcccgggttacccctccccgttaccccgg

SEQ ID NO: 290140 - DNA, 721 bp, Homo sapiens
  misc_feature: GYAE6OF02JR1SM.45.38.D05.1.454.CMB.1.raw
  modified_base (712)..(712): a, c, t, g, unknown or other
  misc_feature (712)..(712): n is a, c, g, or t
tcagacgcgatcgacacgaccggtgctcgatttagtatctgatagttgggtttgggggacctcctgtgcaggaacatgaagcacctgtggttcctcctcctgctggtggcggctcccggatgcgtcctgtcccagctgcacctgcaggagtcgggcccaggactggtgaagccttcggacgaccctgtccctcacttgcagtcgtctcgtggtgactccatcagttagtagtctaagttaaagtttcggggcgttcgggtccgccgaaccgccccggagggaacggggctggagtggagttcgggactgtctacgtcgtagtcgggaccctacgtattacacgtcccgtccctacaagtcctacggtaacgtgggtacgtactacctacaaacgtaaacaccggtaaccaaacgaaacctaactttccctaccgtaggacgggtacttaggaaccttcgtacgtaccggacccggtcccgggaccgggaacccgacggtaacccaaaactttacgttacgtgggtaacaacgaaaggtacggacgggtaccgttagggttaacttcttacccgttacgaacccgtagggttccgggcggtaacggtaacccggtgttacccgtccgtacctccctacgacccgtccctaccgaacccggaacggtcccgttagtcccgttaccctcccgacgtccctacccgtcacggaccnccgtacccg

SEQ ID NO: 290141 - DNA, 663 bp, Homo sapiens
  misc_feature: GYAE6OF02FQNC8.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtcctcacttgctagtgtctcgtggtcactccatcgagtagtagtcaattaagttttgggctggtccgccacgccccgagggaagggctggagtggagttgggactgtctactcgtagtcggaacctacgtacttacgacgtcccgtacctacaacgtactccgacgtggtacatacctataaactaaaccgtcgtaaccaaagaaccctaattcccgtacccgtggacgtactagtacctcgtcggtcggacccgccggacgtaacggaaccgacttaaattaccgttacgtagtacgacgaaaggacggacgggtactaggtaatttaccgttacgttaccgaacgtaccggttcgggtacgttaccgggtacccttcggtacctaccgtcgtcctacgaccgttcccgaccgaaccgtacggtaccctaccgtccggttaccccttacccggtacccg

SEQ ID NO: 290142 - DNA, 655 bp, Homo sapiens
  misc_feature: GYAE6OF02H271T.45.38.D05.1.454.CMB.1.raw
  modified_base (213)..(213): a, c, t, g, unknown or other
  misc_feature (213)..(213): n is a, c, g, or t
  modified_base (296)..(296): a, c, t, g, unknown or other
  misc_feature (296)..(296): n is a, c, g, or t
  modified_base (394)..(394): a, c, t, g, unknown or other
  misc_feature (394)..(394): n is a, c, g, or t
  modified_base (449)..(449): a, c, t, g, unknown or other
  misc_feature (449)..(449): n is a, c, g, or t
  modified_base (642)..(642): a, c, t, g, unknown or other
  misc_feature (642)..(642): n is a, c, g, or t
  modified_base (653)..(654): a, c, t, g, unknown or other
  misc_feature (653)..(654): n is a, c, g, or t
tcagacgcgatcgacacgaccggtgctcgatttagtatctgatagttgggtttgggtttagaacctatgaacattctgtaggggccactgtcttctccacggtgctccctttctgccctgactcagcctgcctccgtgtctgggtctcctggacagtcgatcaccatggcctgcacgtggaaccaacagtgatggttgggagtttttagtttntctctaggtaccaacaacgacccggcgaacacccccaaataatcaattagtaggaacactaaggccggtccgtcgggggtttnaacgtcgcgttctcgtaggtctacccgaagtcgtcggacaacgtacggtccctcccgtagaactatcctgtcgggcctaccgagctacgagggaccgnggtacgtgtactttatttcgtgtttcgactacgtatagtcgaccgtagggaaccngtaccgtaggtttcgggtcggtttccggggcggtacgggcttaacgggtcgtaccggtcgtacgtacgaccggtacccgaggccgtcccgtcccgtaccggtcgtaacgttccgttccgttcccctaccgtccgtacttccgacgtccgtacgtcgtcgacggcggtcggtaccggagaacggccgagtacgngtacgcagtcnng

SEQ ID NO: 290143 - DNA, 713 bp, Homo sapiens
  misc_feature: GYAE6OF02GEYI9.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctccggatgcgtcctgtcccagctgcacctgcaggagtcgggcccaggactggtgaagtccttcgggacgaccctgtcccctacacttgctaggtgtcctcttggtcgactccatcaggttagtagtctaagttaaagttttggggcgtcgggtccgtccgaccgtcccccgaggggaacgggtcgtacggggagtgggtagttgggtaactgtctacgtctaggtcgggacccaccttacttacgaccgtccccgtaccctcgtaacgactcggtaaccgtggtacgacgttactactaaactaaaactaccgtaccaaaacgtaacctaactttacctacccgtgacggtactacgtactcgtcgtcgacccgccggacgaccgaccggaacctaaattacgttacgttacgtacgtacgaggacggtacggtaccgtaggtaacttacgttccgttacgaccgtccggtacggtccgtacgggtaccgtacggtccgtaacccgtccgtacctcgtaccgtacctacccgaaccggtacggaccccgttacggtccccggtttacccctcccgttacccgg

SEQ ID NO: 290144 - DNA, 708 bp, Homo sapiens
  misc_feature: GYAE6OF02I5DJI.45.38.D05.1.454.CMB.1.raw
  modified_base (298)..(298): a, c, t, g, unknown or other
  misc_feature (298)..(298): n is a, c, g, or t
  modified_base (390)..(390): a, c, t, g, unknown or other
  misc_feature (390)..(390): n is a, c, g, or t
  modified_base (405)..(405): a, c, t, g, unknown or other
  misc_feature (405)..(405): n is a, c, g, or t
  modified_base (425)..(425): a, c, t, g, unknown or other
  misc_feature (425)..(425): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggtaggtcgggcccagggactgggtagaagtccttcgggacgaccccttgtcccctctacgtttgctagtcgtctctggtcgacctccatcaaggttagtagtacaattaaagttttgggacgtcgggtcccnccgacgcccccggaagggaagggcgtagggagtggtaagttcgggacttgtctacttcgtaggtcggacctactatacacgcccgtccctanacgactcgactggtntatacgtactaaagtaaacnccgtacaaacgaacctacttccttaccgtagaacgtctacgtaaccttacgtagttacgaaccgccggtaccggaccgtaccggaactaaacgttaagttacctagtacgaacgaaggacgggacggtacgtaggttaactttaccgttccgtttaacgtaaccgtacggttcgggtacccgttacggggtaaccttaccggtccgtaccggttacctacccgtaccgtaccgtcccgtaaccctaccgaaaccgggtccccaacggttcccggttacccccg

SEQ ID NO: 290145 - DNA, 746 bp, Homo sapiens
  misc_feature: GYAE6OF02JNTKE.45.38.D05.1.454.CMB.1.raw
tcagacgcgatcgacacgaccggtgctcgatttagtatctgatagttgggtttgggggacctcctgtgcaggaacatgaagcacctgtggttcctcctcctgctggtggcggctcccggatgcgtcctgtcccagctgacacctgcaggagtccgggcccaggacctgggtacgaacgtccctttcgggacgtaccctcgttccctcactttggacctagttgttcctctggtcgactccatcgtaggtagttagtcaattaacgttttgggactcgggtccgcacgccccgagggagggtctggtacgtggattgggacttgtacttacgtcgtaggtacggtacctactatactacgtcccgtacctacgaacgtactcgacttcggtacgtactctaacaaactaaccacgtacctaaacgtaacctacgtttacctcccgtagtaacgccgttacggaaccttcgtacgtacgacccgtcggacccggacgaccggtacctaaagtttactacgttacggcgtaaccgaaggtcggaacggtccgttaaggttaacttccgtttaccgtttaccggaacgtaccgggttcgggtacccgttaccgggtaacccgttcggtacccgtaccgttaccttacccgtcgaccgttccccttaaccgaccggtaaccggtccctacggttacccgtcccctttacccgacgtaccctcccctaccgtaacccgttacgacctacccg

SEQ ID NO: 290146 - DNA, 709 bp, Homo sapiens
  misc_feature: GYAE6OF02GYXZO.45.38.D05.1.454.CMB.1.raw
  modified_base (172)..(172): a, c, t, g, unknown or other
  misc_feature (172)..(172): n is a, c, g, or t
  modified_base (424)..(424): a, c, t, g, unknown or other
  misc_feature (424)..(424): n is a, c, g, or t
  modified_base (438)..(438): a, c, t, g, unknown or other
  misc_feature (438)..(438): n is a, c, g, or t
  modified_base (444)..(444): a, c, t, g, unknown or other
  misc_feature (444)..(444): n is a, c, g, or t
  modified_base (452)..(452): a, c, t, g, unknown or other
  misc_feature (452)..(452): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgccgtcctgtcccagctgccacctgcgaaggngtccgggcccaggactgggtagaacgtcccgttcggacgaccccttcgtccctctacttgctaggttctccttgtggtcgacctccgatcgagtagttagtactaatttaaaggttttggggccgtgggtcccgccaccggacccccgaagggggacggggcgtgggaggtgggtagttggggacttgttactacgttcgtaggtcgggacctaacctattaccgcgtccccgtcctaacgactcgactggnactcaacaataacncacaanactatccncagcgctagacgtctcgcgaccggccacggacctacggactaaagttacttacgtcgtagacaggacggtacgggtacgtaagttaacttacgttaccgtttacggaaacccttggggtaccggtacccgggttacggtaccccggtacggttacccggtacccgtttaccgtccccgtaacgaccccggttacccgtaaccccaaccgggtaaccccgggtaaccccttccgggtttccccgtttaacccccccgg

SEQ ID NO: 290147 - DNA, 954 bp, Homo sapiens
  misc_feature: GYAE6OF02FR0M0.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtccgggcccagggacgtggtgaacgtcccgtttcggacgtacccgtcgtcccctactacgtttgcctagttcgtcttgtggtcgtacctccattcgaaggttagtaacgtctaagtttaaaggttttggggcgttccgggttacccggcccgtaccggaccccccggtaagggggtaacgggggtccgttacggggaggttacggggtaacggtttcggggggtaaccttcggttaccgttaccgttaccggttagggtaccggggtaacccctaacccttaacgtttaaccgaaccggtccccccggttacccgtaccgaaaccggtacctaccggtaccgttagggttacgtaacctttacccgtaaacgttaaaacctaaaaccgtaccgtaaaccctaaaaccggtaaaccccttaacgtttaccccgtaccgtacggtacggtacctaaccggttaccgttccggttacgggtaccccgggtaccccggtacccgggaacccgggtaacccggtaaacccggttaaaccgtaaagttttacccgtttaacgtacgggtaaccggtaaccggtaaagggtaccgggtacgggtaaccggtttaaggttaaaccgtttaccgtttacccggtttaaccgaacccgttacggggtacccgggtaccggttaaccgggtacccgttaccgggtaccttacccgttcccgttcccgtacgtacccggtacccctaccggtaaacccggtacccggtcccttacccgggttcccgtttccccccgg

SEQ ID NO: 290148 - DNA, 840 bp, Homo sapiens
  misc_feature: GYAE6OF02J2LL1.45.38.D05.1.454.CMB.1.raw
  modified_base (208)..(208): a, c, t, g, unknown or other
  misc_feature (208)..(208): n is a, c, g, or t
  modified_base (280)..(280): a, c, t, g, unknown or other
  misc_feature (280)..(280): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctccggatgcgtcctgtcccagctgcacctgcaggacgtcgggccaggactggtgaagccttcggacgccctgtccctnacttgcagtgtctcgtggtcactccatcgagtagtacgtctaagttaaagttttggggaccttggggtcccnccgacggtccccccgaagggggtaacggggctagggtaagtcgggagtttcggggaacttcggttacctaacgttcgttacggttacggggaaccctaaccgttaagttaaccgaacggtcccccgttaccccgttacgaaacggtaccgttaccggacgttggggtacgtacgttaccgttaaccaaaacgttaaaacccgtaccgttaccaaaaaccggtaaaccttaaactttcccgtacccgttagggaacggtaccgttaacgtaaaccttccgttaaggtacccggtacccggacccgggtaccggaaccgtaaccggaaccttaaagttactttaaccgtggtacgtacgaaacggacggtacgggtaccgttaacggtaactttaccgttaccgtttaacgtaacccgtacgggttacgggcccgttaacgggaacccgtttcggtaccctaccggttacccgttcccgtaccgtaccggttccccgtaaccggtaacccggtacgggtaccccttacggttccccgggtttacccctttccccggtaccgg

SEQ ID NO: 290149 - DNA, 714 bp, Homo sapiens
  misc_feature: GYAE6OF02JW8V3.45.38.D05.1.454.CMB.1.raw
  modified_base (218)..(218): a, c, t, g, unknown or other
  misc_feature (218)..(218): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggaccacgaggctcggtgggccctttctcgccctgactcagcctgcctccgtgtcgtgggtcctccgtggacagtcgatccaccngtcggcctgaccacgtcggaaacccaagagttgattggtttagggtacgtttttagttttgtccttcgtacggtaaccaacgaacccgacccggacgaaccaccccctaataactctaattacgaggactacagccggtccgtcgggttacacgtcgtctcgtcgtcgctaccgtagtcgtacgacacgaccgtccctcgtcgactacgtcgtcgtacggcctaccgaggtccgtacgacgggtaacgtcggaccgttagttaactttcgtttcgtagttcgtaccttagtatttacgacggtaccggtaacggtaccctcgtacgttacgggtttcgggtacgggttaccgggacgggtacggtaaccggtcggttacccggaccgttaccgtacgggtcgaaccggtacccggacggttcccgtccggtaacccccgtggttacccgtacccgtttccgtacccggtttccccgtcccttacccgttcggtccg

SEQ ID NO: 290150 - DNA, 668 bp, Homo sapiens
  misc_feature: GYAE6OF02GM6VF.45.38.D05.1.454.CMB.1.raw
  modified_base (395)..(395): a, c, t, g, unknown or other
  misc_feature (395)..(395): n is a, c, g, or t
  modified_base (402)..(402): a, c, t, g, unknown or other
  misc_feature (402)..(402): n is a, c, g, or t
  modified_base (411)..(411): a, c, t, g, unknown or other
  misc_feature (411)..(411): n is a, c, g, or t
  modified_base (480)..(480): a, c, t, g, unknown or other
  misc_feature (480)..(480): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtccgggcccagggactgggtgaacgtccgtttcgggacgaccccttgtcccctctacttggctaggtcgttcctcgtgggtcgacctccatcagttagtagtctaagttaagttttggggctcgggtccgccacggccccgagggaacgggcgtggagtggagttgggactgtctactgtagtcgggacctacgtatacacgtccctccacaacgactcgacgtggtnatcctanaactaaacncgtaacaagaacctaattctcctagacgctagactcgtgtacgaccgccgacggacgacgactaaattnttacgtgtacgacaaggtacgcggtactaggtaactttcgtcgttacgaccgttacggtccgggtccgtacggtaacccgttcgggtacccgtacccgttccgtcccgtaccgtaccggtaccccttacccggaacccgtaaccgggtaccccttaccggttcccggtttaccctcccccggtaccgg

SEQ ID NO: 290151 - DNA, 935 bp, Homo sapiens
  misc_feature: GYAE6OF02JRBRP.45.38.D05.1.454.CMB.1.raw
  modified_base (181)..(181): a, c, t, g, unknown or other
  misc_feature (181)..(181): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctctcactcaggacacgacggatcggtacgggtcccttttcaccgtccgtaggacctcncgtccgtcgtcccgtcggtcgttcgtcggtcctcgtaggtacgtacggtacactaccaccggtagtcggtacctacgaccgtacggtaaccggaaaccaggtcggtacgttaggttacggggtttacggttttaacggtttttacggtttccgtccgtttaccggtaacgttaaccgaaaaccccgtaacccggtaaccccggggaccgaaacccccgtaaaccggttaaaccttacgttaaccttaaacgggtttaaacggaaccggtactaaaccggttaccgggtacccggttccggggtttaaacgggttactacgggttccccgttaaggtttccgtccggttaacggtccctaaacgggttaccgtcggttaacggaaacccgaccgttacccggtaccctttaaccggtaaacgttaaacctccgggtttacggttcccggtaacgggtttcccgacccgggtaaagtccggtacgggtaaaccggtacgggtccgtaacgtttcgttaacgtttcgttcgttacgtacgtccttacgtagtacgtacgggtaccgtacgtaccgtacggtaaccgttcgggttaccgtcggggtaacggtaccggtaacggttccggttaaccgtacggttaaccgtcgttaccgtacggtaaccggacggtaccggtcccgttcccggacccggttaccgtccgttaaccgttcccggttaacccgttaccccgtccgtaccgttcgtaaccggg

SEQ ID NO: 290152 - DNA, 745 bp, Homo sapiens
  misc_feature: GYAE6OF02ISDKI.45.38.D05.1.454.CMB.1.raw
  modified_base (593)..(593): a, c, t, g, unknown or other
  misc_feature (593)..(593): n is a, c, g, or t
  modified_base (599)..(599): a, c, t, g, unknown or other
  misc_feature (599)..(599): n is a, c, g, or t
  modified_base (684)..(684): a, c, t, g, unknown or other
  misc_feature (684)..(684): n is a, c, g, or t
  modified_base (691)..(691): a, c, t, g, unknown or other
  misc_feature (691)..(691): n is a, c, g, or t
tcagacgcgatcgacacgaccggtgctcgatttagtatctgatagttgggtttgggggcttttctgagagtcacggacctcctgtgcaggaacatgaagcacctgtggttcctcctcctgctggtggcggctccggatgcgtcctgtcccagctgcacctgcaggagtccgggcccaggtactgggttacgaagtcctttacgggagtaccccttgttcccctctactttgctaggtcgttcttcgtcggttcgtacctccagttccgtaaggttacgtaattcctaaaggttttaagtttcggggtaccgttcggggtacccgccgtaccggacccccggaagggggtaacggggtccggttagggtacgggttggtaacggtttcgggtacgttcggttacttaccgttacgttacggtcgggacctactttacgttaaccgccgtaccccgtcctacgaacgtaccgtaccgacgttacggtactactacctacgtaaactaaccgacctaaacgaacgtaaccttaactttaccctccgtaggacggtctacgtacgtctagtcgaccgcgacgaccacgactaaattnttacgngacgacgaacggacgaggccgtaagtacgtttacttaccgtacgaccgttacggcggtaccgtcgtaccgtcggtacctaccgtntacccgntacccgaccgtaccgacggtaaccgtcctacggtaccggttccctacccgtccg

SEQ ID NO: 290153 - DNA, 752 bp, Homo sapiens
  misc_feature: GYAE6OF02GN8X0.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtccgggcccagggactgggtgaagccttcggacgaccctgtccctcacttgctagtgtctctggtcactccatcagtagtagtcaattaaagtttgggctcgggtccgccacgccccgaggggacgggcgtggagtggtagttgggactgtctacgtcgtaggtcgggacctactactacgacgtccccgtacctacgaacgtactccgacgtcggtagtactctacaaataaacacgtaaccaaacgtaaacctaacttccctacccgtaggacggtactacgtaaacctcgttacggtaccggacccggacccggaccgggaacccgtaacccggaaccctaaaagtttacttaaccgttcggtaacgaccgaaaggtacgggaacgggtaccgttacgggttaaactttaccgtttacccgtttacgacccgtacgggtacgggtacccggtacgggtaacccgttcgggtacccgttaacccggtccttaccccgtcgaacccgttccccgtacccgtaacccggtaaccggggtcccctaaccggtttccccggttaccccgttcccccggtaaccccgg

SEQ ID NO: 290154 - DNA, 622 bp, Homo sapiens
  misc_feature: GYAE6OF02JPJCA.45.38.D05.1.454.CMB.1.raw
  modified_base (159)..(159): a, c, t, g, unknown or other
  misc_feature (159)..(159): n is a, c, g, or t
  modified_base (202)..(202): a, c, t, g, unknown or other
  misc_feature (202)..(202): n is a, c, g, or t
  modified_base (468)..(468): a, c, t, g, unknown or other
  misc_feature (468)..(468): n is a, c, g, or t
  modified_base (481)..(481): a, c, t, g, unknown or other
  misc_feature (481)..(481): n is a, c, g, or t
  modified_base (493)..(493): a, c, t, g, unknown or other
  misc_feature (493)..(493): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggcccttttcngccctagactcagcctgcctccgtgtctgggtctccgtggacnggtcatcaccatggcctgcactggaacctacagttgattggttagggtattttgttttcgtctcctggttacaactaaccacccggagaacgaccccctaaatatactaactttagacggacactaagccgtaccgttcggggtttacaacgttcgtccttctcgttacggcctacaagtctggacaacgacgcctacctcgtaacacttctccgtggcctcgtagctcggtacgacgagcgtacgtaatttcgttctcgggttcncgttacattacgngacgacggtacngtaccgtacgttcgggcgttcggcggtaggaccttggtcgtccgcgttacggacaaccgtccggaacggtctccggtccccgtacggtactaccgtccgttcccggtaaccctcccctcgtccgtaccg

SEQ ID NO: 290155 - DNA, 658 bp, Homo sapiens
  misc_feature: GYAE6OF02GI469.45.38.D05.1.454.CMB.1.raw
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (242)..(242): a, c, t, g, unknown or other
  misc_feature (242)..(242): n is a, c, g, or t
  modified_base (263)..(263): a, c, t, g, unknown or other
  misc_feature (263)..(263): n is a, c, g, or t
  modified_base (361)..(361): a, c, t, g, unknown or other
  misc_feature (361)..(361): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctccggatgcgtcctgtccagctgcacctgcaggagtcgggccaggctggtgaacgccttcggacaccctggtccctcattgctagtctctcgtggcactcntcagtntancataacgttgggctgggtccncagccccgagggagggctcggagtggagttgggactgtctctcgtagtggacctactattacgacgtcccgtacctacgaacgactcgaacgttggtntacgtctataaacaaactaccgtaacctaaacgaacctaaacttttcctaccgtagacggtactacgtaacttcgtgtacggaccgtccggacggacgtacgaactaaattacttaacgtgttagacaaagacggtacggaccgttagtaacgtttagttacctttaagaccgttaaccggtcgggtaccttaccggggtaaccgtcggttcccgtaacccggttacttcccgtaaccgtcgaccccgttacccgaaacccggtacgggtacccgtacgttacccggtttcccccgg

SEQ ID NO: 290156 - DNA, 898 bp, Homo sapiens
  misc_feature: GYAE6OF02GLVFU.45.38.D05.1.454.CMB.1.raw
  modified_base (153)..(153): a, c, t, g, unknown or other
  misc_feature (153)..(153): n is a, c, g, or t
  modified_base (164)..(164): a, c, t, g, unknown or other
  misc_feature (164)..(164): n is a, c, g, or t
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtggccctttntgccctgactnagcctgcctcgtgtctggtctccgtgacagtcatcacagtcgcctgcacgtacggaaccaacgtagtgaagttcggtttagggtagtttttagttttcgtccgttaccgttacggtaaccctaaacgtaacccgtaaccccggtacgaaacccgtacccccctaaaaacgtcctaacgttacgtaacgtttttaacgacggaacggggtacctaaagggttaaaccggcccgggttacccccgttaacgggttaaccggggggtttttaacctaaaacggttcccggttaaccgtttccggttaccggttacggggtacccttaacccgtaaacgggttccgtacggggtaaccccaaacggtaaccccgggttaccctacccgttaacgaaccgttaacgtccgttaccgggtacgggtcctacccgggttacggtacgttaacgggaacgggtaaccggtaacgggtccgttaaggtaacttttaaaccgtaacgttcggtacttcgtacttaacgtaagtttacgtagtaacgttaagggttaacgtttacgtttaacggttttcgggtacggtttaccgggaacgggttaaacggaacgtaacggtaccgttaccggtaaccggttccggtaaggtacccgtacccgggtaaccgtaacgggttacccgtaccccggttaccccggtacggttccccgttaacgttcccgttaccccgtttaccccccgg

SEQ ID NO: 290157 - DNA, 326 bp, Homo sapiens
  misc_feature: GYAE6OF02FLSMO.45.38.D05.1.454.CMB.1.raw
  modified_base (303)..(303): a, c, t, g, unknown or other
  misc_feature (303)..(303): n is a, c, g, or t
  modified_base (310)..(312): a, c, t, g, unknown or other
  misc_feature (310)..(312): n is a, c, g, or t
  modified_base (314)..(326): a, c, t, g, unknown or other
  misc_feature (314)..(326): n is a, c, g, or t
tcagacgcgatcgacacgaccggtgctcgatttagtatctgatagttgggtttcaagtcgcttctctggctccaagtctggcaacacggcctccctgacaatctctgggctccaggctcaggacgaggctgatttatttctgttgctcatatgcagggaccagcacgtttggggtgttcgggcgggagggaccagggtttgacccgtccgtaggtcacgacccgaaggcctcgccccctggtccacttcctcgttacccaccctcctctacgactcgtcgtctgacgcgggctggcaaggcanactagcnnnannnnnnnnnnnnn

SEQ ID NO: 290158 - DNA, 779 bp, Homo sapiens
  misc_feature: GYAE6OF02G69IP.45.38.D05.1.454.CMB.1.raw
  modified_base (118)..(118): a, c, t, g, unknown or other
  misc_feature (118)..(118): n is a, c, g, or t
  modified_base (244)..(244): a, c, t, g, unknown or other
  misc_feature (244)..(244): n is a, c, g, or t
  modified_base (457)..(457): a, c, t, g, unknown or other
  misc_feature (457)..(457): n is a, c, g, or t
tcagacgcgatcgacacgaccggtgctcgatttagtatctgatagttgggtttgggggctttctgagagtcacggacctcctgtgcaggaacatgaagcacctgtggttcctcctctnctggtggcggctcccggatgcgtcctgtcccagctgcacctgcaggcgtcgggcccaggactggtagaacgtccgttcggaactccctgtccctagacttcggcagtgtccttgtggtacactccntcaaggttagtagtactaagtttaaaaggtttcgggcggtcggtccgacccgacggcccccggaagggggaacgggtccggtagggtacggtacggtaggttacggggacgttcggttcctaacgtttaccgtaggaccggtaaccgtaccttaacttaaccgccgtaccccgttacccaccgaagtaccgtcgtaacgttacgggtctaacnccggttaaactaaacgtaaaccgtaaacgtaccgaaaaccaaactaacttacccgtctaaggacgtaccgtacgtaaaccttcgtacgtaacgaaacccggccggtaccggaacaaccgggtactaaaattacttaacggttgaacgacgaaagaacgggagtccgtaaggtaacttacgttaccttccgaacggtccgtggtacccgacgggttaacccgttcgaccgtaccggttcccgtaccttaccgaacccgtccgtaaacccgtacccggaaccgggtaaccctcggttacccggtcccccgtttacccgacccgg

SEQ ID NO: 290159 - DNA, 918 bp, Homo sapiens
  misc_feature: GYAE6OF02GMUZ3.45.38.D05.1.454.CMB.1.raw
tcagacgcgatcgacacgaccggtgctcgatttagtatctgatagttgggtttgggggggtcacaagaggcagcgctctcgggacgtctccaccatggcctgggctctgctgctcctcactctcctcactcaggacacaggatcgtgggccctttctgccctgactcagcctgcctccgtgtcgtgggtctcctggacagtcgatcaccatggcctgcacgtcgaaccaacagtgagttggttgggtagtttttaggttttcgtcttccgttaggtaaccaacaaccgaccccggtacgaaaccgacccccctaaaaagtaacttaccgtaattttaacgtaacggggaacctaacgtaaacggcccgggtaccccggtttcggggggttttaccaaacggttccgtccgttttaccgttccgttcgggacccttacccgtaaacggttccgtacgggtaacccgtaaaccgtaacccggggtcccctttacccccgtacggtaaacctaaaccgtttcccgttaccggttaccgggggccctttaccccggtaacggggtaccctttaccgggaaacggggtaccggaacgggttaccgttaacgggttaacttttaacggttttaccggttaggttttaacggtaccttacgttaaacgttacgttacggaaccggtaaccgggtaacctaaccgggtaccgttaacggtttcggggggttacgggtttaccggggaacccgggggtaacggggttacccggttaacgggtttaccggtaacccggttacccggttaacgggtacccgttaccggaaccccggtaaacgggtcccgttccccgggtacccccgttcggttaccctaacccgttccgttacccgttacccccgtacccgtttcccctcgttacccgg

SEQ ID NO: 290160 - DNA, 727 bp, Homo sapiens
  misc_feature: GYAE6OF02G2GEW.45.38.D05.1.454.CMB.1.raw
  modified_base (187)..(187): a, c, t, g, unknown or other
  misc_feature (187)..(187): n is a, c, g, or t
  modified_base (342)..(342): a, c, t, g, unknown or other
  misc_feature (342)..(342): n is a, c, g, or t
  modified_base (371)..(371): a, c, t, g, unknown or other
  misc_feature (371)..(371): n is a, c, g, or t
tcagacgcgatcgacacgaccggtgctcgatttagtatctgatagttgggtttgggtttagaacctatgaacattctgtaggggccactgtcttctccacggtgctccctttctgccctgactcagcctgcctccgtgtctgggtctcctggacagtcgatcaccatggcctgcactggaaccaacngtgatggttggagttttagttttgtcttcctggtaccaaacaaccaccccgggacgaaaccgcccccaaaactaactcctaatttaagtagggacactaagccggtcccgtcgggggtttcaaggtcgcttctcgtggctccaagtctggcaacncggcctccagactatcgtctcggctccgngctcgacggacgaggctgtatttacttcgtgtttgcgttatagtatcgacgtacggggaccctaaggtctaacggtttgggtacgttcgggacgggtagggtaacccgtagggttacgtacccgttaccggttacggtacccgtacggacccgtaaaccgggtccgtacccgaccccccggttcggtacgtaacccgtttcccggttacccggtttacccccggtacccctttcccgtccgttaccggtacccgtccggttcccgtacgtacgggtaccgggtcccgggtccggttacggggacccgtaacgggtaccccgggtacaacggttacgtaccgacggtctaggcgtac

SEQ ID NO: 290161 - DNA, 560 bp, Homo sapiens
  misc_feature: GYAE6OF02HYMBX.45.38.D05.1.454.CMB.1.raw
  modified_base (302)..(302): a, c, t, g, unknown or other
  misc_feature (302)..(302): n is a, c, g, or t
  modified_base (476)..(476): a, c, t, g, unknown or other
  misc_feature (476)..(476): n is a, c, g, or t
  modified_base (490)..(490): a, c, t, g, unknown or other
  misc_feature (490)..(490): n is a, c, g, or t
  modified_base (552)..(552): a, c, t, g, unknown or other
  misc_feature (552)..(552): n is a, c, g, or t
  modified_base (556)..(556): a, c, t, g, unknown or other
  misc_feature (556)..(556): n is a, c, g, or t
  modified_base (559)..(559): a, c, t, g, unknown or other
  misc_feature (559)..(559): n is a, c, g, or t
tcagacgcgatcgacacgaccggtgctcgatttagtatctgatagttgggtttgggtttagaacctatgaacattctgtaggggccactgtcttctccacggtgctccctttctgccctgactcagcctgcctccgtgtctgggtctcctggacagtcgatcaccatggcctgcactggaaccaacagtgatgttgggagtttttagttttgtctcctggtaccaacaacacccggcgaacgcccccaaactaatcatttatagggacactaagcggccgttcgggggttcaagtcgcttcnctggtctccaagtctggcaacacggcctcctgacatctcgtggcctccgagctcaggacgagtctgatttattctgtgtctctatatgcgacggacagctacgttgggtgtcgggaggtacggacgtaggttcgaccgtccgtaggtcacggccacgcgtcgccccggtcgtcnctccgtcgttcccncctcctcgtcgtactcgcttcgtcgacggtccggtctcggacgacggtcgacgtagtagtcngtcngcng

SEQ ID NO: 290162 - DNA, 680 bp, Homo sapiens
  misc_feature: GYAE6OF02GZI78.45.38.D05.1.454.CMB.1.raw
  modified_base (390)..(390): a, c, t, g, unknown or other
  misc_feature (390)..(390): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctccgtgtctgggtctccgtggacagtcgatcaccatggcctgcacgtggaaccaacagtgatggttgggtagtttttagttttgtctcctggtaccaacaaccaccccggcgaacgacccccaaactaactcaatttacgagggacactaagccggtcccgtcgggggtttacaagtcgtcttctctggctcaagtctggcacacggcctcccngactatctcgtgggctccgaggctcgacgggacgaggctagtatttatttcgtgttcgcttacattatgaccgacgggtaccaggtcgtacggtttgggttcggttcgggaccgggtacgggtaccgtagggtttccggacccggttaccgttacgggtaccgtaccggtaccccgtaaacggggtccgttaccccgggtccccccgtttaccgggttacccgttacccgtttcccggttccccggttttaccccccgtcccccggttttacccgtcccgtttaccccgg

SEQ ID NO: 290163 - DNA, 668 bp, Homo sapiens
  misc_feature: GYAE6OF02GZN52.45.38.D05.1.454.CMB.1.raw
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggaggtccgggcccaggactggtgaacgccttgggacgacccttgtcccctcacttgctagttgtctcgtggtcactccattcaagttagtatctaagttaaaggttttggggcgttggggttccgcccaccggacccccgaaggggaacggggctacgggagtggagttaggggactggttctactcgtacggtgggacccaccttatacacgcccgtccacaacgtctcgacgtgtagtntcctanaactaacactacaacgaacctaattcctacctgaacgcgtacgtactctgtcgacccgccggacgacaccggaccaattacttactgagtacgaagtggacgggaccttaggtaactttacttcgtttaccgacctaccggttcgggaccgtccgggtacgtacggtcctaaccgttccgaccctcggaccctcccgtacccgaacccggtaccggtcccgtaaccggtttcccggttcccttcccccggtacccgg

SEQ ID NO: 290164 - DNA, 714 bp, Homo sapiens
  misc_feature: GYAE6OF02G1IIW.45.38.D05.1.454.CMB.1.raw
  modified_base (210)..(210): a, c, t, g, unknown or other
  misc_feature (210)..(210): n is a, c, g, or t
  modified_base (293)..(293): a, c, t, g, unknown or other
  misc_feature (293)..(293): n is a, c, g, or t
  modified_base (358)..(358): a, c, t, g, unknown or other
  misc_feature (358)..(358): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtgcggctcccggatgcgtcctgtcccagctgcacctgcaggagtccgggcccaggactggtgagccttcggagaccctgtccctnacttgcagtgtctctggtgacctccatcaagtagtagtcattaaagttttggggctgggtccgccacgccccgagggagggcnggagtggtattcgggacttgtcctacgtctaggtcgggaccacctagttacacgtccccgtcctnaacgactcgactggtacattcacaataaacaccgtaccaaagtaaccctaatttcccgtacccgtagacggtctacgaaaccttcgtaggtaccgacccggtccggaccggaccgtaccggaacctaaaattacgttacgtcgttacaacgtaaggtacggaacgggtccgtaagtaaacgtttaccttaccgttttacgaacctacgggttccggggtacccgttacggggtaaccccgttgggttaaccctacccgggtttccccttacccgtaccggtaacccggtcccctttaaccccgaacccggggtaaacccgggtacccccttaagggttcccccccggtttccccgg

SEQ ID NO: 290165 - DNA, 559 bp, Homo sapiens
  misc_feature: GYAE6OF02GR9AV.45.38.D05.1.454.CMB.1.raw
  modified_base (382)..(382): a, c, t, g, unknown or other
  misc_feature (382)..(382): n is a, c, g, or t
  modified_base (431)..(431): a, c, t, g, unknown or other
  misc_feature (431)..(431): n is a, c, g, or t
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctgccctgactcagcctgcctccgtgtctgggtctcctggacagtcgatcacatggctgcactggaaccaacagtgatgttgggattttagtttgtctcctggtaccaacaacacccgcgaagccccaaaataatcattatagggacactaagcggccgtcggggttacaagtcgacttctctggactccaaagtctaggacaaacgacggcctccctgaacaaatcnctcggctccaggctcaaggacgaagctgattattctgtacgctcattangtacagggactagcgtaacgtggttggttcggcggtaggaccgtaagttacggaccgttaccgtacggtgacgtacccgaaggcttcggccccttcggtcactcctacgttcccgccctcgtcctacg

SEQ ID NO: 290166 - DNA, 667 bp, Homo sapiens
  misc_feature: GYAE6OF02I7IZU.45.38.D05.1.454.CMB.1.raw
  modified_base (207)..(207): a, c, t, g, unknown or other
  misc_feature (207)..(207): n is a, c, g, or t
  modified_base (316)..(316): a, c, t, g, unknown or other
  misc_feature (316)..(316): n is a, c, g, or t
  modified_base (549)..(549): a, c, t, g, unknown or other
  misc_feature (549)..(549): n is a, c, g, or t
  modified_base (603)..(603): a, c, t, g, unknown or other
  misc_feature (603)..(603): n is a, c, g, or t
  modified_base (611)..(611): a, c, t, g, unknown or other
  misc_feature (611)..(611): n is a, c, g, or t
tcagacgcgatcgacacgaccggtgctcgatttagtatctgatagttgggtttgggggtcacaagaggcagcgctctcgggacgtctccaccatggcctgggctctgctgctcctcactctcctcactcaggacacaggatcgtgggccctttctgccctgactcagcctgcctccgtgtctgggtctccgtggacagtcgatcacntgcctgcactggaaccacagtgatgttgggtattttgtttgtctccgtagtaccaacagcctaccgaggacaaaccgccccaaaatccatgtaactttagaggacggtnaaggtaacgtccgtcctacgttagggttctaacgtccgtacgttctcgtcggcttaccgtaacgttccgaggtaccgtaaccgtaaccggtcccttacccggtacgaaaccgttaaaccgttcccggtccggttaccgggtaccccgtttacggaaccgggttcgttaaccgggacggggttaccgacggtaccgttagtacttttaaccgttaagttcggtcctgtccttanacttaagtcgtacgtaacggttcgtaagtttccgtttgtacggtcggtacgggngtaaccgngtcgtcgaaccgtcgtagcgacgaccgtcgtaccggctcccggtcgtacgtctccg

SEQ ID NO: 290167 - DNA, 666 bp, Homo sapiens
  misc_feature: GYAE6OF02JJ776.45.38.D05.1.454.CMB.1.raw
  modified_base (236)..(236): a, c, t, g, unknown or other
  misc_feature (236)..(236): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaaggcccttcgggagacccctggtcccctacacttgccagttgtccgtntggtcgacctccatcaggtagtagtcataaagtttgggcgtgggtccgccacggtcccccgaggggacgggtcgtggacgtgggagttgggacgttcgtactacgtcgtaggtcgggacctactagttacacgtccccgtccgtacaagacgtcgacgtcggtgactgtacaaataacgaccgttacccaaagtaaacctatcctccctagacggtactacgactctcgacgaccgccgacggacaccggacaaattagttaccacgtagacaaggtacgacggtcgtaggaacttcgtacgtcgtacctacgggtcgggaccttaccgggaaccgttcggtacccgttaccgttacccgacccgttaccgacggtaccccgtaaccctacccgggtaaaccggccccttaggttaccccggtcccccgg

SEQ ID NO: 290168 - DNA, 957 bp, Homo sapiens
  misc_feature: GYAE6OF02IAGHY.45.38.D05.1.454.CMB.1.raw
  modified_base (199)..(199): a, c, t, g, unknown or other
  misc_feature (199)..(199): n is a, c, g, or t
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggccctttctcgccctgactcacgcctgccttccgtgtcgtggtctcgtgacngtcgatcacctagtggcctggccacgtacggaaaccaacgtagtgtacgttgggtttacggggttaagttttttaggttttttcgtccgtttaccggttacggttaaacccaaaaccgaaaccccgtacccccggggaaccggtaaacccggaacccccccgttaaaaattaaaccgttaccgttaaagttttaaccggtaaacgggtaaacccttaaaccggtaaacggtcccggggtttacccggtttaccgggggggtttttactaaccggtttcccgttaccgtttcgttaccgttcgggtacccttacgtaaacggttcgttcggaacctaaccggaccggttcccttaccgtacggtaaccacgttcctccggtcgggtcctaccgtacggtcctaacggaacgggtaccggtacggttaccttaggttaaccgtttttatttccgtttaacggtttcggtacctttaacgtaaacgttttacggtacggaccggttaaccggggaccttaaaccggtccggttttaacggggtttcgggggtttaaccggttcccggggggaacggggtaaccgggttaacccgggtttacggggtaaccggttaccccggtttaaggttcccgggtacgtaaacccggtacccgggtaccggtaccccggtttcccgtaccccccggttttaccggtcccttaaccggttttcccgtaccccgttttaccccccgcccgtttacccctccggttaacccg

SEQ ID NO: 290169 - DNA, 692 bp, Homo sapiens
  misc_feature: GYAE6OF02HASM4.45.38.D05.1.454.CMB.1.raw
  modified_base (158)..(158): a, c, t, g, unknown or other
  misc_feature (158)..(158): n is a, c, g, or t
  modified_base (232)..(232): a, c, t, g, unknown or other
  misc_feature (232)..(232): n is a, c, g, or t
tcagacgcgatcgacacgaccggtgctcgatttagtatctgatagttgggtttgggggggggtcacaagaggcagcgctctcgggacgtctccaccatggcctgggctctgctgctcctcactctcctcactcaggacacaggatcgtgggccctttntgccctgactcagcctgcctccgtgtctgggtctccgtggacagtcgatcaccatggcctgcactggaaccaanagtgatgttgggtattttagtttgtctctaggtaccaacaaccacccggacgaacgaccccaaactaatctaatttagtaaggactacgtaacgccggtccgttcggggttacaagtcgtcttctcgtcggcctacgagtcgtagacaacgaccgcctacccgtagaacctaactcgttcgtcgggtacctccgtaggcctacgacggacgaggactagtatttactttcgtaggtttcgacttactaagttacgtacgtacgacgggtaccacggtaccgttacgggtttgggttcggttacgggcgggtaacgggtaccgttaagggttccggtaaccggttacgtacggtacgtaaccggacccggtaacggtacccgtcccgtacccccggttacggttacctaaccggttcccgttacccggtcccccgttacccgttcccgtacccgttaccgg

SEQ ID NO: 290170 - DNA, 710 bp, Homo sapiens
  misc_feature: GYAE6OF02HAPEX.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtccgggcccaggactggtagaacgtcccgttcgggacgtaccccttgtcccctcacgttgctaggttcggtcctcgtgggtcgtacctcccgtatacgtagtagtacgtactaagttttaagggtttcgggacggtccggtcccgaccgacccggacccgggaaggggacgggtcgtagggtaggtggtaggtacggacttgtccgttacgtcggtagggtaccgtacctacgttataccgccgtccccgtcaacgtacgtaccgtcgagttggacgtctaccgtaataaacgtaaccgtaccgtaaccaaacgtaacctacttccgtacgagacgtctacgtactcgtcgaccgaccgcggaccgacgacgtaactaagttactacgtgacgagacggtaggaccggtagtaacgttacttaccgttcgtacgaccgttggtaccgggtaccgtaccggtaccgtcggtccctaccggtcctaccgccgtaacccgcccgtaaccgaccggtaccggtcccttacggttccccgtccccg

SEQ ID NO: 290171 - DNA, 814 bp, Homo sapiens
  misc_feature: GYAE6OF02GJZDW.45.38.D05.1.454.CMB.1.raw
tcagacgcgatcgacacgaccggtgctcgatttagtatctgatagttgggtttggggggggtcacaagaggcagcactctcgggacgtctccaccatggcctgggctctgctgctcctcactctcctcactcaggacacaggatcgtcggcccctttctgccctgactcagcctgcctccgtgtctggtctcctggacagtcgatccacatcggcctgctattggaaaccacagtgagttggttagggttagttttagttttgtctccgttggtaccaacaaccacccggcgaacgacccccaaactaactcatttagtaacggacacgtaacgccggtcccgtcggggtttcaagtccgtcttctcgtgtcctccgtaacgtcgtgaccaacgaccggtcctcccgtagacgtaactcctcgtacggctaccgtacggtccgtacgacgggtaccgaggtaccgttaggtaacttttacgttttaccgtttagggttccgttaccgttacgttaactttacgtacggtaaccgggtaaccggggaacccgtaacggtaacccggtttacgggttttacggggggttccgggttttaccgggggacccgggggtaacggggttacccggttaaacggggtttcccgggtaacccgggtttcccgggtaacgggttacccgaaccggtacccccgggtaaacggtccccgggttaccccgggtcccccccggtttacgggttaccccttaacccgtttccggtttcccccggtttaacccccttcccccggttacccgttccccgtttacccggg

SEQ ID NO: 290172 - DNA, 358 bp, Homo sapiens
  misc_feature: GYAE6OF02HR8Z1.45.38.D05.1.454.CMB.1.raw
  modified_base (311)..(311): a, c, t, g, unknown or other
  misc_feature (311)..(311): n is a, c, g, or t
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
  modified_base (328)..(358): a, c, t, g, unknown or other
  misc_feature (328)..(358): n is a, c, g, or t
tcagacgcgatcgacacgaccggtgctcgatttagtatctgatagttgggtttcaagtcgcttctctggctccaagtctggcaacacggctccctgacaatctctgggctccaggctcaggacgaggctgattatttctgttgctaccatatgcgagggaccagcacgttgggtggttcggtcggagggaccgaggttggaccgttcgtaggtcgtacgcccgaaggcgtcgccccgtcggtccacgtctcgttcccacctcctcctcgactccgtcgtcctggacgccgggtctcgggacaacgggtccncggtatacggntgcngnnnnnnnnnnnnnnnnnnnnnnnnnnnnnnn

SEQ ID NO: 290173 - DNA, 694 bp, Homo sapiens
  misc_feature: GYAE6OF02F2ODR.45.38.D05.1.454.CMB.1.raw
  modified_base (424)..(424): a, c, t, g, unknown or other
  misc_feature (424)..(424): n is a, c, g, or t
  modified_base (522)..(522): a, c, t, g, unknown or other
  misc_feature (522)..(522): n is a, c, g, or t
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcgtgggtccctttctcgccctgactcagcctgcctccgtgtcgtcggtctccgtggacagtcgatcaccatcggcctgccacgtcggaaaccaagagtgtagtggttgggtacgtttttagtttcgtccttccgtaggtaaccaacgaacccgtaccccggcgaaacccgaccccctaaactaactctaatttacgtaaggacctaacgtaacggccggtcccggttcgggggtttacaacggtccgtcttcgtctggctcagtctgacaacgccgcctccngacactctcgtcgggctccgacggtctcggacggtaccgaggtctaggtactttagtttaccgtggttactccgtatacttagtcgacggacggaccncggtacttgggttacgggttcggtccggggtacgggtacgggtaacccgtgggttaccggtacccgttcgtaacgggttcgaacccggaccgttgggacccgttcccggtcccccgttcggtaccgtcccgttacgtttccccggtccccgtcccgtttaccgtacggtccg

SEQ ID NO: 290174 - DNA, 654 bp, Homo sapiens
  misc_feature: GYAE6OF02HRRAP.45.38.D05.1.454.CMB.1.raw
tcagacgcgatcgacacgaccggtgctcgatttagtatctgatagttggggtttgggggctttctgagagtcacggacctcctgtgcaggaacatcgaagcacctgtggttcctcctcctgctggtggcggctccggatgcgtcctgtcccagctgcacctgcaggagtcgggcccaggactgggtgaagccgttcggagacccctgtcccctcacgttgcagtgtctcgtggtgactccatcagtagtagtcaagttaagttttggggctcgggtccgccgacgcccccgaggggaacggggcgtggagtggagttgggactgtctactcgtaggtcggacctactattaccgacgtcccgtcctacaagctcgactggtgactctacaataaaccgacgtacaacaacctattcctacctgacgactacgtaactcgtgccgccggacgtcggacaccggactaattattctaggtacgagtaagaggacggtacgtaggttacttacgttccttacgaacccgtacggtcggaccttacggggtacccgtcggttaccgtacccgttccgttccctaacggcccgtacccgtaccccaccgggaaccggtcccgttacggtaccccgggtttcccttacccccggtcccgg

SEQ ID NO: 290175 - DNA, 707 bp, Homo sapiens
  misc_feature: GYAE6OF02ILCAC.45.38.D05.1.454.CMB.1.raw
  modified_base (229)..(229): a, c, t, g, unknown or other
  misc_feature (229)..(229): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggacgaccctgtccctcacttgcagtgtctctggtnactccatcagtagtagtctattaaagtttgggcgtcgggtccgccacggcccccgaggggaacgggcgtagggacgttggagttgggacgtggtccttacgtcgtaggtcgggaaccctaccgtaattaaccgacgtccccgttaccctacgaaacgtcctaccgacgtgggtctacgtctactaaactaaaccaaccgtaccaaaacgtaaaccctaaactttccctacccgtaggacggtaccgtacgtaaccttcgtacggtaccggacccggcccgtaccggaccgaccggacctaaatactttacgtagtcgacgaaggacggacgggtccgtaggtaacgtttactccgttacgaccgtacggtcgggtcccgtacgggtacccgtcggtaccgtaccgtcttacccgtcgtaccgtccccgtaccacccggaacggtacccctacgtccccggttccctcccccgtaccgg

SEQ ID NO: 290176 - DNA, 686 bp, Homo sapiens
  misc_feature: GYAE6OF02GVI6G.45.38.D05.1.454.CMB.1.raw
  modified_base (231)..(231): a, c, t, g, unknown or other
  misc_feature (231)..(231): n is a, c, g, or t
  modified_base (270)..(270): a, c, t, g, unknown or other
  misc_feature (270)..(270): n is a, c, g, or t
  modified_base (310)..(310): a, c, t, g, unknown or other
  misc_feature (310)..(310): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacgagggtcctgggcccagtctgccctgactcagcctgcctccgtgtctggtctcgtggactagtcgatccaccatctctgcacgtaggaaccngcagtgatggttggattataccttgtctcctagtaccancgcaccgagaccaaaccgccccaatcactagtagtttagnggaggacaggtaacgccgtacctcggtaggttactacgtccgtcttcgtcgtcgctacgtaagtcacggactaacgccgtcctacccgtagtaacctacgtcgtacggtcggtacctacccgaggtcctacgggaacgggacgtacgtcgttaggttactttacgtttctcggttacgtccttaagtacgttacggtcggtaccggtacgggtaacccgtacggtaccgtttaccgggttgggttaccgggttaccgggacggggtaccggtaccggttaacggggttccgtaacccgggttacgtaacgggtcccgtaaccggtacccggtacgttccccggtacccggtcccccggttacgtcccgttacccgg

SEQ ID NO: 290177 - DNA, 180 bp, Homo sapiens
  misc_feature: GYAE6OF02GEBKD.45.38.D05.1.454.CMB.1.raw
  modified_base (175)..(180): a, c, t, g, unknown or other
  misc_feature (175)..(180): n is a, c, g, or t
tcagacgcgatcgacacgaccggtgctcgatttagtatctgatagttgggtttggggggtcacaagaggcagcgctctcgggacgtctccaccatggcctgggctctgctattcctcaccctcctcactcagggcacagggtcctgggcccagtctgccctgactcagcctgccnnnnnn

SEQ ID NO: 290178 - DNA, 1060 bp, Homo sapiens
  misc_feature: GYAE6OF02F0GRS.45.38.D05.1.454.CMB.1.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggcccttttctcgccctgactcagcctgcctccgtgtctgggtctcgtggacagtcgatcgaccagtcggcctgccacgtcggaaacccaactaggtgagttggtttaggggttaggttttttacggtttttcgtccttccgttacggtaacccgtaaaccaaacccgaacccccggtaccgaaacccgaacccccccgtaaaaataaaccttcctaaacgtttttaacgtaaaccggggtaacctaaccggttaaacgggccccgggttaccccgggttttaccggggggggtttttaaaccctaacgggttcccggttaccgtttttcccgttccgtttacggggtacccttacccgtaaacggttccgttacgggtaccgtaaaacccggtacccggggtaccccctttaccccgtaacggtaacccgttaaacgtttacccgttaccgggtttaccggggtacccgtttaccccggtaaagggttccccgttaacggaacgggggtaacccgggacggggttaaccgtttacggtttaacgtttttacgtttttacccgtttcgggttttaccggtacctttacctaacgtttacggtttacgggaccggtaaccgggtaacccggtacgtacccggtttacgggttcggggtttacggggtttcccgggggacggggtaaccggggtaacccggtttacggggtttaccgggtaaacccccgggttttacgggttaacccgggtacccggttaaacccgggtacccggaaaaccggggtttccccgtaacccccggggtccccccccgtttaggggtttaacccccgttacccggtttccccgtttttaaccccccggtaccccccggtttacccccctttacccccgggtttaccccgttacccgg

SEQ ID NO: 290179 - DNA, 789 bp, Homo sapiens
  misc_feature: GYAE6OF02G177P.45.38.D05.1.454.CMB.1.raw
  modified_base (225)..(225): a, c, t, g, unknown or other
  misc_feature (225)..(225): n is a, c, g, or t
tcagacgcgatcgacacgaccggtgctcgatttagtatctgatagttgggtttgggggggggtcacaagaggcagcgctctcgggacgtctccaccatggcctgggctctgctgctcctcactctcctcactcaggacacagggtcctgggccagtctgccctgactcagcctgcctcgtgtctgggtctctggacagtcgatcacatctctgacactggaaccngtcagtgatggttagggattataacccgttgtcctaccgtggtaacccaactacggccacccgtaagggaccaaaaccggccccctaaaatccatcgtaatttacgtagggaacggtactaggtaacgccggtaccgttcggtacggggttttactaacgtccggtacttctcgtcggtacctacgtaacgttccgtacgggacctaaaccggaccgggtccccttacccggtaagtaccctaaacgttccgtccggtacgggtccccgtaacccggtacgggtaccgtagggtaacgggtaccggtaacgggccgttaaggttaccttttaaccggttacgtaccggttcttcggtaaccttagtaaacgttaggttaccggaccggttaagggtttacggttaccgggttttacgggtttacgggttccggtttacggggaacccggggtacgggtaacccgtaacgggttcgtaacccgggttaccgggttaaccgtacggtaacccgacggttacccggtaacggttcccggtaccccggtaccccggttcgtaaccccg

SEQ ID NO: 290180 - DNA, 609 bp, Homo sapiens
  misc_feature: GYAE6OF02HKIMJ.45.38.D05.1.454.CMB.1.raw
  modified_base (521)..(521): a, c, t, g, unknown or other
  misc_feature (521)..(521): n is a, c, g, or t
tcagacgcgatcgacacgaccggtgctcgatttagtatctgatagttgggtttggggatgcttttctgagagtcacggacctcctgtgcaggaacatgaagcacctgtggttcctcctcctgctggtggcgctcccggatgcgtcctgtcccagctgcacctgcaggagtcgggcccaggactggtgaagtccttcggagaccctgtccctcacttgcagtgtctctggtcgactccatcagtagtagtacaattaaagttttgggctgggtccgccacgcccccgaggagggctggacgtggagttgggactgtcgtactcgtagtcggaccacctattaccgacgtccccgtacctcagacctcgactggtgatctacgaaataaacacgtaccaaacgaactaactttcctacccgtgacgtctacgtactcgtcgtcgaccgcggcgaaccgacgacctaaagttatactgtacacgtaaggagacggacgtaggtaacttacgttcctttcgaccncgtcgggtccctagggtaaccctggtacccgccgttctcccgtcctacgccctaccgaccgtaaccggccctacgtcccggttccccg

SEQ ID NO: 290181 - DNA, 742 bp, Homo sapiens
  misc_feature: GYAE6OF02JI4BE.45.38.D05.1.454.CMB.1.raw
  modified_base (160)..(160): a, c, t, g, unknown or other
  misc_feature (160)..(160): n is a, c, g, or t
  modified_base (201)..(201): a, c, t, g, unknown or other
  misc_feature (201)..(201): n is a, c, g, or t
  modified_base (265)..(265): a, c, t, g, unknown or other
  misc_feature (265)..(265): n is a, c, g, or t
  modified_base (522)..(522): a, c, t, g, unknown or other
  misc_feature (522)..(522): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcggtgggcccttttcngccctgactcagcctgcctccgtgtctgggtctcctggacngtcgatccaccatggcctgacactcggaaccaacgtgtgtattggttgggttatttttagtttnttcctccgtagtacctacaaccgcccggacgaaccgacccctaaactatcctaatttacgaggaactacgtaacggccggtccggttacgggggtttacacggtcgtaccttcgtcgttcggccttccgaagttccgtcggaacctaaacgtcccggtcccgtaccctgaacctacgttccttaccggtgggtcctccgacggtccgttacgacgggaacgtacggtccttaggttaacgttttaagtttcggtttnttaccggtccttacttacggttacgttcggaaccgtacgggtacctacggtccgttaacggtttcggggtccgtttcgggggaaccgggtacgggtaccgtcgggttacgtacccggttcggtagtaccgtaccgaccggtaacggttccgtcccggtaccccgttcggtaccgttacccttccgttaccctccccgtacccgtcccgttcgtaccccgg

SEQ ID NO: 290182 - DNA, 598 bp, Homo sapiens
  misc_feature: GYAE6OF02GU487.45.38.D05.1.454.CMB.1.raw
  modified_base (230)..(230): a, c, t, g, unknown or other
  misc_feature (230)..(230): n is a, c, g, or t
  modified_base (313)..(313): a, c, t, g, unknown or other
  misc_feature (313)..(313): n is a, c, g, or t
  modified_base (474)..(474): a, c, t, g, unknown or other
  misc_feature (474)..(474): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtnactccatcagtagtagtcataagtttggggctgggtccgccacgcccccagggaagggctggagtggattggactgtctactntagtggacctactattacacgtccccgtcctacaagactcgactggtcgatctacaataaaccacgtaccaaagaaccctaacttcctacccgtacgacgctacggaactctacgtcgacccgccgacggaccgacggaacctaaagttacttacgtgtanaccgaagacgagggcctaggtaattacttaccgttacgaccgtacgtcggggcctacgggaccctggtccaccgtctccctcgacgccctaccgaccgtaacggccctacgttccgttaccccg

SEQ ID NO: 290183 - DNA, 811 bp, Homo sapiens
  misc_feature: GYAE6OF02HECSA.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagtaccctgtcccctcacttgcagtgtctctggtgacctccatcagtagtagtacaagttaaagttttcggggtcttcggggtcccgaccgacggaccccccgagggggaacgggggtcgtcgggaggtcgggtagttcggggtacgtcggttccgttaacttccgttaagggtaccggggtacccctaacccgttacgtttaaccgacggtacccccgttaccccgtaccgtaaacggtacctcggtaccgttgggtacgagttacctacaaaactaaaaccgtaaccgtacctaaacgtaaacctaactttcctcccgtcgacgggtccttcgaaccttcgtacggttacggaccccggccggtaccgggaccgaaccggaccgtaaaacttacgtttaacgttcgtcggtaactaacgggaacggtacgggtacccgttagggtaacgtttacctttccggtttcgaacccgtaccgttaccggggtcccggttaccggggtaaccccgttcgggtacccgtacccggttcccgtacccgttcgacccgtcccctaccccggaccggaaccgggccccttacgggtccccgttacccgttccccccgtccggg

SEQ ID NO: 290184 - DNA, 756 bp, Homo sapiens
  misc_feature: GYAE6OF02I0BIW.45.38.D05.1.454.CMB.1.raw
  modified_base (164)..(164): a, c, t, g, unknown or other
  misc_feature (164)..(164): n is a, c, g, or t
  modified_base (193)..(193): a, c, t, g, unknown or other
  misc_feature (193)..(193): n is a, c, g, or t
  modified_base (245)..(245): a, c, t, g, unknown or other
  misc_feature (245)..(245): n is a, c, g, or t
  modified_base (481)..(481): a, c, t, g, unknown or other
  misc_feature (481)..(481): n is a, c, g, or t
  modified_base (498)..(498): a, c, t, g, unknown or other
  misc_feature (498)..(498): n is a, c, g, or t
  modified_base (524)..(524): a, c, t, g, unknown or other
  misc_feature (524)..(524): n is a, c, g, or t
tcagacgcgatcgacacgaccggtgctcgatttagtatctgatagttgggtttggggggggtcacaagaggcagcgctcgtcgggacgtctccaccatggcctgggctctgctgctcctcactctcctcactcaggacacgaggactcggtcggtcccttttcncgaccctgactcagcctcgcctcgtgtcnggtctcgaggacagtcgactccgacgatggcctgcacgacggaaaccaacgngtacgtagttgggttagggttatttttacggtttcgttactaccgtacggtacaaaccgaccggacccggacgaaccgtacccctaaaagtactaacgttacctttaagcggtaactacggtaacggtccggtacccggttacggggttactacggtaccgtcttctacggcgtacctctaacgtcgtacgaacaacgtccggtccttccgacgtactactcgttacgcgctacgnggctcgacggaccggtnacggttatagttcgtttctacggttntcctaggtaacttcgtacggtaaaccggcggttaacgaccgttaacggttgggttttacgggttacggggttcccggaaacggggttccgggttaacgttacccgggtacggttaaccgggtcccggtaagttaccggaaccggtcccggtaaccggtcccggttccgtaccccggtccgttaaccgtccgtttccggtccaacccccgggtttcctaccttacgggtcccg

SEQ ID NO: 290185 - DNA, 680 bp, Homo sapiens
  misc_feature: GYAE6OF02FJPDF.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtcgtctctggtgactccatcagtagtagtcattaaagttttgggctggtccgccacgccccgagggacgggctggagtggagttgggactgtctactcgtagtcgggacctacttataccacgaccccgttcctacgaacgaccgtacgacgtggtcgaactcctactaaactaaaacacgtaccgtaaacgaacctaaacttcctacccgtggaacggtctacgtaacttcgtacgtcgacccgtcccggacgaaccgaccggaacctaaagttactacgtgtacgacgaaggacggtacggaccgttaggtaattacgttaccgttacgaccgtacggtcgggccgtacgggtaacccgttcggaccgaaccggttcctacccgtaccgaccgttaccctaccccgaaccgtaacccggggccccttaacggtccccggtttacccttacccccgtaccgg

SEQ ID NO: 290186 - DNA, 892 bp, Homo sapiens
  misc_feature: GYAE6OF02G2CC8.45.38.D05.1.454.CMB.1.raw
tcagacgcgatcgacacgaccggtgctcgatttagtatctgatagttgggtttgggggggggtcacaagaggcagcgctctcgggacgtctccaccatggcctgggctctgctgctcctcactctcctactactccaggacacgaggtagtccggtcgggtcccttttcgcgcccgttgtacttcgacgtcctcgtcccttccggttgttccggttcgggttcctccggttacggactacggtcctaactccaccgtagtcgggcctcgaccgtaccggtacgaaaccctaagcggtagtagtttggggttagggtttaggtttttagttttcgtactccgtacggtaaccaaaccgaacccgtacccggaaccgacccgaaccccctaaaacttactactaacgtttaacgacggtaaccgtaacgtaaccgggccgggttacccggttacgggggtttaccgaacgttaccgttcgtttcgtccgttcggtacccgtaccgtaacggtcggttacggaaccgtaaccgtaccggtacccgttcccggtacgtactaacgttccgtcggtcggtacctccgacgttaccgtcggacggtacggtacgtcggttacgtttaacgtttcgttttacgttcggttctcgttacctaatttcggtacggacggtaacgggtaccgtacgtacgttacgggtttacggggttcgggtaccggggtcggggtaacgggtaacccgtttcgggttaacccggacccgtttaccgggtacggtaccgtaacccgggtacggtaacccgggttacccgttccccgggtccccgtttacggacccctttaccggtttcccgttaacccccgttccgtacccccgttcggttaccgtaccgg

SEQ ID NO: 290187 - DNA, 557 bp, Homo sapiens
  misc_feature: GYAE6OF02G2XAQ.45.38.D05.1.454.CMB.1.raw
  modified_base (158)..(158): a, c, t, g, unknown or other
  misc_feature (158)..(158): n is a, c, g, or t
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
  modified_base (264)..(265): a, c, t, g, unknown or other
  misc_feature (264)..(265): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (408)..(408): a, c, t, g, unknown or other
  misc_feature (408)..(408): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggcccttttntgccctgactcagcctgcctccgtgtctgggtctccgtggacngtcgatcaccatcggcctgcactggaaccngcagtgatgtggattatactgtctctgtaccanncaccagcaacgccccaancatgattagngaggcagtagcgcctcgtagggtttcaatcgtacttctcgtggcctctaagtctggacaacgacccggcctccctgacctaatcctcgtcgggcctccgaggtctggacggacgnggtctaggtattacgttacgtgcttgctctatatcgtcgtaggttacgtacgtttacgtttggtcggtacgggtacggacggacctaggtcgtaccgtaccggtcctaggtccgaacgcccgtaaggccctccggtccccgtagtcccg

SEQ ID NO: 290188 - DNA, 591 bp, Homo sapiens
  misc_feature: GYAE6OF02FT8B4.45.38.D05.1.454.CMB.1.raw
  modified_base (360)..(360): a, c, t, g, unknown or other
  misc_feature (360)..(360): n is a, c, g, or t
  modified_base (394)..(394): a, c, t, g, unknown or other
  misc_feature (394)..(394): n is a, c, g, or t
  modified_base (447)..(447): a, c, t, g, unknown or other
  misc_feature (447)..(447): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctccggatgcgtcctgtcccagctgcacctgcaggagtcgggcccaggactggtgaagccttcggagaccctgtccctcacttgcagtgtctctggtgactcatcagtagtagtcataaatttggggctgggtccgcacgcccccaggggaaggggctggagtggagttgggactgtctactctagtgggaccactattacacgcccgtcctacaagactcgactggtnatctacaataaacacgtaccaagaacctaattcncctgacggctagaactctgtcgaccgccgcggacacggaccaaattacttacngtcgacgaagagacgggcctaggaacttacgtccgtttagaccgtacgtcggggacccgttcgggaacccttcgggtaccaccggttcctaccgttccgaccgtaccctcccgaaccgtaccgggccctagtacccggttcccc

SEQ ID NO: 290189 - DNA, 893 bp, Homo sapiens
  misc_feature: GYAE6OF02F8VWY.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcgcctcccggatgcgtcctgtcccagctgccaccgtgcaggacggtccgggcccgaaggacgtgggtagaacggtcccgttcggacgaccccgttcgtccccgttcacttcgctaggttcgttccttcgtggtacgtacctacctatacgtaacgttacggttagttaccgtaaagttttaaggttttcgggggtacgttccggggtcccgcccgaaccggacccccgggtaaggggaacgggggtccggtagggtacgggttagggtaacggtttcgggaaccgtttcggtaaccttaccggtttacggtacgggtaccggtaaccgtaaccgtttacgttacccgtaccggttacccccggttaccccgttacgtaaaccggtaccgttacggtaaccggttcggtacggttacttaccgttaaccgtaaaaccgtaaaaccgtaacccgtaacccgaaaacgtaacccgttaacgtttacccgtacccgtaggtaccggtactaacgttaacgtcgttacggtaccgggacccgtaccgggacggtaacgaaccgacgttaaacgttacgtacgtgacgtacggaagtaccgggacggttaccggaagtttaccgttacgttaccggttaccgtacccgtagggtcccggggtaccgttacgggacccgtttcggacccgtttacggtcccttacccgcgttacccgaccctccggtaaccgtcccggtaccgtacccggtcccgttaccccgtcggtaacccg

SEQ ID NO: 290190 - DNA, 926 bp, Homo sapiens
  misc_feature: GYAE6OF02I6K6Z.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttacgggagaccctgtccctcacttgcagtgtctctggtgactcatcagtagtagtcaagttaaagttttggggcgttcgggtcccgccacgtaccccccgaggggaacggggcgtgggtaacggtgggtaacgttgggggaacgttcggttacgttaaccgttaccggttaagggttaccggggaaccctaacccggtttaactttaaccggtaaccggtaccccccgggtttaccccttaccgtaaaaaccgggtaacccttaccggggaaccgttagggggttacggtaactttacccgttaaccgtaaaaacttaaaaaacccgtaacccggttaacccgaaaaacggtaaaacccctaaaacttttacccgtacccccggttaagggaaccggtacgttaacggtaaaaaccgtttcccgttacgggtaaccgggaaccccgggtcccgggaccggggtaaacccgtaacccgggaaaccctaaaaacgtttaacgtttaccgttaggacgtaaccgtaaaggaacgggtacggggacccttaagggtaaacttttaccgttacccgttttacggaacccgttaacggggttccgggtaccgttacggggtaacccgttcgggttaccctacccggtttccctaccgttaaccgcggttaccccctaaccggtaacccggtaaaccgggtccccgtaacgttcccgggttacccccttcccccggtaccgg

SEQ ID NO: 290191 - DNA, 755 bp, Homo sapiens
  misc_feature: GYAE6OF02HMDJ9.45.38.D05.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (278)..(278): a, c, t, g, unknown or other
  misc_feature (278)..(278): n is a, c, g, or t
  modified_base (720)..(720): a, c, t, g, unknown or other
  misc_feature (720)..(720): n is a, c, g, or t
tcagacgcgatcgacacgaccggtgctcgatttagtatctgatagttgggtttgggggacctcctgtgcaggaacatgaagcacctgtggttcctcctcctgctggtggcggctcccggatgcgtcctgtcccagctgcacctgcaggacgtcgggcccaggacgtggtagaacgtccgttcggacgacccctgtcccctanaccttgacgngtgtctcgtagggcacttccaagtctaggtacgtagtactagttaaagtttcggggctcgggtacnccaacggcccgaaggggaacgggcgtaggacgtggagttcggtacttgtactacgtcgtagggtcggaacctaacttacgtaacgaccgtaccccgttacccagtaacgacttacgacgtgggttacaacctttacaacctaaaataaaaccgtccggtaaacctaaaaccggaaaccttaacgtttacccctacgtacgtaacggtcctaaagtaaccgttccgtacgcggtaacccggaccggtcggtaaccgacggtaaaccctaaaagttacgttaagtcggtagaaccgtaagacggtacggtactaggtaacttacgttcgttaaccgaccgtacggtacggaccgttaaccgggacctacgtaccgtaacccggtctaccgtacgaccgtaccctaccgacggaactccccgagtccccgttccttaaccccggngtaccctaccccgtaacgtccaaccgtcgtaaccg

SEQ ID NO: 290192 - DNA, 795 bp, Homo sapiens
  misc_feature: GYAE6OF02IBFV9.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtgcggctcccggatgcgtcctgtcccagctgcacctgcaggagtcgggcccaggactggtgaagccgttcggagaccctgtcccctcacttgctagtgtctctggtcgactccatcagtagtagtacagttaaagttttggggacgtcgggtccgaccgtacgcccccgaagggggtaacgggtctagggtaacggttgggagtttcggggtacgttcggttacgtaccgtacgtaggtccggggaaccctaacccgttagttaaccgtaccggtacccccggtccctacgtaaacggtaacctccggtaaccgttgggtacgtaacttcgtaacaaaacgttaaaccgtaccgtaaccctaaacggaaaccttaactttcccgtaccgtaggacggtcctacgtaaccgttcgttacggtacggacccgacccgggtaccgggtaaccgtaaccgggaaccctaaaatttaccgttaacgtacggtcgaacgtaacgggagaaccggggttacctaacgggtaaatttaccgttacccgttttacggaacccgttaacgggttcggggacccttaccggggaaccctttcggacccgttacccgtccgtacccgttacgacccggtcctacccgaaccggtaccggcccctaacggtccgttacccccg

SEQ ID NO: 290193 - DNA, 802 bp, Homo sapiens
  misc_feature: GYAE6OF02F22OV.45.38.D05.1.454.CMB.1.raw
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggtccctttctgccctgacctcagcctgcctccgtgtctggtctctggacagtcgatcaccatcggcctgcactggaaccaactgtgattggttgggttagtttttagttttcgtctccgtaggtaaccaactaacccgaccccggacgaaccgaccccctaaataactacctaatttaacgacgggtactaacgtaacggccggtcccggttcgggggtttacaacggttcgtacctttctcgttcggtcctaccgtaacgttccgtacggtacccaaacggtacccggtacccttaccccgtacgtaacctaacgttccgttaccggtacggggtaccctacccgggaggtaccgttaccggaacgggtaccggacgggtcttacggttactttacgtttcgttcggtttacgtccttacgtacgttacgtacggtaccgaacgggtaccgtacgaccgttaacgggtttcggggtccggtttacggggtacgggtaaccgggtaccgggttacggttaccggtaacccggttaccgtaccgggttaccgaccggtacccggtaacggttcccgtaccccggtccccgttacggtacccttacccgtttccgttaccccggttacccctacccgttcccgtcccgttaccgg

SEQ ID NO: 290194 - DNA, 808 bp, Homo sapiens
  misc_feature: GYAE6OF02IKNVE.45.38.D05.1.454.CMB.1.raw
tcagacgcgatcgacacgaccggtgctcgatttagtatctgatagttgggtttgggggctttctgagagtcacggacctcctgtgcaggaacatgaacgcacctgtggttcctcctcctgctggtggcggctcccggatgcgtcctgtcccagctgcacctgcaggacgtccgggcccaggactgggtgaacgcctttcgggacgacccttgtcccctcacttgctagtgtcctctagggtgacctcactcgagtagtagtactaattaaaggtttttggggacgttcggggtccgtcccgaccggccccccgaagggggaacggggcctaggggtacggtagggtacgtttcggggacttcggttcttacgtacgttagggtcgggacctaaccgttattaaccgaccgtccccgttacctcgaaacgtacctcgaccgtggtacgtacttactactaaacgtaaaaccgtaaccgtaccaaaacgtaaacccttaactttacccgttacccgtaggacggtacgttacgtaaaccgttccgttacggtaccgtacccggtccgggaccggaaccgaaccgggtaacctaaattacgtttaacttggaacgtacgtaacggaagggacggtcgttaaggtactttactccgtttacgaccgtacggtcgggtaccgtacgggtaacccgttggtacccgtaccgttcccgtaccgtacccgtacccgaccccgtaacccgaacccgggaacccgggttacccgttacccggttccccgggtttacccccgttccccgttacccccgg

SEQ ID NO: 290195 - DNA, 818 bp, Homo sapiens
  misc_feature: GYAE6OF02GUS7N.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagtcccgttcggacgaccccttgttccccctacgtacgtttcgcctaggttcgttccttccgtgggtcgacctcccatcgaaggttagtacgttacaagtttaaaagtttttggggcgttcggggtcccgccgaacggccccccgaagggggacggggtaccgttgggaggtggtaggttcgggacgttcgtactacgttcgtagtcgggaacctaccgtaattacgacgtccccgtaccctacgaacgtaccgtcgtacgtggtcgtactacgtacaaagtaaacgaccgttaccaaacgaaacctaacgttcctacccgtagtacggtaccgtaacgtactcgtacgtaccgaccggaccgtccggaaccgaaccggtaacctaaacgttaacttaacgtacgtacgtaacgaacggtaacggaaccgggaccgttaacggttaacgtttaccgttaccgtttaaccgtacccgttaccgggtaccgggtacccgtaccgggttaacccggttaccggtacccgtaacccgttcccggttacccgtacccgtaaccgtaccccgtaacccggtaacccggaaacccgggttttttaccccgacccggttaccccggtttaccccccgg

SEQ ID NO: 290196 - DNA, 686 bp, Homo sapiens
  misc_feature: GYAE6OF02HLDN6.45.38.D05.1.454.CMB.1.raw
  modified_base (155)..(155): a, c, t, g, unknown or other
  misc_feature (155)..(155): n is a, c, g, or t
  modified_base (167)..(167): a, c, t, g, unknown or other
  misc_feature (167)..(167): n is a, c, g, or t
  modified_base (179)..(179): a, c, t, g, unknown or other
  misc_feature (179)..(179): n is a, c, g, or t
  modified_base (237)..(237): a, c, t, g, unknown or other
  misc_feature (237)..(237): n is a, c, g, or t
tcagacgcgatcgacacgaccggtgctcgatttagtatctgatagttgggtttgggggtcacaagaggcagcgctctcgggacgtctccaccatggcctgggctctgctgctcctcactctcctcatcaggacacaggactcgtgggcccttttntgccctgactcngcctgcctcgtntcgtggtctcctggacagtcgatcaccagtcggcctgccgtagtacggaacctaacgngtagtagttggttaggttgtttttagttcgtccttcgtcggtaaccacgaaccgacccggacgtaaccgacccctaaatactactattagtacgactaacgtacgccggtccgttggggttacacgttcgtctgtcgtcgctacgtagtcgtcgaccacgaccgtccttaccgacgaactacgtccgtacggtcggtaccgtcgaacggttcgacggacggtaccggtacgttacctaggttaactttacgttacgtcgtaccgtcgtacttacgtatacgtagtccggttaaggttgttaaccgtttcgtttgggtacgtcgggtaacggacggtaccgaactccggtaacgtccgtaaggtccgtacgacccggtaccgacggtcccgtacccgtcccgtagtcccgtacgttcccgttcccggttaccccctccgttacgttcccg

SEQ ID NO: 290197 - DNA, 759 bp, Homo sapiens
  misc_feature: GYAE6OF02G0GES.45.38.D05.1.454.CMB.1.raw
tcagacgcgatcgacacgaccggtgctcgatttagtatctgatagttgggtttggggatgctttctgagagtcacggacctcctgtgcaggaacatgaagcacctgtgttcctcctcctgctggtggcggctcccggatgccgtcctgtcccagctgcacctgcaggagtccgggcccaggctgggtgaagtccgttcggacgaccccgttcggttcccctacctactttcggcctacggttcgttccttcggtgggtcacctccactacaggttacgtagtactaagtttaaaggttttggggcgtcgggttccgcccacggcccccggaaggggacggggcgtgggacggttgggtaggttcgggacgttgtacgttcgtacgtacggtcggaccctactacttacgaccgccccgttacctacacgtacctacgacgtgggtatactacgtactaaacgtaaactacccgtacctaaacgtaaacctaactttacctacccgttaggacggtctacggtaacttcgtacgtccggacccgaccgggaccgaccgtaaccggaactaaactttacgttaacctcggtacgaagtaacggacggtaacgggtaccgttaaggtaacttttacgttccgtttaaccgacgttacgggtcgggtccgttaccgggtaccgtcggtccgtacccgttccgtccctaccgaccgtaccgtacccgaaccggacccggtcccgtaaccgttcccgttaccccg

SEQ ID NO: 290198 - DNA, 795 bp, Homo sapiens
  misc_feature: GYAE6OF02I2BTA.45.38.D05.1.454.CMB.1.raw
  modified_base (212)..(212): a, c, t, g, unknown or other
  misc_feature (212)..(212): n is a, c, g, or t
  modified_base (574)..(574): a, c, t, g, unknown or other
  misc_feature (574)..(574): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaacgtccttcggacgccctgtcccctnacttggcctagtgtctcgtggtacgaccttaccatacgtaaggtagtacgttactaaagttaaaagttttcgggggtcgttcgggtcccgacccgtaacccgaccccccggaagggggtaacggggtaccgtgggaggtagggtagttaggggtacgttcggtccttacgtcgtaggtaccggtaacctacccgtttacttaaccgtaccggtacccccgtcctacgaactaccgtccgaacgttaggtgtaactctaacgtaaactaaaaccgtaccgtaaccgaaacaaaacccttacttacccgtacccgtaggaacggtaccgtacgaccttacgtaggtacccggaacgaccccggnggaaaccgtaccgaacctaaattaacggtacgttacgagtaccgaaaggacggtacggtacgtaacggttactaccgttaccgttacgaccgtaacgggtacgggtcccgtaccggtaccccgtgtaccctaccgtcccgtaccttacgcccgtacccgtaaccgaacccggtaacccgggtcccgaacccggttcccggttacccgttcccggtacccgg

SEQ ID NO: 290199 - DNA, 642 bp, Homo sapiens
  misc_feature: GYAE6OF02FVDRX.45.38.D05.1.454.CMB.1.raw
  modified_base (196)..(196): a, c, t, g, unknown or other
  misc_feature (196)..(196): n is a, c, g, or t
  modified_base (273)..(273): a, c, t, g, unknown or other
  misc_feature (273)..(273): n is a, c, g, or t
  modified_base (369)..(369): a, c, t, g, unknown or other
  misc_feature (369)..(369): n is a, c, g, or t
  modified_base (390)..(390): a, c, t, g, unknown or other
  misc_feature (390)..(390): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctccggatgcgtcctgtcccagctgcacctgcaggagtcgggcccaggactggtgaacgccttgganccctgtccctcacttgctagtctctcgtggtcgactcatcaggttagtagtacaattaagtttgggcgttcggtccnccgaccgccccggaagggacgggtctaggacgtggtagttgggacttgtactacgtcgtaggtcggacctacgttacgtacgacgtccctccgtanacgtaccgtcgtacgtcggtnactctaacaactaacgcgtacaaacgaacctacgttcctaccgtgacgtctacgactgtcgcgccgcgacgacgacggaactaagttactacgtgacgacgaagacggacggtaccgtagtacgttactccgtttacgaccgttgtcgggtacgtaccggtaccgtgtaccgtaccgttccgtaccctcgaaccgtcccgtaaccgaccggtaccggacccgtacgttccccgttaccgtacccccgtccgg

SEQ ID NO: 290200 - DNA, 1117 bp, Homo sapiens
  misc_feature: GYAE6OF02IJ04X.45.38.D05.1.454.CMB.1.raw
  modified_base (228)..(228): a, c, t, g, unknown or other
  misc_feature (228)..(228): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggcctccggatgcgtcctgtcccagctgcacctgcaggagtcgggccaggactgggtgaagtccttacggacgacccgttcgtccccttcacttgctagtntcttcgtggtctacctcctactcagttaggtagttacgaaagtttaaaggtttcggggtcgttcggggtacccgtaccgaccggaccccccggtagggggaaacgggggtccgtaggggaggttagggtacggttttacgggggaccgtttcggtttaccgtaaccgtttccgggtaacgggttaccggggtaacccctaccgtttaaaccgtttaccggaacccggttcccccggttaccccgtaccgaaaccggtaccggtacccggtaacggtttcgggtaaccgttacgttacccttaaaccgtaaaaacccgtttaaaaacccgtaacccggtttaaaacccgtaaaaacccggttaaaaacccctttaacccgttttaccccgtttaaccccggtacggttaacccgggttaccgttaacggtaaacccgtttccggttaccggtaacccgggccccggtacccgggtaaccgggacccccgtaaccgggtaaacccgttaaaaaacgtttaccggttttaacccggttcggttaaccggttaacccggtaaaacggggtaaacggggacccgggggttaaccgttaacggggttttaaaaccgttttaaccgttttaccccgttttaaaccgggaaacccccgggtttaaccgggggttaaccccgggggttaccccgggttaaacggggtttaaccccccggtttacgggggttaaaccccccgttaccccgggtttcccctttaacccccgggtttacccggtaaccccggttaacccccgtaaccccggttaaacccccgggtaacccgggtacccccccggtttacccggttttccccgggtttacccccccggttaccccccgggttaacccccggg

SEQ ID NO: 290201 - DNA, 946 bp, Homo sapiens
  misc_feature: GYAE6OF02H538X.45.38.D05.1.454.CMB.1.raw
  modified_base (235)..(235): a, c, t, g, unknown or other
  misc_feature (235)..(235): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctgggtggcggcctcccggatgcgtcctgtcccagctgcacctgcaggagtccgggcccaggactggtgaacgccttcggagaccctgtccctacacttgcagtcgtctcgtggtnactcatcgagtagttagtctaagttaaagttttggggcgtcgggtccgccacgccccgagggaagggtcgtggagtggagttgggacttcggtactactacgtaacggtcggaacctaaccgtactttaccgaacggtccccgtacccgtacgaacgtacgttaccggacgttcgggtacgtacttaccttacgaaaaacgttaaaacctacccgggtttaaccaaaaaccggtaaaacccttaaaacgtttcccgtacccgttacgggtaacgggtaccttaacggtaaaccgtttaccgtaccggtttaccggaaccccgggacccggttaacccgggggaaacccgaacccggggtaaaaccccttaaaaagtttaaaaccgttttaccccggtttaggttaaccggggtaaaccgaaacgggtaaaccggggtaaacccgggggttaacccggttaaaccgggtttaaacgtttaaaccccgtttttaccccggttttaaaccggtaaccccgttaaccggggttaccgggggtttaccccgtaccggggggttaaaacccccgttcgggttaccccggttaaacccggttccctttaccccggtacggtacccccggtaccccgttaaccccggtaacccggaaacccggggtcccgttaaacccgggttttccgtttcccccggtttaccccccgttaccccggg

SEQ ID NO: 290202 - DNA, 871 bp, Homo sapiens
  misc_feature: GYAE6OF02GCZL1.45.38.D05.1.454.CMB.1.raw
  modified_base (396)..(396): a, c, t, g, unknown or other
  misc_feature (396)..(396): n is a, c, g, or t
  modified_base (491)..(491): a, c, t, g, unknown or other
  misc_feature (491)..(491): n is a, c, g, or t
tcagacgcgatcgacacgaccggtgctcgatttagtatctgatagttgggtttggggggggtcacaagaggcagcgctcgtcgggacgtcctccaccatggcctgggctctgctgcctcctcactctcctcactcaggacacgacgggaccgtcgggtccctttcgtcgcccgtgtaacctcacgcctcgcccttccgtgtcgtcggcctccgtaggactacgtcgataccacgtagtcgcctgactacgacggaaccactagtgagttggttggtttatttcggtttcgaccttccgtaacggtaaccaaacctaccggaaccccggtacaaaccccgtaacccaaattacgtactaagttacacggacaacgtacggccggtccgtgggttacncgttcgcctttcgaccgtcgtctacgtacgttgacggactaccgggcgtcccctacacgtaccgtctaccggtcgtaccggtaccaccgaccggnttaacggaccggtaacggtcgaacgttacgttttaacgtttacgttacggtcttaccgtaccgttaacgttaaaccgttcggtaacggtacccggtaaacggtaccgttaaacggtcccgggtttttgggaaccggggttcccggggttaacgggttaaccgggggtaaccggtaaccggggtttaaccgggttccccggggtaacccggtttaacaaccggggttaccggacccgtaaacgggtttacccgggcccccccggttaacggggttaaccccggtttccggtttaaccctcccggggtttaaacccttacccccccgggtaccccttttaacccggccccgtttaaccccccggttggttaaaccccccggg

SEQ ID NO: 290203 - DNA, 832 bp, Homo sapiens
  misc_feature: GYAE6OF02H2IDQ.45.38.D05.1.454.CMB.1.raw
  modified_base (745)..(745): a, c, t, g, unknown or other
  misc_feature (745)..(745): n is a, c, g, or t
  modified_base (755)..(755): a, c, t, g, unknown or other
  misc_feature (755)..(755): n is a, c, g, or t
  modified_base (824)..(824): a, c, t, g, unknown or other
  misc_feature (824)..(824): n is a, c, g, or t
tcagacgcgatcgacacgaccggtgctcgatttagtatctgatagttgggtttgggggacctcctgtgcaggaacatgaagcacctgtggttcctcctcctgcgtggtggcggctcccggatgcgtcctgtcccagctgccacctgcaggacgtcgggcccaggactggtagagtccttaggacgaccctgtccctctacttgcgtagtcgtcttcgtggtctaccgtcatcgtagttagttacgtactaaagtttaaagggttttcggggaccgttcggggttccccgaccggtaacccgggaccccccggtaaggggggtaaacggggggtccgttacgggggtaacgggttacgggtaacggtttacgggggtaacctttggttaacccgttacgtttaccggtaacgggttaccgggtaaccccttaacccggtttaactttaacccggaccggtcccccggttacccgttaaccgtaacgtaccgtaccgttaaccggttcgggttacgtaacgtaccgttaaaccgtaaactaaaacccgttaacccgtaaccgaaacggtaacccttaaccgtttacccgtacccggtaggacggtcttaacgtacttcgtacgttaccggaccgtccggaccggtacaccggaaataacgttcgttacgagtacgacgtaaggtaggcggtacgtacggtatttcgtacttacgaccgtcggtacggccgtacggtacgtcgttacncctcgtaccncgcttaccgaccacggtaccgtcctaacggttcccgtccctacccgtcgtccctacctccgtaccgacncgtacccg

SEQ ID NO: 290204 - DNA, 665 bp, Homo sapiens
  misc_feature: GYAE6OF02FZ4Z1.45.38.D05.1.454.CMB.1.raw
  modified_base (264)..(264): a, c, t, g, unknown or other
  misc_feature (264)..(264): n is a, c, g, or t
  modified_base (280)..(280): a, c, t, g, unknown or other
  misc_feature (280)..(280): n is a, c, g, or t
  modified_base (320)..(320): a, c, t, g, unknown or other
  misc_feature (320)..(320): n is a, c, g, or t
  modified_base (402)..(402): a, c, t, g, unknown or other
  misc_feature (402)..(402): n is a, c, g, or t
  modified_base (434)..(434): a, c, t, g, unknown or other
  misc_feature (434)..(434): n is a, c, g, or t
  modified_base (447)..(447): a, c, t, g, unknown or other
  misc_feature (447)..(447): n is a, c, g, or t
tcagacgcgatcgacacgaccggtgctcgatttagtatctgatagttggggtttgggggggggtcacaagaggcagcgctctcgggacgtctccaccatggcctgggctctgctgctcctcactctcctcactcaggacacagggtcctgggcccagtctgccctgactcagcctgcctccgtgtcgtgggtctccgtggacagtcgatccaccatctcctagcactacggaaccagcagtgagtggttaggtattactacttntctccgtagaccaacngaccaccgagaccaaccgaccccaaactctatatattagnggaggacagtacgcgtcctacgttaggttactagtcgtacttcgtcgtcgctcgtaagtcgacggacaaccgcgtccctccncgtaactacgtctcgtacggcctacgtcgcgnggacgggtaccgngggtactgttaacgtttacttagcgtcgtactaccgtgtaatggtacgtacgttaggttaacggtttaacggttggttttacgggtaccgggttacgggaaaccggggtacggtaaacccgtgggttaacccgtccgggtaacccggttacccggtaagtacccgggaaccgttcccggtaacggtccccgttaccccggtccccgggtactaccccg

SEQ ID NO: 290205 - DNA, 658 bp, Homo sapiens
  misc_feature: GYAE6OF02HAK5P.45.38.D05.1.454.CMB.1.raw
  modified_base (408)..(408): a, c, t, g, unknown or other
  misc_feature (408)..(408): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcggcccaggactggtgaagccttcggagaccccttgtcccctcacttgcagtgtcttcgtggtacgacctccaatctaggtagtagtctaagttaaagttttggggacgtcgggtccgacctacggccccccgaggggaaggggccgtagggaaggtcggtagttcggggtacttgtactacgttcgtaggtcggtacctacctactacgacgtcccgtccctgaacgctcgacgtggtntatctacaaataacacgtacaacgtaaacctacttcctacctgacgtctagtaacctcgtggtcgacccgtccggacgaccgaccggactaaattactacgtagtgacgaagcggtacgcgtagtattactcgttacgaccgtgtcgggccgtacggtacccgtcgtaccgaccgttctcccgtagtacccgtcccgtaccaacccgggacggtaccctcggttacccgttcccgttccccgttacccgg

SEQ ID NO: 290206 - DNA, 589 bp, Homo sapiens
  misc_feature: GYAE6OF02HHB4J.45.38.D05.1.454.CMB.1.raw
  modified_base (226)..(226): a, c, t, g, unknown or other
  misc_feature (226)..(226): n is a, c, g, or t
  modified_base (231)..(231): a, c, t, g, unknown or other
  misc_feature (231)..(231): n is a, c, g, or t
  modified_base (548)..(548): a, c, t, g, unknown or other
  misc_feature (548)..(548): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctcccggatgcgtcctgtcccagctgcacctgcaggagtcgggcccaggactggtgaagccgttcggagaccctgtccctcacttgcagtgtctntggtnactccatcagtagtatctattaaagtttgggctcgggtccgccacgccccgaaggggaggggcgtggagtggtagttgggactgtctacgtcgtaggtggacctacgtacttacgacgccccgtcctacaacgtactcgactggtctatcactaactaaacacgtacaaagaacctattcctaccgtagagtcgtacgactacgtgtcgaccggtccgacggacacgaactaaatcgtactagcgagaggagacgcgtagtacttacgtccttagaccctgtccggcgtacggacccgtggtccctaccgtctaccncgaccgtcctaccgaccgaacggtccctagttcccgtcccg

SEQ ID NO: 290207 - DNA, 832 bp, Homo sapiens
  misc_feature: GYAE6OF02JTJ6K.45.38.D05.1.454.CMB.1.raw
  modified_base (167)..(167): a, c, t, g, unknown or other
  misc_feature (167)..(167): n is a, c, g, or t
  modified_base (211)..(211): a, c, t, g, unknown or other
  misc_feature (211)..(211): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtggcggctccggatgcgtcctgtcccagctgcacctgcaggngtcggcccaggactggtgaagtccttcggagacccttgtccctnacgttgcagtgtctcgtggtcactccatcagttagtacgtctaagttaaagttttggggtacttcgggttaccgaccgaccggtaccccccgaagggggtaacggggtcgtggggtaggttagggagttacggggacttggtaccttaccgtacgtaaggtcgggaaccctaccgttaattaaccgaccggtccccgtacctacgaaacgtaccgtcgaccgttggggtctacttacgtactaaacttaaaccgaccgtaacctaaacggtaaacctaactttaccctacccgtagacggtacgttacgtaaactcgttacggttacgaacccggccggaccggtaacgaaccggtaacctaaattacgtttaaccgtcggttaacgaaccgtaaagggtacggaaccgggtaccgttaacgggttaaacttttaccgtttacccggttttaggaaacccgttacgggtttaccggggtaccggttaccgggttaacccgttaccgggttaacccggtaccggttttaccctaccccggtaccgttaaccggttccccttaaccggtaaccccggtaaaccgggttccccgtaacggtttcccccgggtttaaccccccgg

SEQ ID NO: 290208 - DNA, 894 bp, Homo sapiens
  misc_feature: GYAE6OF02HOK6U.45.38.D05.1.454.CMB.1.raw
tcagacgcgatcgacacgaccggtgctcgatttagtatctgatagttgggtttggggatgctttctgagagtcacggacctcctgtgcaggaacatgaagcgacctgtggttcctcctctgctggtgcgctccggatgcgtctgtccagctgcacctgcaggacgtccgggccaggactggtagaagtccgttcggacgacccctggtccctactacttgcagttcgtctcgtaggtcgacctaccgatacgtagtacgttaggtactaagtttaaaggttttggggtacgttcgggtccccgaccgtaccggacccccggaagggggtaaacgggtcgttacgggtaggttacgggtaacgttacggggtaccttacggtaaccgttacgttaccgttagggttaaccgggaaccctaaccgttaacgtttaccgaaccggtcccccgttacccttacggaaacggtaccgtaccgtaccgttgggtactacgtttaccgtacgtaaaacgtaaaccgtacccgttaaaccgtaaaccgtaaacccttaaagtttccccgtaaccccgtagggtaacccgtaccggtttaacgtaaccgttacgttacggttaccgggaacccggttcccgggaaccggtaccgaaccggtaaactaaacgttactttaacgtacgttacgaacggtaaacggtacggacgggttacctaagggttaactttaacccgtttaccggttacgtaaccgtaaccggggtcgggtacccggttacccgggttaaccgttcgggttaaccccggtaccgtttacccgtacccggttacgtaccgtaccccgttaacccgtaacccgggtaacccggtcccgttaacggtccccggtttaaccccccg

SEQ ID NO: 290209 - DNA, 679 bp, Homo sapiens
  misc_feature: GYAE6OF02GBRA7.45.38.D05.1.454.CMB.1.raw
  modified_base (202)..(202): a, c, t, g, unknown or other
  misc_feature (202)..(202): n is a, c, g, or t
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
  modified_base (495)..(495): a, c, t, g, unknown or other
  misc_feature (495)..(495): n is a, c, g, or t
  modified_base (531)..(531): a, c, t, g, unknown or other
  misc_feature (531)..(531): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacagggtactgggcccagtctcgccctgactcagcctcgcctcgtgtctcgggtcctcgtggacngtcgaactcactactcctccngcctacgagaaccngcagtgtagttggtaggtaattactacgttcgtctcctacggtaccaacgacgaccacctaacggaccaaacccgtacccctaaagtccaagttcgtattagacggacggactaacggtaccgccggtccgttaaggtacggtttataccgtccgttcttccgtggtccgtacctacgtacgtcgacgtaaccacgtcccggtaccttaccggactaactacgtccgtgtcggacctcggaacgcgtacgcggtaacncggtctacgttatttacttcgtacgtctctaacgtnttacggcgtacgaccgtacgcgttacgtcgggttcgggtaacgggtccgggacgggtacgtaccggtaaggtcccggtaacccggtcggtaaccgtcgaaccggtaccggtccgtacccggtcccgtaccccggtccgtgtttacccc

SEQ ID NO: 290210 - DNA, 682 bp, Homo sapiens
  misc_feature: GYAE6OF02GDDWH.45.38.D05.1.454.CMB.1.raw
  modified_base (235)..(235): a, c, t, g, unknown or other
  misc_feature (235)..(235): n is a, c, g, or t
  modified_base (263)..(263): a, c, t, g, unknown or other
  misc_feature (263)..(263): n is a, c, g, or t
  modified_base (280)..(280): a, c, t, g, unknown or other
  misc_feature (280)..(280): n is a, c, g, or t
  modified_base (308)..(308): a, c, t, g, unknown or other
  misc_feature (308)..(308): n is a, c, g, or t
  modified_base (495)..(495): a, c, t, g, unknown or other
  misc_feature (495)..(495): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtcgggtccctttctgccctgactcagcctgcctccgtgtcgtcgggtctccgtggactagtcgatcaccatggcctcgcactggaaccngcagtgatggtggtagttaataccgttntctccgtagtaaccacncgccaccgaggaccaaccgccccaaacncattagtattactggaggacgacgtaacgccggtcccgtacgttaggggttacttactccgtactttcctcgtcggcctacgacgtcgtacggacaacctaccggcccttccgtacgactaccgttctcgtacggcctaccggcggtacgtaggaacgtacgcggtactacgttactttacgttacncgtacacggtacaatacttaacgttatttcgtttcgttaccgttaccgggttcgggttagtaccggggtaacggtaccgggtaccgtaacggtttcccgggtaacccggttcggttaccggaccgtacccgggtaccgtaacggtccgtccccggttaccccgacggttccttacccgtttccccgg

SEQ ID NO: 290211 - DNA, 291 bp, Homo sapiens
  misc_feature: GYAE6OF02IA9OM.45.38.D05.1.454.CMB.1.raw
  modified_base (255)..(291): a, c, t, g, unknown or other
  misc_feature (255)..(291): n is a, c, g, or t
tcagacgcgatcgacacgaccggtgctcgatttagtatctgatagttgggtttggggggtgtggtggtctccactcccgccttgacgaggctgattatttctgttgctcatatgcagggaccagcacgttgggtgttcggcggagggaccagggttgaccgtcctaggtcagcccaaggctcgccccctggtcactctcgttcccaccctcctctcgatcgcgtctggagcgggctcggacgaacggcgcatagnnnnnnnnnnnnnnnnnnnnnnnnnnnnnnnnnnnnn

SEQ ID NO: 290212 - DNA, 732 bp, Homo sapiens
  misc_feature: GYAE6OF02HDSWJ.45.38.D05.1.454.CMB.1.raw
  modified_base (356)..(356): a, c, t, g, unknown or other
  misc_feature (356)..(356): n is a, c, g, or t
  modified_base (374)..(374): a, c, t, g, unknown or other
  misc_feature (374)..(374): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccagggactggtgaacgccttcggagaccctgtccctctacttgcagttgtcttctggtcactccatcagtagtagtcaattaaagttttgggctgggtccgcacgccccgagggagggctggagtggagttgggactgtactactctacggtcggacctactattacacgtccccgtcctanaacggactcgacgtaggntaactcctaacaaataaaacgtaccgtaacaaagtaaacctaacttccgtacctaggacggtactaacgaaccttcgtcggtacggacccggacccggaccggaaccgaaccggtaacctaaaagtttaacgttaccgtaggtacgaagtaaacggaacgggaacgggtaccgtaacggttaaacttttaccgttaccgttttaacggaacccgttacgggtaccggggtaccgtaaccggggtaaccccgttggtaacccgtacccggttcctaccctaccgaacccgtaccgtaacccgaaccggtaacccgggacccttaaccggttcccggttaccccttacccccggtaccgg

SEQ ID NO: 290213 - DNA, 731 bp, Homo sapiens
  misc_feature: GYAE6OF02GD47P.45.38.D05.1.454.CMB.1.raw
  modified_base (165)..(165): a, c, t, g, unknown or other
  misc_feature (165)..(165): n is a, c, g, or t
  modified_base (428)..(428): a, c, t, g, unknown or other
  misc_feature (428)..(428): n is a, c, g, or t
tcagacgcgatcgacacgaccggtgctcgatttagtatctgatagttgggtttggggatgctttctgagagtcacggacctcctgtgcaggaacatgaagcacctgtggttcctcctcctgctggtgcggctcccggatgcgtcctgtccagctgcactgcaggngtcggcccaggactggtgaacgccgttcggagtaccctgtaccctcactttgctagtcgtctcgtggtcgtacgtccaatccgaagttagtacgtacctaagttaaacgttttcgggcgttcggtccgacctaccgcccccggaaggggacgggacgttggaaggtggagttcgggacgttcggtactacggtcgtaggtcggtacctactactacgacggtcccgtacccgtactaactacgtcgtacgtaggtcgtacgtnaacgtaaactaacgtacgttaccaaacgtaacctacgttacctaccgagtccgacgttacgtactcgtgttacggacccgtccggtaccgaccgtaccggaaccttaaaagttcttaacgtacgtacgaacggtaaacgtacggaccggggttactaagggttaacttacgttaccgttcggtaaaccgtcggtacccgggtccggtaccgggtacgttccggacccgttacccgccgttacccaccggtaccgtacccgacccgtaaccggtaaccctcccgttacggtccccgttaccccg

SEQ ID NO: 290214 - DNA, 969 bp, Homo sapiens
  misc_feature: GYAE6OF02IOLZH.45.38.D05.1.454.CMB.1.raw
tcagacgcgatcgacacgaccggtgctcgatttagtatctgatagttggggtttggggggggtcacaagaggcagcgctctcgggacgtctccaccatggcctgggctctgctgctcctcactctcctcactcaggacacaggatcgtgggccctttctcgccctgactcagcctgcctcgtgtcgtggtctccgtgacagtcatcacagtcggcctagacacgtacggaaacacgtagtacgtagttggttagggttagtttttcgttttacgtcgttaccgttacgggtaacccaaaaaccgtaacccgaacccccgggtaacgaaaccccgtaaccccgtaaaaacttaactacccgttaaaggttttaaccgaacggggtaactaaacggtttaaccggccgggtaccccggttaacgggggtttacaacggttccgtacgtttacgcggttacggtacctaacgtaagttccgtacgggaacctaaccggtaccggtaccctaccccgttaggtaaacctaaccggtttcgttaaccggtcggggttacccctaacccgggacgggtttaccgaaccgggacggggttaaacaccgggtttacgtgttaaaacttttcggtttaccggttacgtccggttacctaaacggttcgtttaaagtaccgggtaacccggtaaaccgggtaccggtacgttacgggttaaacccgggttgggggtttaaccggtccgggggtaaccggtaaccggggtaccgggtttaaaaccggtttcccggggaaacccggtttaacggtttaccgggaacccgttacgggaaacccccccgggttaaacgggtccccccggtaccccgggttttaaacgaccccggttttaaccccgggtttaccccggttcccgtttaaaccccccggggtcccctttaacccgggttttaccccgaaacccgggtttcccggg

SEQ ID NO: 290215 - DNA, 931 bp, Homo sapiens
  misc_feature: GYAE6OF02IOT2K.45.38.D05.1.454.CMB.1.raw
  modified_base (165)..(165): a, c, t, g, unknown or other
  misc_feature (165)..(165): n is a, c, g, or t
tcagacgcgatcgacacgaccggtgctcgatttagtatctgatagttggggtttgggggctttctgagagtcacggacctcctgtgcaggaacatagaagcacctgtggttcctctcctgctggtggcgctccggatgcgtcctgtccagctgcacctgcgaggngtcggccaggactggtgagccttcggacgaccctgtccctcacgttgaccgtagttcgtaccgttcgtgggtcgtaccttacactacgtaaggttacggtacgtaccgtaattaaaggttttcggggacggttcgggtacccgaccgaaccggtcccccggaagggggtaacggggtacgtcgggacggttagggtacggttacggggtacttcggttacctaccgttcggttaacgggtaccgggtaaccgtaccgtttaacttaaccggtaacccggtccccgttacccgtaacgaaaggtaccgttacggtaacgtcggttacgtacttaccgtaactaaaacgtaactaccggtaaacctaaaacgtaaacccttaacgttacccgtacccgttaggtaccggtacttaacgtaaaccgtttcgtaccggttaaccgggaccccggtccgggtaaccgggtaaccgtaaacccggaaccttaaaagtttaccggtttactacggggttaacgaccgggaaagggtacgggtaaccggggttaccgtaagttaaacgtttacgtttacccgtttaacgggccgttaaacccgggttcggggttaaccccgggtaaccggttaacccgggttcgggttaacccgttacccggtccccgttaaccggtacccgttaacccggtaccccgtaaacccggtaccccggtaaacccggggtaccccgttaacgggtttcccccgtttaccccggtaaccccgtcccgg

SEQ ID NO: 290216 - DNA, 1076 bp, Homo sapiens
  misc_feature: GYAE6OF02JCPX8.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcggccaggactggtgaagtccgttacggacgacccttgtccccttatacttggctagttcgtcttcgtcgggtagaccttccgtaatcgtaaggttagtacgttactaagtttaaacggttttggggcgttcgggtcccgccgtaccgacccccggaaggggaacgggtcgttagggtaggtaggtagttacggggaccttcggtacttacgtacgttacggtccgggacctaacgttagttaccgaccggtcccgtaccctcgtaaacgtccgtacggacgtttcggtctacgttctaacgaaacgttaaaaccgaccgttaaccgtaaacgaaacccttaacgttacccttacccggttaggtaaccgggtaccgttaaccggttaaaccggtttccgttaaacgggttccccgggtaacccccggtaacccggggtacccgggttaaaacccgtaaacccccgggggtaaacctttaaaaaccgggtttaaaccgtttttaccccgggttaaagggttaacccgggtttaaaccggaaaacgggggttaaaccgggggttaaaccccggggtaccgggtttttaaaaggggtttaaaccccgttttaaacgggttttttaacccccggtttaaccgggtttaaccccgttaacccggggggttaaccccgggggtttaaccccgggttaacccggggggttaaacccccgtttaccggggttttacccccgaaccccgggttttttaccgtaccccccgtttaaaccgggtcccccggttaaaccccggttaacccccgggtaaaccccggggttaaaccccggggttaaccccccgtttcccgggttttaaccccccgggttttaaccccccggttttccccccggggtttaaacccccccggg

SEQ ID NO: 290217 - DNA, 675 bp, Homo sapiens
  misc_feature: GYAE6OF02JWOHO.45.38.D05.1.454.CMB.1.raw
  modified_base (188)..(188): a, c, t, g, unknown or other
  misc_feature (188)..(188): n is a, c, g, or t
  modified_base (591)..(591): a, c, t, g, unknown or other
  misc_feature (591)..(591): n is a, c, g, or t
  modified_base (625)..(625): a, c, t, g, unknown or other
  misc_feature (625)..(625): n is a, c, g, or t
  modified_base (655)..(655): a, c, t, g, unknown or other
  misc_feature (655)..(655): n is a, c, g, or t
  modified_base (663)..(663): a, c, t, g, unknown or other
  misc_feature (663)..(663): n is a, c, g, or t
  modified_base (671)..(671): a, c, t, g, unknown or other
  misc_feature (671)..(671): n is a, c, g, or t
tcagacgcgatcgacacgaccggtgctcgatttagtatctgatagttgggtttgggtttagaacctatgaacattctgtaggggccactgtcttctccacggtgctccctttctgccctgactcagcctgcctccgtgtctgggtctccgtggacagtcgatcaccatggcctgcactggaaccaacngtgatggttgggtagtttttagtttgtctcctggtaaccaactaaccgaccccgcgaacgccccctaaataactcatttaagtacgggactactaacggccggtacccgttcggggggttttacaacggtccgtcgtttctccgttcggtcctacctaacggtctcggaccaacgaccggccttacccagactaactcgtcgtcgggcctccgagtcctcgacgtacgagcgtagtatttacgttctagtcgtctcgtatagtcgcgacggtaccagtccttagttcgggtacggttcgggcgggtaacgggtcctagggtccgtaaccgtacgtcggtaccacggaccgtacgtcccgtccctaccccgggtcgtaaccctcgtacccgttccggttccccncccgttacgtcctacgtccgtaccgcgttaccgnggacgtcggcggtccggtacgaccgggtcncgtacgtngtacgtancatg

SEQ ID NO: 290218 - DNA, 815 bp, Homo sapiens
  misc_feature: GYAE6OF02HQ0Z8.45.38.D05.1.454.CMB.1.raw
  modified_base (223)..(223): a, c, t, g, unknown or other
  misc_feature (223)..(223): n is a, c, g, or t
tcagacgcgatcgacacgaccggtgctcgatttagtatctgatagttgggtttgggggctttctgagagtcacggacctcctgtgcaaggaacatgaagcacctggtcggttcctcctctgctggtggcgctccggatgcgtcctgtcccagctgcacctgcaggtgtccgggcccagggacttggtgaacggtccctttagggacgacccttcggtcccctnacttcgactaggtcgtctcgtgggtacactcagttcgagtaggtactactaagtttaaacggtttggggacttcggggtccgccacggtcccccggaggggaacgggtcgtaggacggtcggtaggttcggacttcgtaccttaacgtcgtaacggtacgggtacctaccggttaactaccgtacgtccccgtaccgtaacgaacgtaccgtcgtaacgtgaactgtactctaactaaaacgtaaaacgcgtaaccctaaaagtaaaccgttacttaccgtacccggtagtaacggtctaacgttaacttccgtacggacggaccggtaccggaccgtaccgaccgtaaaccgtaaatttaaccggtacgttaacggtcggaaaccgtaaggccggtaacgggttccgttaaggtaacttttccggttacctttaacgaacccggtacggttcgggggtaaccgttccgggtaacccggttcgttaaccggtacccggttacccgtttccgaacccgttaccgcccgttaaccgggtaaaccccggacggttaccccggttaactttccccgggttaccctttaccccgggg

SEQ ID NO: 290219 - DNA, 673 bp, Homo sapiens
  misc_feature: GYAE6OF02F2ZAW.45.38.D05.1.454.CMB.1.raw
  modified_base (144)..(144): a, c, t, g, unknown or other
  misc_feature (144)..(144): n is a, c, g, or t
  modified_base (175)..(175): a, c, t, g, unknown or other
  misc_feature (175)..(175): n is a, c, g, or t
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (238)..(238): a, c, t, g, unknown or other
  misc_feature (238)..(238): n is a, c, g, or t
tcagacgcgatcgacacgaccggtgctcgatttagtatctgatagttgggtttggggggggtcacaagaggcagcgctctcgggacgtctccaccatggcctgggctctgctgctcctcgactctcctcactcaggacacaggntcggtgggtccctttcgtgccctgacctcgngcctcgcctccgtgtctgggtctccgtgacngtcgatcacntcgctgctacgtagaaccaagngtcgagtggttaggttagtttttagtttgtctcgtacgtaccaaacgaaccgacccggacgaacccgaccccaaatactcttattaacgtacggaacctacgtaacggccggtccgttcgggggttacaacggtccgtcttaccgtcgtcggtccttaccgaacgttcgtacggacaaccgtcccggtcctacccgtacgtaacctaacttccgttcgtcgggtccctaccgtacgtccgtacggacggacggtacggcttacgtaactttcgtttcgttgttccgtgttacgtagtacgttgacccgaggtacccgaggtccgtaggttcgggttcgtacggggcggtacggacgtacggtccgacgttcgtagtcgagccgacggcctccgggtccctcgacctcctcgttccctccgtacccgtctccgtcg

SEQ ID NO: 290220 - DNA, 623 bp, Homo sapiens
  misc_feature: GYAE6OF02FK6RG.45.38.D05.1.454.CMB.1.raw
  modified_base (238)..(238): a, c, t, g, unknown or other
  misc_feature (238)..(238): n is a, c, g, or t
  modified_base (321)..(321): a, c, t, g, unknown or other
  misc_feature (321)..(321): n is a, c, g, or t
  modified_base (388)..(388): a, c, t, g, unknown or other
  misc_feature (388)..(388): n is a, c, g, or t
  modified_base (396)..(396): a, c, t, g, unknown or other
  misc_feature (396)..(396): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggcccctttctgccctgacctcagcctgccctccgtgtctgggtctcctggacagtcgatccaccatcggcctgcacgtggaaccaacgngtgattggttaggtagtttttagtttgtctcctaggtaccaacaaccacccggacgaaccgacccccaaactactctatttanacgggacacgtaacgccggtcccgttcggggtttacaagtcgtcttctcgtgctcgagtctgcaacncgcctccngactactctcgtggctaccgcgctacgacggcgaggctagtattattcgtgtgtctatatgtacgcgacggaccagtactagttgggtcggtcgggccgggtacgggaccttagggttaccgaccggttccgtacggtccacggtcccgaaggtccctcccggccccgttacggtcccgtacgttccgtttcccggtacccccgtcccgttacccgtccgtacccgg

SEQ ID NO: 290221 - DNA, 223 bp, Homo sapiens
  misc_feature: GYAE6OF02HK5W7.45.38.D05.1.454.CMB.1.raw
  modified_base (180)..(223): a, c, t, g, unknown or other
  misc_feature (180)..(223): n is a, c, g, or t
tcagacgcgatcgacacgaccggtgctcgatttagtatctgatagttgggtttggggggtcacaagaggcagcgctctcgggacgtctccaccatggcctgggctctgctgctcctcactctcctcactcaggacacaggatcggtgggtccctttctcgccctgactcagcctcgcctnnnnnnnnnnnnnnnnnnnnnnnnnnnnnnnnnnnnnnnnnnnn

SEQ ID NO: 290222 - DNA, 726 bp, Homo sapiens
  misc_feature: GYAE6OF02HB405.45.38.D05.1.454.CMB.1.raw
  modified_base (112)..(112): a, c, t, g, unknown or other
  misc_feature (112)..(112): n is a, c, g, or t
  modified_base (189)..(189): a, c, t, g, unknown or other
  misc_feature (189)..(189): n is a, c, g, or t
tcagacgcgatcgacacgaccggtgctcgatttagtatctgatagttgggtttgggggctttctgagagtcacggacctcctgtgcaggaacatgaagcacctgtggttccnctcctgctggtgcgctccggatgcgtctgtccagctgcacctgcaggagtcgggccaggactggtgaagccttgganaccctgtccctgacttgctagtgtctcgtggtcactccgtagtcagttagtacgtctaagttaaacgtttgggacgtcgggtaccgccgtacgccccgaagggacgggtcgtggaggtcggaagttcgggacgtcggtaccttacgtcgtacgtacgggacctactagttaccacgtcccgtacctaccgaaacgtaccgtcgaccgttacggtagtacgtacctacgaaactaaacgtaaccgttaccgaaaacgtaaaccctaaacgtttcctacccgtagtaacggtcctacgtaaccgttcgtacgttaccggacccgacggtacggaaccgacggtaaccaaagttacgttacgtagtacgaacgtaaggacgtaaacgggtcttaaggtaactttagttacccgttacgtaccgtacggttcgggacccgttagggtaacccctggtacctaccggtcctaccgtccgaaccgtcccgtaaccgaccgtaaccgggtaccctacgtttacccgtccggtaccccgtaccgg

SEQ ID NO: 290223 - DNA, 727 bp, Homo sapiens
  misc_feature: GYAE6OF02HEIU0.45.38.D05.1.454.CMB.1.raw
  modified_base (222)..(222): a, c, t, g, unknown or other
  misc_feature (222)..(222): n is a, c, g, or t
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
  modified_base (402)..(402): a, c, t, g, unknown or other
  misc_feature (402)..(402): n is a, c, g, or t
  modified_base (446)..(446): a, c, t, g, unknown or other
  misc_feature (446)..(446): n is a, c, g, or t
  modified_base (659)..(659): a, c, t, g, unknown or other
  misc_feature (659)..(659): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcggtcgggcccttttcgtcgcccttgacctcagccctcgtcctccgtgtcgtgggtctccgtggacagtcgatccacngtcggcctgcactcggaaaccaacngtnagttggttagggttagtttttagttttcgtccttccgtacggtaaccaaacctaaccgaccccggacgaacccgaacccccgaaataactctaatttaagaacggacaacgtaacggccggtccgttcggggttacacggtctcttctacgnggtcctacgagtccgtaggaccaaccgaccggcccttacccganaacgtacttccgtacgtcggtaccctccggaggtactcgacggtcgtaccggtattaccgttacttttcgttacgttcgggttaacctgttaaccgattcgtacgaccgggtacgaaccgcttacggtacggtttgggtaccgggtcggaacgggtaccgtacgttcgggtaccggtaccgtccgggttagaccgcgtaaccgtcgggtaccnccccggtccccgtcgtaaccctttcgtccccggtaccgttcccccgacctttcccgtataccccgggg

SEQ ID NO: 290224 - DNA, 659 bp, Homo sapiens
  misc_feature: GYAE6OF02FX4N7.45.38.D05.1.454.CMB.1.raw
  modified_base (318)..(318): a, c, t, g, unknown or other
  misc_feature (318)..(318): n is a, c, g, or t
  modified_base (461)..(461): a, c, t, g, unknown or other
  misc_feature (461)..(461): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagttagagtcataagttttgggctgggtcgccagccccaggagggctggagtggattgggactgtctactgtagtgggaccnctattacacgcccgtacctcaagactcgacttgggtcactctacgaataaaccacgtaccaaagaaacctaattccgtaccctagacggtctagaacttcgtgtcgacgccgtcggaccaccggactaagttacttactggtncgtaagaggacggtccgtagggtaactttacgttcccgttttagacccgttaacgtcgggggtacccttacggggtaaccccgttggtaccccgtacccggttccgtaccccttacccggaccgtccccgtaaccgtaccccggaaccggggtcccccgtaagggttccccgttaccccggtttccccccgtcccggg

SEQ ID NO: 290225 - DNA, 792 bp, Homo sapiens
  misc_feature: GYAE6OF02JTCYM.45.38.D05.1.454.CMB.1.raw
  modified_base (137)..(137): a, c, t, g, unknown or other
  misc_feature (137)..(137): n is a, c, g, or t
  modified_base (239)..(239): a, c, t, g, unknown or other
  misc_feature (239)..(239): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctccggangcgtcctgtcccagctgcacctgcgaggacgtcgggcccaggacgtggtgaacgccgttacggacgcccctggtcccactacgttcgctagtgtctgtggtnacctcactcagtagtgtactaagtttaaggtttgggcgttacggtccgccaccggacccccgggaaggggtaacggggcgttagggaggtagggtacgttgggtaccgttcgtcgttaccgtagtacggtacgggtacccaaccttagtacccgtacgggtccccgttaccacgtaaccggtaccgtacgtaacgttgggtacgtaacttaccgtaaactaaaaccttaaaacccgccggttaaacccaaaacgtaaacccctaaacttaccccgttaccggacggtacgggtactacgtaaccgttagtcgtaccggacccggtaccgggtacggtaaccggaaccgtaaacgttaaacttacgtttaacgtcggtaagtaacgaaaggaccgggtaaggggtcccgtaagttaaacgttacttaccggttaccgaacgtcgggtacgggtccgtacgggtacctaccggtaccgtcccggtcctaccctcgacctacccgtaccgaccgttaccggacccgtccggttcccggtaccccttccccgtaccg

SEQ ID NO: 290226 - DNA, 895 bp, Homo sapiens
  misc_feature: GYAE6OF02GFT02.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgctacctgcgaggagtccgggcccaggactggtacgaacggtccgtttcgggacgtaccccgttgtcccctctacgttggctaggttgtcctcgtggtgacctccatcgaagttagtagtactaagtttaaaggttttcggggaccgttcgggtacccgtccgacgtacccccccggaagggggaacgggggtccgtaggggtacggttacggggtacggtttacgggggtaaaccgtttcggttaacccggttaccgttacgggttaaacggttcgggggtaaacccctaaccgtttaacgttaacccgaccggttcccccgttaccctaccgaacgtaccgtccggtaacgttggtacggtacttaccgtaactaaactaaaccgtaaccgttaccaaaacgaaaccctaactttcctacccgtagtacggtacctacgaacgttcctaggtccggacccgtaccggacccggaccgaacccggaaccctaaaagtttaccgtttaacgttacggtacgaacgtaacgggtaacgggacggtacccggtaaggttaaccttttaccgttaccgttttaccggaaccgttccgggttaaccggggtaccgtaacccggggtaccgttaccgggttacccggtaccccgttccgttacccgtaccgtacccggtcccctacccgtaacccggaaccggtacccgttccgttacccgggttcccccttaccccggtaccccg

SEQ ID NO: 290227 - DNA, 726 bp, Homo sapiens
  misc_feature: GYAE6OF02F9GRE.45.38.D05.1.454.CMB.1.raw
  modified_base (164)..(164): a, c, t, g, unknown or other
  misc_feature (164)..(164): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcgctccggatgcgtcctgtccagctgcacctgcaaggngtccgggccaggactggtagaacgtccttcgggacgtaccctcgtccctcacgttgcagtgtctgtggtctacctccattcaggttatacgtactaagtttaaaggttttcgggctcgggtccgccgacgaccccgaaggggacgggacgtgggtaggtggtaggttgggtacgttggtcttacgtacgtaggtcggaacctacgttacgtaacgaccggtcccgtaccgttacgaacgtacgttcggaccgtgtacgtctactactaaacgtaacctacggtaccaaaacgtacctaacttacctacccgtagacggtaccgtaacgtaaccttcgtagtcccggaacccggccggtaccgggaaccgaccggtaaaccttaagttaacgttacgttacgacgaacgtaagacggaacggtcgtagtacgttacttccgttacgaccgtcgtacggtaccgtacgggtaccctgtaccgtaccttccgtacctccgaacctcctacccggtaacccgtacgggtcccctaaggttccccgttacccgttccccgtacccgg

SEQ ID NO: 290228 - DNA, 886 bp, Homo sapiens
  misc_feature: GYAE6OF02INNX0.45.38.D05.1.454.CMB.1.raw
  modified_base (162)..(162): a, c, t, g, unknown or other
  misc_feature (162)..(162): n is a, c, g, or t
  modified_base (664)..(664): a, c, t, g, unknown or other
  misc_feature (664)..(664): n is a, c, g, or t
tcagacgcgatcgacacgaccggtgctcgatttagtatctgatagttgggtttgggggggggtcacaagaggcagcgctctcgggacgtctccaccatggcctgggctctgctgctcctcactctcctcactcaggacacaggatcggtgggtcccttttcncgccctgactcagcctcgcctccgtgtctggtctccgtggacagtcgatccacagtcggcctgcctacgtacggaaacccaacgtaggttgtacgttggggtttaggggttaagtttttttacggtttttcggttcctttacccgttacgggtaaacccctaaaccgtaaacccccggaaccccccggggtaaccgtaaaaccccggtaacccccccctaaaaaattaaccttacccgtttaaagtttttaacggaaaccggggtaaacctaaaccggttaaacgggcccccggggttaccccgggttttaccgggggggtttttaaccaaacggtttcccggttaccgttttcccttaccgggttcggtacccgttacccgtaacggtttcccgtacgggtaaccgtaaaccgtaccccgggcccctttacccgtacgtaacctaacgtttccgtcggttcggggtaccctaccggacggtccgtaccgagggtaaccggnggtacttagttacttttacgtttcgttgttcacttacgtattcgtcggacacgggacctaggtaccgttagggtttcgggtcgggttaccgggacggggtacggaaccggtttggtaccggaccgttcgtacggtccgaccgtacccgggagttccgccccggtacccttcggtaccgttaccgtccgttacccgttccccctaccgtttccgtagtcccgg

SEQ ID NO: 290229 - DNA, 891 bp, Homo sapiens
  misc_feature: GYAE6OF02F7LGL.45.38.D05.1.454.CMB.1.raw
  modified_base (157)..(157): a, c, t, g, unknown or other
  misc_feature (157)..(157): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttntgccctgactcacgcctgcctccgtgtctcgggtctcctggacagtcgatcaccatcggcctgcacgtggaaccaagacgtagacgttggtttaggggtagtttttacgttttgtccttccgttacggtaacccaaacaacccgacccccggtacgaaaccgacccccctaaaacgttaactaccctaattttaacgtaacgggtacccaacgtaaacgggccggtaccccggttacggggggttttaccaaacggttccgtacctttcgtccgttacgggtccctaccgtaaacggttccgttacgggaaccgtaaaccgacccggggtaccccttaccccgtacgtaaacgtaaaccgtttccgttccgtcgggttccctaacccgtacggtccgtaaccggtacggggtaacggtaacgggtccgttaagtaacgttttacgttttcgttacggtttcgaccctttacttaaagttccttacggtaccgaaacggggaccctaggttaccgttaccgggtttcgggttccggtaccggggtaccgggtaacggggttaacgtccgggtttaccggtaccggttacccgttaacgggtacgtaaacccggtacccggtaaacgggttcccgtacccccgggttaccccgttacccgggttacgtaacccggtttccccggtttcccgggttaacccccccggtccctttaccccggtcccgttaaccccggg

SEQ ID NO: 290230 - DNA, 658 bp, Homo sapiens
  misc_feature: GYAE6OF02FS6NX.45.38.D05.1.454.CMB.1.raw
tcagacgcgatcgacacgaccggtgctcgatttagtatctgatagttgggtttgggggatgctttctgagagtcacggacctcctgtgcaggaacatgaagcacctgtggttcctcctcctgctggtggcggctcccggatgcgtcctgtcccagctgcacctgcaggagtccgggcccaggactggtgaagccttcggacaccctgtccctcacttgcagtgtactctggtcgactccatcagtagtagtctaattaaagttttgggctcgggtccgaccgacgcccccgaaggggaacgggctggagtggtgttgggactgtactactcgtagtggacctactattacacgtccccgtcctacgaacgtactcgactggtagtactcctacaaactaaaccacgtaccaaagtaacctactttcctaccgtagtacgtactacgtaactctcgtacgacccgccggacggtaaccgaaccggtaacctaaagttacgttaccgtgtacgacgaaggaggacgggtcgtacggtaatttcgttaccgttacgaccgtacgtcgggtccgtacgggtacccgttcggtccctaccgttcctccctacgaccctcccgtacccaaccggtacggacccctacggtcccggttacccccg

SEQ ID NO: 290231 - DNA, 1064 bp, Homo sapiens
  misc_feature: GYAE6OF02HI98U.45.38.D05.1.454.CMB.1.raw
  modified_base (158)..(158): a, c, t, g, unknown or other
  misc_feature (158)..(158): n is a, c, g, or t
tcagacgcgatcgacacgaccggtgctcgatttagtatctgatagttgggttgggggggtcacaagaggcagcgctctcgggacgtctccaccatggcctgggctctgctgctcctcactctcctcactcaggacactaggatcgtcggccctttcgngccctgactcagcctgcctccgtgtcgtgggtcctccgtggacctagtcgactcaccagtcggcctgccgacgtacgaaaccaacgagtagagttggttggttattttagtttcgtccttcgtcggtaaccaacgaaccgaccccggacgaaccgtacccccctaaaagtaactactacgttttaacgaacggggaacctaacggttaacggcccgggttaccccgtttacgggggttttccaaacggtttccggtactttaccgtcgttccggtcctacccggtaaacggttccgttacggggacctaaaaccggtaccccgggtaccctttacccccggttaacggtaaacccgtaaacgtttccccgttaaccgggttcggggtacccccgtttaacccggtaacccggggttaccgttaccccgggtaaaacggggtacccccgggtaaaggggttcccctttaaagggtttaaacccgtttttcggtttttaaacccggtttcggtttaccgggtaacccttttaagggtaaccgtttttaaacggttcccgggtaaaccccggggttaaacgggtaaaccccggttaacccgggttaaccgggttaaacccgggtttttccggggggttaccggttttaacccggggggaacccggggttaaaccgggggttacccggtttaaaccggggtttacccgggtaaacccccggggttttacgtaacccgggggtttacccggaacccgggttaacccccgggttaaaccgggttccccccgggtttacccgtaaccccccccgggtttaccggttaccgttttaaacccccgggtccgttttaccccccggtttacccccggtttaaccccccggttttaccctcccgggtttaacccccgg

SEQ ID NO: 290232 - DNA, 929 bp, Homo sapiens
  misc_feature: GYAE6OF02G14JT.45.38.D05.1.454.CMB.1.raw
  modified_base (201)..(201): a, c, t, g, unknown or other
  misc_feature (201)..(201): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctcccggatgcgtcctgtcccagctgcacctgcaggagtccgggccaggactggtagaacgtccttacgganacccgtgtccctctacttgctagtcgtcgtacgtggtactacctaccagtcgtaaggtacgttagtactaaagtttaaaggttttggggcgttcgggtcccgacccgtaccggacccccggaagggggaacgggtccgtagggtacggtagggtaggttcggggtaacttcggttacctaacgttacggtacggtacgggtaccctaaccgttaacttaccgaccgtccccgttacccgtacgtaaacgtaccgtaccgtaccgttaggtacgtaacgtccttaaacgtaaaaccttaaaccgtaaccgttaaaccgtaaaaccgtaaaccgttaaaccgttccccgttaccgtaacggtacggtccgtaacgtaaaccgtttccgttacggtacccggtaacccggcccgtaacggggtaaacccaaccggttaaaccgttaaaaccgtttacgtttaacgtacgggtaaccgtaaaccgtaaacggtaaccggggtaacgggtaccgtttaacgggttaaaccgtttttaccgttacccgttttaaccggaacccgtttaacggggtaccgggttaacccggttaaccggggtaaacccgttcgttaccccggttacccgggtacccttcccgttaaaccgcccgttaacccccgaccgttaaacccgggtacccggtccccgttaaccggtttccccgtttacccccgttccccggtaaccccgg

SEQ ID NO: 290233 - DNA, 690 bp, Homo sapiens
  misc_feature: GYAE6OF02H75U5.45.38.D05.1.454.CMB.1.raw
  modified_base (208)..(208): a, c, t, g, unknown or other
  misc_feature (208)..(208): n is a, c, g, or t
  modified_base (228)..(228): a, c, t, g, unknown or other
  misc_feature (228)..(228): n is a, c, g, or t
tcagacgcgatcgacacgaccggtgctcgatttagtatctgatagttgggtttgggggctttctgagagtcacggacctcctgtgcaggaacatgaagcacctgtggttcctcctcctgctggtggcggctccggatgcgtcctgtcccagctgcacctgcaggagtcgggcccaggactggtgaagccttcggagaccctgtccctnacttgctagtgtctctggtnactccatcagtagtagtcaagttaaagttttggggcgttgggtccgccacggtcccccgagggaacggggtctggaggtggtattgggactgtctacgtcgtagtggaccactattacgacgcccgtcctacaagactcgactggtgtatctacaataaacacgtaccaaagtaaccaattcctcctgacggtctagaacttcgtgtacgaccgcgcggacacggaccaaagttacttacgtgtacgtacgaaggacgacgggtacctagggtaactttacgttccgttttacggaacccgtacggtacggggtccgtaccggggtaacccgttcgggttacccgtacccgggttcccttaccccgttacgacccggttaccccgttaccccgtaacccggtaacccgggtacccccgttaacggttccccggtttaccccccgttcccccgttaccccggg

SEQ ID NO: 290234 - DNA, 781 bp, Homo sapiens
  misc_feature: GYAE6OF02I1ZQJ.45.38.D05.1.454.CMB.1.raw
  modified_base (165)..(165): a, c, t, g, unknown or other
  misc_feature (165)..(165): n is a, c, g, or t
  modified_base (195)..(195): a, c, t, g, unknown or other
  misc_feature (195)..(195): n is a, c, g, or t
  modified_base (734)..(734): a, c, t, g, unknown or other
  misc_feature (734)..(734): n is a, c, g, or t
tcagacgcgatcgacacgaccggtgctcgatttagtatctgatagttgggtttggggctttctgagagtcacggacctcctgtgcgaggaacatgaagcacctgtggttcctcctcctgctggtgcggctcccggatgcgtcctgtcccagctgcacctgcaggngtcggccaggactggtgaagccttgggacnccctgtccctcacgttgccagttcgtctcgtaggtcgacttccgagttcagttacgtatcaagttaagtttgggcttggtccgccgacggccccgaaggggaacgggtcctagggtagtgggtaagttggtacgttcgtcgttacgtacgttacggtaccggggtaacctaaccgttaacgttaaaccgtccggtcccccggttacccttaccggaaacgtaacccgttccggtaacggttaccgggttcggttaacgttaccgttaaacctaaaaaccgttaaaacgaacccgggtaaccccttaaaagggaaaaccctaaacctttcccgtacccgtttaaggaccgtacgtacgtaaacgttcgtaacggttcgaacccgttccggacgaccgttaccggaccgtaacttacgttacttgacgacgtacggagtacggtcgttaacggtattcgtttcccgttaggaccgtacgtcgggtaccgtacgggtaccgttcggtacccgttaccggtcttacccgtacgacccttaccncccgtaacgaccggttcccgacgttcccggttccctacccggtcccg

SEQ ID NO: 290235 - DNA, 745 bp, Homo sapiens
  misc_feature: GYAE6OF02F4DW4.45.38.D05.1.454.CMB.1.raw
  modified_base (231)..(231): a, c, t, g, unknown or other
  misc_feature (231)..(231): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcggtgggccctttctgccctgactcagcctgcctccgtgtctgggtctcctggacagtcgatcaccatcggctgcactggaaccacngtgattggttagggtagttttagttttcgtcttccgtaggtaacccaaacaaccgaccccgggtaccgaaccgaccccccgtaaaacttaactacctaagtttaacgaacgggactaacgtaacggccggtacccggttacgggggtttacaacggttcgtcctttcgtcgtcgtctaccgtaagtccgtcggaccaacgtaccggccctacccgtacgtaacctacttactcggtccgggtaccttaccgacgtccgtacgaacgggtaccggtagggtacttagtaactttacgttacgttcgaccgtacggtacttcgaagttacgtcgtaccgtacggacgacgtactacggttacgtaaccgttgtaacgtttacgtcgggaccggtaacggggaacctaaggccgttaccggtacccggttacggtacggtacctaaccgggaccgtaaccgggtccgttacccggtcccccgttacgggtacccctacggtttccccgttaccccgg

SEQ ID NO: 290236 - DNA, 717 bp, Homo sapiens
  misc_feature: GYAE6OF02JZ88Z.45.38.D05.1.454.CMB.1.raw
  modified_base (415)..(415): a, c, t, g, unknown or other
  misc_feature (415)..(415): n is a, c, g, or t
  modified_base (465)..(465): a, c, t, g, unknown or other
  misc_feature (465)..(465): n is a, c, g, or t
  modified_base (505)..(505): a, c, t, g, unknown or other
  misc_feature (505)..(505): n is a, c, g, or t
  modified_base (561)..(561): a, c, t, g, unknown or other
  misc_feature (561)..(561): n is a, c, g, or t
  modified_base (646)..(646): a, c, t, g, unknown or other
  misc_feature (646)..(646): n is a, c, g, or t
tcagacgcgatcgacacgaccggtgctcgatttagtatctgatagttggtttgggggggtcacaagaggcagcgctctcgggacgtctccgaaccagtggcctgggctctgctgctcctcactctcctcactcgacggacacaggtatccgtgggccctttgtcgcccttggactcagtcctacgtcccttccgtagtcgtgggttcctccgtagggacctggtccgtactccgaaccgtatcgggcctggacctacgtacgaacccaatgtagtcgtggtttagggttactttttaggtttcgtctcgttacggtaaccaactaccgacccggtacgaacctaccccgtaaagttatagttacttaaggacggactacgtacgccggtacccggtttgggttacaacggttccncgttttcacgttcggtaccacgtacgtcgtaccgactacgacccggtccnccgtaagactaacgtctcgtacgggcctacctggtaaccncgacgtacgattcgtgttaactttcgtcgtgtcattacgattccgacgtaggaccntacggttctggggttacgtacgttcggggaacggttaccggaacttcggggtacctccggttagtacgtccggcttaacccgggngtcccgttccgggtaaccctggtaccccgttagttcccggtacccgtcccgttcggtacccttcgaaccgg

SEQ ID NO: 290237 - DNA, 892 bp, Homo sapiens
  misc_feature: GYAE6OF02FUJQ2.45.38.D05.1.454.CMB.1.raw
  modified_base (760)..(760): a, c, t, g, unknown or other
  misc_feature (760)..(760): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcggtcgggtccctttctcgccctggactcagcctcgcctccgtgtcgtgggtctccgtggacaggtcgactcaccatcggcctgacacgtacggaaccaacgagtagagttggttagggttagtttttaggttttacgtcttccgtaggtaacctaaacaaccgtaccccggacgaaacccgaccccctaaaactaactctaatttaacgtacggaacactaacggccggtaccggtcgggggtttacaacggtccgtactttcgtcgtcgcctacgtaacggtccgtgggaccaacgaccggtcccctacccgtacgtaacgtaactcgttccgtacgggtacccttacccggacggtcctacggtaaacggggtacccggtaagggtccttaagggtttactttttaacgtttcccgttagggttaccgtaccgtttactacgtttaattccggggtaaccgtaaccgggggaaaccctagggtacccctttagggggtttttaccgggggtacgggtttaccgggggtaaccggggggtaaacccggggtacggtttaccccgggggttaccggttaaacccccggggttccggtttaaccggggttaacccnccccgggtaaaccggttaacgggtcccggtacccccggttcccccccggttagggtacccccttcccggtttaaccccggttttcccggtaccccccgttacccccgtttacccggtccgtttaaccccggg

SEQ ID NO: 290238 - DNA, 856 bp, Homo sapiens
  misc_feature: GYAE6OF02F9WXF.45.38.D05.1.454.CMB.1.raw
  modified_base (575)..(575): a, c, t, g, unknown or other
  misc_feature (575)..(575): n is a, c, g, or t
tcagacgcgatcgacacgaccggtgctcgatttagtatctgatagttgggtttggggctttctgagagtcacggacctcctgtgcaggaacatgaagcacctgtggttcctcctcctgctggtggccgctccggatgcgtctgtccagctgcacctgcaggacgtccgggcccagggtactgggtacgaacgtcccgttacggacgtacccttcgtcccctactaacgttgctagttcgtccttcgtggtacgacctccagttcagtagttagtactaagttaaggtttcgggctacgggtccctaccgaccggacccccggtaaggggaacgggcgtagggtaaggttcgggtagttcggggtaacttcggtaccttacgttaccggttacggtaccgggacccttaaccgttaacgtttaaccgacccggtacccccgttaccctaacgaacgtactaccggtaacgttggtagtactaccgtaactaaaacgtaacccgtaaccgtaaccgtaaaacgtaaccctaaccgtttacccgtaccccgtaaggtacggttaacctacgttaaccnccggttcggtacccggttaaccccggcccggtaaccggtaacccgaccggtaacccttaaagtttaacctttacgttcggtaacgtacgtaacgggtacggtaacggttaccgttaacgggttaactttaccgggttaccttacgaccgttaccgggtcggtaccggttacggtaacccgttcggtaaccgtaccccgttccgttacccgaccgtaccgaccctaccgtaaccggccgttaacccggccgtttaccccgttccccgttacccgtaccccgg

SEQ ID NO: 290239 - DNA, 833 bp, Homo sapiens
  misc_feature: GYAE6OF02H32BY.45.38.D05.1.454.CMB.1.raw
tcagacgcgatcgacacgaccggtgctcgatttagtatctgatagttgggtttgggggctttctgagagtcacggacctcctgtgcaggaacatgaagcacctgtggttcctcctcctgctggtggcggctccggatgcgtcctgtcccagctgcacctgcaggagtcggccaggactggtgaagtcctttacggacgtaccccgtcgtaccctctacgttcgccgtagtgtccttcgtgggtcacctctaactacgtaagttacgtacgtactaagtttaaacggttttcggggaccggttcgggtaccgtacccgcccggtacccccggaagggggtaaccgggtcggtacgggaggttcgggtacggttacgggtacccgtttgttaccgttacgttacgttacgggtaccggtaacctaaccttacggtttaaccgacccggttaccccggttaccctaacgtaaacccggttacgacccggttaacgtcggggttaacggtaccttaacgtaacgtaaaactaaacccggtaaccgtaaacgtaaacaaacccctttaaacgtttcccgaccgtacggtaacgtaccgtacgtaaccgtttcgttccggaccgtacggaccggaacccggttaggaacccggtcttaaaattccgtttaaccgaggtataacgaaggtagtaccgtgtaacgttacgtatttaccgaccgtttaacggcgtaaccggtacggccgtttaggaccgtttaccggtactaccgtccttacgtccgaacctcgtaccccggaacgtccggacccgtttaccggttccgacccgttccccgg

SEQ ID NO: 290240 - DNA, 767 bp, Homo sapiens
  misc_feature: GYAE6OF02HII99.45.38.D05.1.454.CMB.1.raw
  modified_base (160)..(160): a, c, t, g, unknown or other
  misc_feature (160)..(160): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcggtcggtccctttcncgccctgactcagtcctgcctccgtgtcgtgggtctccgtggactgtacgatcaccagtcgcctgccacgtacggaaaccaagacgtgtacgttggttagggttagttttttacgtttcgtccgtccgttacggaacctaaccgaaaccgtacccccggacgtaaacccgaaccccctaaaacgttactaccttaagtttaagacgggaactaacgtaacggcccgggttacccgggtttacggggtttaccgtacgttccgtaccgttttccgtaccggtacggaccctttaccggaacgtttaccggtacggtaaccgtaaaccgacccgggttccctaaccccggttacaaaccttacgttcccgttacggtccgggtaccctccgggtaccgtcttacggacgggacgtacggtcttaggttactttacgtttgtgtttacgcttagacttgtcggacggaccggtacaggtcttacgggtttaggtcgggtaggacggtcgggtaactcgggtaccgtacgtcgtcgaccacgtaccggacgtccggcccgtaccccgttggtccttacgtcccgttcctaccccgtaccttccgcctccgg

SEQ ID NO: 290241 - DNA, 816 bp, Homo sapiens
  misc_feature: GYAE6OF02G2W0J.45.38.D05.1.454.CMB.1.raw
  modified_base (166)..(166): a, c, t, g, unknown or other
  misc_feature (166)..(166): n is a, c, g, or t
  modified_base (199)..(199): a, c, t, g, unknown or other
  misc_feature (199)..(199): n is a, c, g, or t
  modified_base (617)..(617): a, c, t, g, unknown or other
  misc_feature (617)..(617): n is a, c, g, or t
tcagacgcgatcgacacgaccggtgctcgatttagtatctgatagttggggtttggggggggtcacaagaggcagcgctctcgggacgtctccaccatggcctgggctctgctgctcctcactctcctcactcaggacacgacggatcggtcgggtccccttttcncgcccgtgactcgagcctcgcctccgtgtccgnggtcctccgagacagtcgatcactagtcggtcctgcctaacgtacggaaaccaacgtagtcgtagttaggggtttacgggttaattttttacggtttcgttaccgtccggttacggtaacccaaaccgtaaacccgaccccggaaccggtaaacccgtaacccccctaaaaagtaacgttactaaacgtttacgtaaacggggaaccttaaccggtaaaccgggtcccggttaccccgggtttaagggggtttaccaaacgggtttccgtacccgtttacgttaccggtacggtacccttaccggtaacggttaccgtacgggtaaccaaaccgaccggtacccgttacccgtaacggtaaactaccgtaccgttacggtccggaccgttaccggacgttaccgacacgggagtacgngtagttacttagtcgtacgttcgattacgactgtacgacgtacgacctagccgttaggttcggtacgggtacgacgggtaacggccgtaaggttaccgtaccgttaggtaccggtagacccgaacggtaccgtacgtaccccggtcccgttaacggtctaccggtccggttaccgtcccccgtacttcctacggtaccg

SEQ ID NO: 290242 - DNA, 639 bp, Homo sapiens
  misc_feature: GYAE6OF02F3MLX.45.38.D05.1.454.CMB.1.raw
  modified_base (230)..(230): a, c, t, g, unknown or other
  misc_feature (230)..(230): n is a, c, g, or t
  modified_base (386)..(386): a, c, t, g, unknown or other
  misc_feature (386)..(386): n is a, c, g, or t
tcagacgcgatcgacacgaccggtgctcgatttagtatctgatagttgggtttggggggggtcacaagaggcagcgctctcgggacgtctccaccatggcctgggctctgctgctcctcactctcctcactcaggacacaggatcgtgggccctttctgccctgactcagcctgcctcgtgtctgggtctcctggacagtcgatcaccatggcctgcactggaaccaacngtgatggttgggtattttagtttgtctcctggtaccaacaaccaccccggtcgaacgcccccaaactaactcatttatacgggacactaacggccggtcccttcgggggtttacaaaggttccgtcttcctctggctccaaagtctcggtcaaccnccggtcccgtcccctgtacaaactcgtctcgggctccgaggtctcgacggacgacggctgtatttattcttgttcgcttaccgatattcgcgaggtaccaggtcgtacgttcgggtacggttcgggcggtacggggacctaggttcggtaaccgttccgtacggttcgacgtcccgaacgggtcctaccggtcccccttcggtaacccttccgttcccttcggttccccctaccggttcccctccgttacccg

SEQ ID NO: 290243 - DNA, 230 bp, Homo sapiens
  misc_feature: GYAE6OF02FJSJ9.45.38.D05.1.454.CMB.1.raw
  modified_base (169)..(169): a, c, t, g, unknown or other
  misc_feature (169)..(169): n is a, c, g, or t
  modified_base (174)..(178): a, c, t, g, unknown or other
  misc_feature (174)..(178): n is a, c, g, or t
  modified_base (180)..(230): a, c, t, g, unknown or other
  misc_feature (180)..(230): n is a, c, g, or t
tcagacgcgatcgacacgaccggtgctcgatttagtatctgatagttggggtttggggggaagaggaagactgacggtccccccaggagttcaggtgctgggcacagcggccctgggctgcctggtcaaggctacttcctgatcgcgtctgagcgggactggcaaggcncatgnnnnntnnnnnnnnnnnnnnnnnnnnnnnnnnnnnnnnnnnnnnnnnnnnnnnnnnn

SEQ ID NO: 290244 - DNA, 130 bp, Homo sapiens
  misc_feature: GYAE6OF01BPSZQ.47.23.C01.1.454.CMB.1.raw
  modified_base (130)..(130): a, c, t, g, unknown or other
  misc_feature (130)..(130): n is a, c, g, or t
tcagagctcacgtacacgaccggtgctcgatttagtacacgtgattagggattgggcacagcggccctgggctgcctggtcaaggactacttcctacgtgagctctgagcgggctggcaaggcgcatagn

SEQ ID NO: 290245 - DNA, 129 bp, Homo sapiens
  misc_feature: GYAE6OF01AOF35.47.23.C01.1.454.CMB.1.raw
tcagagctcacgtacacgaccggtgctcgatttagtacacgtgattagggattgggcacagcggccctgggctgcctggtcaaggactgcttcctacgtgagctctgagcgggctggcaaggcgcatag

SEQ ID NO: 290246 - DNA, 134 bp, Homo sapiens
  misc_feature: GYAE6OF01EJM89.47.23.C01.1.454.CMB.1.raw
  modified_base (134)..(134): a, c, t, g, unknown or other
  misc_feature (134)..(134): n is a, c, g, or t
tcagagctcacgtacacgaccggtgctcgatttagtacacgtgattagggattgggcacagcggccctgggctgcctggtcaaggacagactacttcctacgtgagctctgagcgggctggcaaggcgcatagn

SEQ ID NO: 290247 - DNA, 130 bp, Homo sapiens; identical to SEQ ID NO: 290244
  misc_feature: GYAE6OF01DDNMH.47.23.C01.1.454.CMB.1.raw
  modified_base (130)..(130): a, c, t, g, unknown or other
  misc_feature (130)..(130): n is a, c, g, or t

SEQ ID NO: 290248 - DNA, 245 bp, Homo sapiens
  misc_feature: GYAE6OF01EP7AE.47.23.C01.1.454.CMB.1.raw
  modified_base (243)..(245): a, c, t, g, unknown or other
  misc_feature (243)..(245): n is a, c, g, or t
tcagagctcacgtacacgaccggtgctcgatttagtacacgtgattagggattgggccgacggaaaccttgactactggggccagggaaccctggtcaccgtctcctcagcctccaccaagggcccatcggtcttcccctggcaccctcctccaagagcacctctggggcacagcggccctgggctgcctggtcaaggactacttcctacgtgagctctgagcgggctggcaaggcgcatagnnn

SEQ ID NO: 290249 - DNA, 538 bp, Homo sapiens
  misc_feature: GYAE6OF01AKCIM.47.23.C01.1.454.CMB.1.raw
  modified_base (228)..(228): a, c, t, g, unknown or other
  misc_feature (228)..(228): n is a, c, g, or t
  modified_base (387)..(387): a, c, t, g, unknown or other
  misc_feature (387)..(387): n is a, c, g, or t
  modified_base (415)..(415): a, c, t, g, unknown or other
  misc_feature (415)..(415): n is a, c, g, or t
tcagagctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttccngtcaggcttctggatacagcttcactagtcatgctatacattgggtgcgccaggcccccggacagagacctgagtggatgggatggatcagcattggcaatggtaacataaaacactcacagaagttccagggcagggtcaccattaccagagacatcnccgcgaccacagcctacatggaactgancagcctgaccttgtagaagacacggtcttatttactactgtcgcgagaggtaggggtttgacgttgggaaccttccgttactacagttacggacgttcggtcgggggacaaacggggtacccg

SEQ ID NO: 290250 - DNA, 247 bp, Homo sapiens
  misc_feature: GYAE6OF01D3HDF.47.23.C01.1.454.CMB.1.raw
  modified_base (245)..(247): a, c, t, g, unknown or other
  misc_feature (245)..(247): n is a, c, g, or t
tcagagctcacgtacacgaccggtgctcgatttagtacacgtgattagggattgggccgacggaaaccttgactactggggccagggaaccctggtcaccgtctcctcagcctccaccaagggcccatcggtcttccccctgtcaccctcctccaagagcacctctgggggcacagcggccctgggctgcctggtcaaggactacttcctacgtgagctctgagcgggctggcaaggcgcatagnnn

SEQ ID NO: 290251 - DNA, 544 bp, Homo sapiens
  misc_feature: GYAE6OF01ERMG0.47.23.C01.1.454.CMB.1.raw
tcagagctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggccctgtgctggtcgtccatgatgatagcgaccggccctcagggatccctgagcgattctctggctccaagtctgggaacacggccaccctgaccgtcagcagggtcgacgtcgggatgaggccgtatattttgtcaggtgtgggagtactaattttggtctatagtgttggttcggcgggtagggaccaaggctggaccgtccgtcggtcagcccgaaggtctcggccccctggtcaccgttctcgttccccgccctccgtcgtaccgg

SEQ ID NO: 290252 - DNA, 539 bp, Homo sapiens
  misc_feature: GYAE6OF01AWT24.47.23.C01.1.454.CMB.1.raw
tcagagctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccaggcccccggacagagacctgagtggatgggatggatcagcattggcaatggtaacataaaacactcacagaagttccagggcagggtcacattaccagagacatctccgcgaccacacgcctacatggaactgagcagcctgacttctagaagacacggtcttatttactactgtgcgagtagaggggtttgacgttaggaaccttccgtttactacgtacgttcgggacggttcgtgggggaccgaaaggggtacccg

SEQ ID NO: 290253 - DNA, 129 bp, Homo sapiens
  misc_feature: GYAE6OF01A00FZ.47.23.C01.1.454.CMB.1.raw
tcagagctcacgtacacgaccggtgctcgatttagtacacgtgattagggattgggcacagcggccctgggctgcctggtcaaggactacttcctacgtgagctctgagcgggctggcaaggcgcatag

SEQ ID NO: 290254 - DNA, 533 bp, Homo sapiens
  misc_feature: GYAE6OF01AV7A3.47.23.C01.1.454.CMB.1.raw
  modified_base (291)..(291): a, c, t, g, unknown or other
  misc_feature (291)..(291): n is a, c, g, or t
  modified_base (484)..(484): a, c, t, g, unknown or other
  misc_feature (484)..(484): n is a, c, g, or t
  modified_base (516)..(516): a, c, t, g, unknown or other
  misc_feature (516)..(516): n is a, c, g, or t
tcagagctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccaggcccccgganagagacctgagtggatgggatggatcgagcagttggacaagtggtaaacaagtaaaacactcaacagaacgttccagggcagggtcacataccagagacatctccgcgaccacagcctacatggaactgagcagcctgaccttctagaacgacacggtacttatttacactgtcgcgagtagtaggggtttanacgtggaacttctactagactcggacgttcgnggggcaaacgggtaccg

SEQ ID NO: 290255 - DNA, 525 bp, Homo sapiens
  misc_feature: GYAE6OF01AEW4G.47.23.C01.1.454.CMB.1.raw
  modified_base (292)..(292): a, c, t, g, unknown or other
  misc_feature (292)..(292): n is a, c, g, or t
  modified_base (433)..(433): a, c, t, g, unknown or other
  misc_feature (433)..(433): n is a, c, g, or t
tcagagctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccaggccccccgganagagacctgagtggatgggatggatcagcattggcaatggtaaacataaaacactacaacagaagtccagggcagggtcaccattaccagagacatctccgcgaccacacgcctacataggaactgagcagcctgacttcngaagacacgtctatttactacgtgtgcgagaggtagggttgacgtggacttccgttactacagtcggacgtgacggggacgaaagggacccg

SEQ ID NO: 290256 - DNA, 661 bp, Homo sapiens
  misc_feature: GYAE6OF01D1KUV.47.23.C01.1.454.CMB.1.raw
tcagagctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggacttccctgtggaaggaaacaacattaggaagtaagagtgtacattggtaccaacagaggccaggccaggccctgtgctggtcgtccatgatgatagccgaccggccctgagggactcccgtgacgccgtcttctcgtggctccaagttcgacgggaacaccggccaccctgaccactcgacgcgcggtacgaacgccggaagacgtgacggaccgtacttaagttacgtagtacgtaaagttttcgggaaccttacgtcgtcccggacgtcgggtaccggttacgttccggggaccgtaccggaacggggtaacccaaggtcccgtacggtaccccgtaccgtaaacggtccgaaccggtaccccgaacgggtcccgttccccggaccccccgttacggggttaccctaacccgttcccgtttacccggttcccccctaaccccgtttcccg

SEQ ID NO: 290257 - DNA, 264 bp, Homo sapiens
  misc_feature: GYAE6OF01CNRIT.47.23.C01.1.454.CMB.1.raw
  modified_base (246)..(264): a, c, t, g, unknown or other
  misc_feature (246)..(264): n is a, c, g, or t
tcagagctcacgtacacgaccggtgctcgatttagtacacgtgattagggattgggccgacggaaaccttgactactggggccagggaaccctggtcaccgtctcctcagcctccaccaagggcccatcggtcttccccctggcaccctcctccaagagcacctctggggggcacagcggccctgggctgcctggtcaaggactacttcctacgtgagctctgagcgggctggcaaggcgcatagnnnnnnnnnnnnnnnnnnn

SEQ ID NO: 290258 - DNA, 526 bp, Homo sapiens
  misc_feature: GYAE6OF01DND4E.47.23.C01.1.454.CMB.1.raw
tcagagctcacgtacacgaccggtgctcgatttagtacacgtgattagggattggggccccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccaggcccccggacagagacctgagtggatgggatggatcagcattggcaatggtaacataaaacactcacagaagttcaggcagggtcacattaccagagacatctccgcgaccacagcctacatggaactgagcagcctgacttctgaacgacacgggtactagtttacactgtagcgagagtaggggtttgacgttgggaacttccttactacattcgggacgtgtcggggcaaaggggtacccg

SEQ ID NO: 290259 - DNA, 247 bp, Homo sapiens
  misc_feature: GYAE6OF01DZCR5.47.23.C01.1.454.CMB.1.raw
  modified_base (245)..(247): a, c, t, g, unknown or other
  misc_feature (245)..(247): n is a, c, g, or t
tcagagctcacgtacacgaccggtgctcgatttagtacacgtgattagggattgggccgacggaaaccttgactactggggccagggaaccctggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnn

SEQ ID NO: 290260 - DNA, 560 bp, Homo sapiens
  misc_feature: GYAE6OF01DH7YY.47.23.C01.1.454.CMB.1.raw
  modified_base (466)..(466): a, c, t, g, unknown or other
  misc_feature (466)..(466): n is a, c, g, or t
tcagagctcacgtacacgaccggtgctcgatttagtacacgtgattagggagttggggcccaacaatcacatccctcctcagaagccccagagcacaactccttaccatggactggacctggaggatcgtctttttggtggcagcagccacaggtgcccactcccaggtccaacttgtgcagtctggggctgaggtgaagaagcctggggcctcagtgaaggtttcctggtcaggcttctggatacagcttcactagtcatgctatacattgggtgcgccaggcccccggacagagacctgagtggatgggatggatcagcattggcaatggtaaacataaaacactacacagaaagttccagggcagggtcaaccattaccagagacatctccgcgaccacagacctacatggaactgagcagcctgacttctagaacgacacggtacttagtttactacttggngtacgaggacgtggggttacgtaacttgggaaacttccttacgtacctagttccgggtaaacgttccgttaagggggccaaagggggtaccccg

SEQ ID NO: 290261 - DNA, 527 bp, Homo sapiens
  misc_feature: GYAE6OF01EPN6P.47.23.C01.1.454.CMB.1.raw
  modified_base (463)..(463): a, c, t, g, unknown or other
  misc_feature (463)..(463): n is a, c, g, or t
tcagagctcacgtacacgaccggtgctcgatttagtacacgtgattagggattggggcccaacaatcacatccctcctcagaagcccccagagcacaactccttaccatggactggacctggaggatcgtcttttggtggcagcagccacaggtgcccactccccaggtccaacttgtgcagtctggggctgaggtgaagaagcctggggcctcagtgaaggtttcctgtcaggcttctggatacagcttcactagtcatgctatacattgggtgcgccaggcccccggacagagacctgagtggatgggatggatcagcattggcaatggtaacaataaaacactacacagaagttccaggcagggtcaccattaccagagacatcctccgcgaccacagcctacatggaactgagcagcctagacttctgaacgacacggtcttattactactgtgcgagnggtaggggtttgacgttggaacttccgttactacacgtcggacgttgtgggacaaagggacccg

SEQ ID NO: 290262 - DNA, 689 bp, Homo sapiens
  misc_feature: GYAE6OF01BUF01.47.23.C01.1.454.CMB.1.raw
  modified_base (291)..(291): a, c, t, g, unknown or other
  misc_feature (291)..(291): n is a, c, g, or t
tcagagctcacgtacacgaccggtgctcgatttagtacacgtgattagggattggggcccaacaatcacatccctcctcagaagccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccacggcccccgganacgacgacctgacgtggagtgggatggatcgagcagttggactaagtaggtaaacaataaaaaccactacaacgaagtaaacgttaccgaggggctaaggggtaccaaccgtaatttaacccgaaggaacgaacctaacgttacccgtacccgacccggaaacccaacccgtaacggaccccttaaacgaacgttaacgggaaacctaggaacgccgaacggtccctacggtaccctttacgaacggtaaacgaacccgtaccgggtaacctttaagttttaaccgtaccgttagtacggaccgtaagggtagggttacggggtttagacgttacgggtaaccttccgttaactacgtagtcgggtacgtacggtacgggaacggtaacgggtacccg

SEQ ID NO: 290263 - DNA, 689 bp, Homo sapiens
  misc_feature: GYAE6OF01AT89H.47.23.C01.1.454.CMB.1.raw
  modified_base (478)..(478): a, c, t, g, unknown or other
  misc_feature (478)..(478): n is a, c, g, or t
tcagagctcacgtacacgaccggtgctcgatttagtacacgtgattagggattggggccccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctgggcctcagtgaaggtttcctgtcaggcttctggagtacagtcttctactagtcatgctatacagttggtgcgccacggcccccggacacgacgacctggaggtggagtgggagtggatcgacgcagttggacaagtaggtaaacgaaactaaaacaactacaacaagaacgttaccgtaacgggacgtacggtacaacctaacttaaccgagaacgaccacttccgtaccgaccgaacccaccgacgaccctaacagtacggtaaaccgnggtaacgctaccggcccttaggtacctttaccgtaacgggaaacacccggtacggtaaccctttaagttttaacctaaccgttgtacgggacgggtaacggtaagggttaccggggggttttataaccggttacgggtaacctttccgttacccgtaagtaacggtcgggttacggtaccgggtcgggggaaacaaacccgggggtacccg

SEQ ID NO: 290264 - DNA, 607 bp, Homo sapiens
  misc_feature: GYAE6OF01AI00N.47.23.C01.1.454.CMB.1.raw
tcagagctcacgtacacgaccggtgctcgatttagtacacgtgattagggattggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagagtgtacactggtaccaacagatgccaggccaggcccctgtgctggtcgtctatgatgatagtcgaccggccctcgtgggactccccggagccgtattccgtctggcctccgaagtcgtagggaaccaccgggcccacccgtgacccgtcgacgcgacgggtcgacgggtcggggagtggacggtccgttattagtttttgcgtagggtggtagggagtacgttaagttttggtactagttagttgttggttcgggtcgggtaacgggtacctaaggtcgtcggtaccgtccgttaggtcgacggcccgaagggcctccgcccccgtcgtcctaccgttcgtccgttccccgtcccgttccgtaccg

SEQ ID NO: 290265 - DNA, 249 bp, Homo sapiens
  misc_feature: GYAE6OF01DDC0V.47.23.C01.1.454.CMB.1.raw
  modified_base (245)..(249): a, c, t, g, unknown or other
  misc_feature (245)..(249): n is a, c, g, or t
tcagagctcacgtacacgaccggtgctcgatttagtacacgtgattagggattgggccgacggaaaccttgactactggggccagggaaccctggtcaccgtctcctcagcctccaccaagggcccatcggtcttccccctggcaccctcctccaagagcacctctgggggcacagcggccctgggctgcctggtcaaggactacttcctacgtgagctctgagcgggctggcaaggcgcatagnnnnn

SEQ ID NO: 290266 - DNA, 550 bp, Homo sapiens
  misc_feature: GYAE6OF01EDA13.47.23.C01.1.454.CMB.1.raw
  modified_base (444)..(444): a, c, t, g, unknown or other
  misc_feature (444)..(444): n is a, c, g, or t
tcagagctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggttttcctgtcaggcttctggatacagcttcactagtcatgctatacattgggtgcgccaggcccccggacagagacctggagtggatggggatggatcagcagttggacaatggtaaacaataaaaacactacaacagaagttccgaggcagggtcaccaattaccagagacatctccgcaccacagcctacataggaactgagcagcctgacttcgagaanacgacggacttatttactactgtcgacgaggtaggtaggggtttgaccgttggaacttccgttacgactagtcgggtaacgtcggtcggggacaaaggggtacccg

SEQ ID NO: 290267 - DNA, 634 bp, Homo sapiens
  misc_feature: GYAE6OF01EIM8S.47.23.C01.1.454.CMB.1.raw
tcagagctcacgtacacgaccggtgctcgatttagtacacgtgattagggattggggcccaacaatcacatccctcctcagaagcccccagagcacaactccttaccatggactggacctggaggatcgtcttttggtggcagcagccacaggtgcccactccccaggtccaacttgtgcagtctggggctgaggtgaagaagccgtggggcctcagtgaaggtttcctgtcaggcttcgtggatacagctttcactagtcatgctatacagttgggtgccgccgacggccccccggacaggacgacctggaggtgggagtggggatgggatcgagctagttggactaagtacggtaaacaataaaacactacaacgaagaacgttccggaaggacgtacgggtaccaaccattaaccaagacgacactcctaccgacgaacccacgacgacctacaagtacggaacctagagaccagcccgttagaccttcgaacgaacgaccgacggtactttaattacctaacgtcgtaggacggtaggtagggtaaggggtttagaccgttaggtaacccttcgttaacgtaaagtcgggtacgttacggaggggtaacgaaacgggtcccgtaaccggg

SEQ ID NO: 290268 - DNA, 678 bp, Homo sapiens
  misc_feature: GYAE6OF01DN4PT.47.23.C01.1.454.CMB.1.raw
  modified_base (366)..(366): a, c, t, g, unknown or other
  misc_feature (366)..(366): n is a, c, g, or t
tcagagctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaaccaacagaggccaggccaggcccctgtcgctggtccgtcatgatgatacgcgaccggccctcgagggactccctgacgcgtcttctcgtggctccaattcgtagggaacnccggcccacccgtgaccatcaggcgcggtacgaacggccgggagacgtggacggtaccgttagtttagtttttcggtacgtagggttggtggggtacgttaacgtttaagttttggtactaatttagtttggtttcgggttcggggtacggggtaacgggtaacccgtaaggtccgttaccggtacccggttcccggttccgggtaccgaaccggtaccccgaacggggttccctaccccgggtcccccccgttacgggttaccctacccgttccgtttaccccggtttccccctacccccgttacccccgg

SEQ ID NO: 290269 - DNA, 800 bp, Homo sapiens
  misc_feature: GYAE6OF01DMNSN.47.23.C01.1.454.CMB.1.raw
  modified_base (240)..(240): a, c, t, g, unknown or other
  misc_feature (240)..(240): n is a, c, g, or t
  modified_base (300)..(300): a, c, t, g, unknown or other
  misc_feature (300)..(300): n is a, c, g, or t
tcagagctcacgtacacgaccggtgctcgatttagtacacgtgattagggattggggccccaacaatcacatccctcctcagaacgccccagagcacaactccttaccatggactggacctggaggatcgtctttttggtggcagcagccacaggtcgcccactcccacggtccaacttgtgcagtctggggctgaggtgaagagcgtgggctcagtgaagtttcctgtcgaggcttcgnggatacagtcttcactagtcatgctatactagttcgggtgccgccgaccggcccccgganacggacgaccgtagacgggttgacggttgggacgttagggactacgacggtacgtaagtttcggaaccgtaaaagtagggttaaaacctaaaacgtaaaaacctaccgttaaccaaacgtaaacggtaaaccggtttaccggaacggggtaccgtaacgggtacccaaacgtaacccgtttaaaccggaggaaaccggtactaaccttcccggtaccccggaaccaaccccgtaacgaaccgtacccgtaactaacgtacgggaacctaggaaccgtcaaccggtcccttaggtaacccgtttacggtaacggtaaacgtacccggtaaccggttaccttttaaacgtttacccgttagttacggttacggacgggtaacggtacgggttaaaggggtttcgaaccggttagggtaacccctttcggttaacctaccggttaacggttacggggacccgttacggggtaacggggtaacccggaaaggggttacccccgg

SEQ ID NO: 290270 - DNA, 597 bp, Homo sapiens
  misc_feature: GYAE6OF01BUZW8.47.23.C01.1.454.CMB.1.raw
  modified_base (240)..(240): a, c, t, g, unknown or other
  misc_feature (240)..(240): n is a, c, g, or t
  modified_base (294)..(294): a, c, t, g, unknown or other
  misc_feature (294)..(294): n is a, c, g, or t
tcagagctcacgtacacgaccggtgctcgatttagtacacgtgattagggattggggccccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttcnggatacagcttcactagtcatgctatacattgggtgcgccgaggccccccgganacgacgaccctgacgtggaactgggatggatcagcagttggcaatggtaacaataaaacactacacagaacttccgaggcgagggtcacctattaccgagagacatcctccgcgaccctacacgacctacacgtacggaactgagtcacgcctgacttcagaacgaccgacgtacttatttactacgtgtccgaggaggtaggtaggggtttcgaacggttacggtaacccttcccgtttaacgtaaccgtacgtacgggtaacccggtcggttacgggggaccgaaacggggtaaccccggg

SEQ ID NO: 290271 - DNA, 720 bp, Homo sapiens
  misc_feature: GYAE6OF01DQMY5.47.23.C01.1.454.CMB.1.raw
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
  modified_base (312)..(312): a, c, t, g, unknown or other
  misc_feature (312)..(312): n is a, c, g, or t
tcagagctcacgtacacgaccggtgctcgatttagtacacgtgattagggattggggcccaacaatcacatccctcctcagaacgccccagagcacaactccttaccatggactggacctggaggatcgttctttttggtggcagcagccacaggtcgcccactcccaggtccaacttgtgcagtcgtggggctggaggtgaagaacgccgtggggcctcaggtgtaaggtttcctgtcaggtcttcgtaggatacngtctcactacgtnagtgtctaatactagttgggtcgcgaccgaccgggccccganacgacgtacctaggaggtggagtgggatggatcgagctagttcggactaaagtacggtaaactaaactaaaaacctaccgtaacgaaacgtaacggtaaacgttccggaacgggacgtaacggtaccaaccgtaacttaaccgaagtaacgaactaacgtcccgtacccggtacaacccagtaccgacccttaagacggtacggaactcggaacaccgtacgtcctggttaccttcgtaacggaacgaccgtaaccggtttacttaaacgttttctaaccggtgtaacggtaccggtaaggacggggtttacgggttacgtaacgttaccggttaaccttcccgtttaaacgtacgtacggttaccggtacggttacgggacggggtaaaccgtaaacggggtccccg

SEQ ID NO: 290272 - DNA, 130 bp, Homo sapiens
  misc_feature: GYAE6OF01CUBUK.47.23.C01.1.454.CMB.1.raw
  modified_base (124)..(124): a, c, t, g, unknown or other
  misc_feature (124)..(124): n is a, c, g, or t
  modified_base (130)..(130): a, c, t, g, unknown or other
  misc_feature (130)..(130): n is a, c, g, or t
tcagagctcacgtacacgaccggtgctcgatttagtacacgtgattagggattgggcacagcggccctgggctgcctggtcaaggactacttcctacgtgagctctgagcgggctggcaaggcncatagn

SEQ ID NO: 290273 - DNA, 665 bp, Homo sapiens
  misc_feature: GYAE6OF01CLB6N.47.23.C01.1.454.CMB.1.raw
  modified_base (229)..(229): a, c, t, g, unknown or other
  misc_feature (229)..(229): n is a, c, g, or t
  modified_base (292)..(292): a, c, t, g, unknown or other
  misc_feature (292)..(292): n is a, c, g, or t
  modified_base (350)..(350): a, c, t, g, unknown or other
  misc_feature (350)..(350): n is a, c, g, or t
tcagagctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcagtctggggctgaggtgaagaagccgtggggcctcagtgaaggtttccngtcaggcttctggatacagcttcactagtcatgctatacattgggtgcgccacggcccccganagacgacctgagtggatggatcggatcagcagtggacaagtaggtaacaactaaaacnctcaacagaacgttccgaggcgaagggtcaaccattaccagacgacatctccgacgaccacacgacctaacagtacggaacgtgaacgcgaacgcccgtagtaactttccgaagaaaccgtaccgaacggttacctttaaacgttttaccgtaaccgtggtaacggtaccggtaacgggtaaggggttaacgggggttttacgaaccggttaacggggtaaacccctttcccgtttaaccgtaaccgttaacggttaccggggtaaccgttaccgggttacgggggtaaacccgaaaacgggggtaaacccccgg

SEQ ID NO: 290274 - DNA, 723 bp, Homo sapiens
  misc_feature: GYAE6OF01D1F76.47.23.C01.1.454.CMB.1.raw
  modified_base (277)..(277): a, c, t, g, unknown or other
  misc_feature (277)..(277): n is a, c, g, or t
  modified_base (294)..(294): a, c, t, g, unknown or other
  misc_feature (294)..(294): n is a, c, g, or t
tcagagctcacgtacacgaccggtgctcgatttagtacacgtgattagggattggggcccccaacaatcacatccctcctcagaagcccccagagcacaactccttaccatggactggacctggaggatcgtctttttggtggcagcagccacaggtgccccactcccaggtccaacttgtgcagtctggggctgaggtgaagaagcctgggcctcagtgaaggtttcctgtcaggcttctggatacagcttcactagtcatgctatacattgggtncgccacggcccccgganagagacctgagtggatgggatggatcagctagttggacaagtggtaaacaataaaacgactacaacgaagtaaagttccgaagggcgtacgggtacaacccgtaattaacccgaaggtacgaactacgttcccgtacccgaccggaaaccccacaaccggtacccctaacgtaacggtaccgggaaacctacggaacgccaaccggtcccgttaacgtaccttttacgtaagaaccggaaccgtaaccgggtacctttaaacgttttaccttaacgttcggttacggaccggtaaagggtacgggtaagggggttttacgaaccggttaacggtaaccctttcccggtttaacttaaaccgaacggtttaccgggtaaccggtttaccgggaacgggggtaacccgtaaaaccgggggtaaccccccgg

SEQ ID NO: 290275 - DNA, 621 bp, Homo sapiens
  misc_feature: GYAE6OF01EM8OI.47.23.C01.1.454.CMB.1.raw
  modified_base (214)..(214): a, c, t, g, unknown or other
  misc_feature (214)..(214): n is a, c, g, or t
  modified_base (407)..(407): a, c, t, g, unknown or other
  misc_feature (407)..(407): n is a, c, g, or t
tcagagctcacgtacacgaccggtgctcgatttagtacacgtgattagggattggggccccaacaatcacatccctcctcagaagcccccagagcacaactccttaccatggactggacctggaggatcgtctttttggtggcagcagccacaggtgcccactcccaggtccaacttgtgcagtctggggctgaggtgaagagcctggggcctnagtgtaaggtttcctgtcaggtcttctggatacagtcttcactagtcatgctatactagttgggtgcgccgacggccccccggagagacgacctaggagtcgggagtggggatggatcgagctagttggacaagtacggtaaacaataaaacactacaacaagaagttccgaggcagggtcacattaccaganacatccgtacgcgaccacacgtacctacacgtagaactgacgcacgcgtcgaccttctaggaacgactacggtacttaactttacctacgtcggttagaccggtaggtagggtaacggggtttcgtaacggttcggtaaaccttcccgttactaacgtaacggttcgggtaaccggttcgggtacgggggaaccgtaaacggggtaaccccggg

SEQ ID NO: 290276 - DNA, 593 bp, Homo sapiens
  misc_feature: GYAE6OF01B9WJH.47.23.C01.1.454.CMB.1.raw
  modified_base (291)..(291): a, c, t, g, unknown or other
  misc_feature (291)..(291): n is a, c, g, or t
  modified_base (416)..(416): a, c, t, g, unknown or other
  misc_feature (416)..(416): n is a, c, g, or t
tcagagctcacgtacacgaccggtgctcgatttagtacacgtgattagggattggggcccccaacaatcacatccctcctcagaagcccccagagcacaactccttaccatggactggacctggaggatcgtctttttggtggcagcagccacaggtgcccactcccaggtccaacttgtgcagtctggggctgaggtgaagagcctggggcctcagtgaaggtttcctgtcaggcttctggatacagcttcactagtcatgctatacattggtgcgccaggcccccgganagagacctgagtggatggggatgggatcagcattggacaagtggaaacataaaacactcaacagaagttccgaggcagggtcacattaccagacgacatcctccgacgtaccacgacgccctaanacgtacggaactgacgaccagcctgaccttcgaggaacgaccgaacggtcttaacttttactacgttgtggaccggaaggtacgggtaagggggtttcaacgttacgggaaacctttcccgttacgttaacaggttacgggaccggttgacgggggacctaaaacgggggtaccccg

SEQ ID NO: 290277 - DNA, 733 bp, Homo sapiens
  misc_feature: GYAE6OF01CTF4G.47.23.C01.1.454.CMB.1.raw
  modified_base (249)..(249): a, c, t, g, unknown or other
  misc_feature (249)..(249): n is a, c, g, or t
tcagagctcacgtacacgaccggtgctcgatttagtacacgtgattagggattggggcccaacaatcacatccctcctcagaagcccccagagcacaactccttaccatggactggacctggaggatcgtctttttggtggcagcagccacaggtcgcccactcccaggtccaacttgtgcagtcgtggggctggaggtgaagaacgccgtggggcctcgagtgtaacggtttcctgtcaggtcttcgnggactacgacgtcttacactagtcatcgactatactagttgggtcgccgccgacggcccccgagaggacgaccgtgaggtggagtgggagtggatcgaagcgtagttggactaagtaggtaaacctaagtaaaaccacgtacgaacgaaggtaaacgttccgaggggtacctacgggtacccaaccgtaacgtaacccgaagacgaacctacgtccgtacccgaccggaacccaacgaccgtaacctaaccgaacgttacgggaactcggaacgtacacgtaccgttagtacctttcgaacgtaaacgaccgtaacgggttacttaacgttttaacccgtacgttaggtacgtacgggtaaaggtacgggttaaggggtttacgtaaccggttacggttaacccttcccgtttaccgtaacgtacggttaccggggtacggttaccgggtaacggggtaaccggaaaccggggtaaaccccggg

SEQ ID NO: 290278 - DNA, 582 bp, Homo sapiens
  misc_feature: GYAE6OF01EHLMK.47.23.C01.1.454.CMB.1.raw
  modified_base (315)..(315): a, c, t, g, unknown or other
  misc_feature (315)..(315): n is a, c, g, or t
  modified_base (324)..(324): a, c, t, g, unknown or other
  misc_feature (324)..(324): n is a, c, g, or t
  modified_base (448)..(448): a, c, t, g, unknown or other
  misc_feature (448)..(448): n is a, c, g, or t
tcagagctcacgtacacgaccggtgctcgatttagtacacgtgattagggattggggcccccaacaatcacatccctcctcagaagcccccagagcacaactccttaccatggactggacctggaggatcgtctttttggtggcagcagccacaggtgcccactcccaggtccaacttgtgcagtctggggctgaggtgaagaagccgtggggcctcagtgaaggttttcctgtcaggtcttctggatacagcttcactagtcatgctatacattgggtgcgccgaggcccccgacagacgacctggagtggagngggttttanggatcagcattggcaatggtaacaataaaacactacacagaacgttcgagggcacgggtacacattaccagagacatctccgacgaccacacgcctacatggaactgagcacgcctgtaccttnacgaagaccgaggtactttagtttactacgtgtcgacgaggtaggtaggggtttacgacgttacgggtaaccttcccgttactaacctgttacggtacgttaccggtacgggggaccgaaacgggtaaccccgg

SEQ ID NO: 290279 - DNA, 799 bp, Homo sapiens
  misc_feature: GYAE6OF01BUC9Z.47.23.C01.1.454.CMB.1.raw
tcagagctcacgtacacgaccggtgctcgatttagtacacgtgattagggattggggcccaacaatcacatccctcctcagaagccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttcgtggatacagcttcactagtcatgctatactagttgggtgcgccacgggcccccggacagagacctggagtggagtggggatggatcagctagttgggacaagtaggtaaacaaagtaaaacactacaactaaggtaaacgttccgaaggggtacgaacgggtacaaccgtaacttaacccgaagaacgactaacttcccgtccgacccgaacccaccacggaccctaacgtaagtacgggaaacgtcggaacgcgtaaccgtccgttaccgtacgttttacgtaaggaaaccggtaacccgtaacgggttaaccttttaaacgtttttaaacccgttacgttacgggttaacggtacccgggtaaagggttaccgggggtttaaacggggggtttttacggtaaaccgggttttacggggttaaaccccgttttacccccgtttttaaacccgttaacccggtttaaacgggttacccgggggttaaacccgggtttaccccgggggtttaacgggggggtaaaccccgggtaaaaacccgggggggttaaacccccgggg

SEQ ID NO: 290280 - DNA, 637 bp, Homo sapiens
  misc_feature: GYAE6OF01CAEXP.47.23.C01.1.454.CMB.1.raw
  modified_base (292)..(292): a, c, t, g, unknown or other
  misc_feature (292)..(292): n is a, c, g, or t
tcagagctcacgtacacgaccggtgctcgatttagtacacgtgattagggattggggccccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctgggcctcagtgaaggtttcctgtcaggcttctggatacagcttcactagtcatgctatacagttgggtgcgccaggcccccgganagagacctggacggtggagtgggatggatcgagcagttggactaagtggtaacataaaacactacaacagtaacgttccgagggacgagggtaccaaccgtacttaaccgagaacgacagtcccaccgacgaacccacgtacgtcctaacacgttacggaaacttgacgaccgaacgtccgtagtaccttacgtagaacgaccgtaccgggtacttaacgtttaactacgttcggtagaccggtaggtacgggttacggggtttagacgttacgggaacctttccttaccgtaagtacggttcgggtacgttaccgggtaggggaccgtaaacggggtaccccgg

SEQ ID NO: 290281 - DNA, 655 bp, Homo sapiens
  misc_feature: GYAE6OF01ANTQD.47.23.C01.1.454.CMB.1.raw
  modified_base (216)..(216): a, c, t, g, unknown or other
  misc_feature (216)..(216): n is a, c, g, or t
tcagagctcacgtacacgaccggtgctcgatttagtacacgtgattagggattggggcccaacaatcacatccctcctcagaagcccccagagcacaactccttaccatggactggacctggaggatcgtcttttggtggcagcagccacaggtgcccactcccaggtccaacttgtgcagtcgtggggctggaggtgaagaagccgtggggcctnagtgtaaggtttcctgtcgaggtcttcgtggatacgagcttcactagtcatgctatacagttgggtgcgccgacggcccccggagagacgaccgtggacgtggagtgggatggatcgagcgtagttggactaagtaggtaacaaactaaaacgactacaacgtaagaaacggttccggaagggtacgtaacggggtaccaaccgtaagttaacccgaaggaacgacaacgttcctacccgaccgtacccacgacgtcccgtaacacgtacggtaactacgtacgactacgcctacggtacctttacgagaaacgaccgtacgtacttaactttaccgttaacgtgtcggacgtacggtaggtacgggtttagaccgtaggttaaccttccgttacaacggttgtacggtaccggtgaacggggaccgaacgggtacccg

SEQ ID NO: 290282 - DNA, 649 bp, Homo sapiens
  misc_feature: GYAE6OF01CEPPQ.47.23.C01.1.454.CMB.1.raw
  modified_base (275)..(275): a, c, t, g, unknown or other
  misc_feature (275)..(275): n is a, c, g, or t
tcagagctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtncgccaggcccccggacagagaccctgacggtcggactgggactagggactcgaagtcgattggcaagtggtaacagtaaaacacgtacaacgagaagttccgagggtcacgggtacacgacgtttaccaaggacgacgtactacctccggacgacccacacgtccctaagacttaggaacctaggacgacgacgtaacctggtaaccttacgtagtaacggacgtaccgggtactttaacgtttacgtacttcggttacggtacggaacgggtaggttacgggggttactaccgggttaggttaaccggttacccttcgtaaatacggttcgggtaccttagggtaccgggaaggtaaaccgggtaaacccggg

SEQ ID NO: 290283 - DNA, 768 bp, Homo sapiens
  misc_feature: GYAE6OF01CGN36.47.23.C01.1.454.CMB.1.raw
  modified_base (377)..(377): a, c, t, g, unknown or other
  misc_feature (377)..(377): n is a, c, g, or t
tcagagctcacgtacacgaccggtgctcgatttagtacacgtgattagggattggggcccaacaatcacatccctcctcagaagccccagagcacaactccttaccatggactggacctggaggatcgttctttttggtggcagcagccacaggtgcccactcccaggtccaacttgtgcagtcgtggggctgaggtgaagaacgccgtggggcctcgagtgtaaggtttcctgtcaggtcttcgtggatacagtcttcactagtcatgctatactattgggtgccgccgacgggccccccggagaggacgaccgtggaggtcggagtcgggatggatcgaggctagttggctaagtaggtaaacaacttaaaaacnccttaacaacgtaagtaaacggttaccgaaggggtaccgtacggggtacccaaaccgtaacgtttacccgaaggaacgtaaccgtaacttcccggtacccgaccggaacccaaacgtaccggtaccctaagtacgtacgggaaaccgtaggacgtacgtaacggtcccgttagtaccctttacggtaaggaaaccgaccgtaaccgggttactttaacgtttaccctaacggttggtacggtaaccgggaagggttacggggttaaacgggggttttaccggtaaccggttacggttaaaccccgttccgtttaaaccgaaccggtttaggtaccgggtaccgggttaccgggtaacgggggtaaacccggtaaaggggtaaccccccggg

SEQ ID NO: 290284 - DNA, 801 bp, Homo sapiens
  misc_feature: GYAE6OF01ER72S.47.23.C01.1.454.CMB.1.raw
  modified_base (273)..(273): a, c, t, g, unknown or other
  misc_feature (273)..(273): n is a, c, g, or t
  modified_base (290)..(290): a, c, t, g, unknown or other
  misc_feature (290)..(290): n is a, c, g, or t
tcagagctcacgtacacgaccggtgctcgatttagtacacgtgattagggattggggcccaacaatcacatccctcctcagaagccccagagcacaactccttaccatggactggacctggaggatcgtctttttggtggcagcagccacaggtgcccactcccaggtccaacttgtgcagtctggggctgaggtgagagcctgggcctcagtgaaggtttcctgtcaggtcttctggatacagcttcactagtcatgctatacatttgggtncgccacggcccccgganagacgacctggacggtggagtgggatggactcgaagtcgtagttggactagtacggtaaactaataaaactacttaccaagtaacggtaaacgtttacccggaaggggacctaacgggggttaccaaacccgtaacgtttaaacccggaagtaacggtaaccacgtttaccgttacccggaccggtaacccacgaccggtaccctaaacgtaacgttagggaaccgttaggaaccgtaccgaacggtccccgtttacggttaacctttcgttaacggaaacgggtaccccgtaacggggtacccttttaaacgtttttaaccgtaacccgtttaggtacggtaacggtttaacggggtaacggggttaacggggggtttttacgaacccgggttttaaggggaaaccccttttcccggttttaacccgtaaccggtaccggggtttacggtaacccgggtttaccggtaccgggggggtaaaccgtaaaaccggggggttaaccccccggg

SEQ ID NO: 290285 - DNA, 566 bp, Homo sapiens
  misc_feature: GYAE6OF01EOC4I.47.23.C01.1.454.CMB.1.raw
  modified_base (328)..(328): a, c, t, g, unknown or other
  misc_feature (328)..(328): n is a, c, g, or t
  modified_base (546)..(546): a, c, t, g, unknown or other
  misc_feature (546)..(546): n is a, c, g, or t
tcagagctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgccccactccccaggtccaacttgtgcagtctggggctgaggtgaagagcctgggcctcagtgaagtctcctgcaggcttctggatacagtcttccaccgtactactatttgcactgggtgcgacggcccctggacaagggcttgagtggatgggacggatcgagccctaagngtggtggcaacaactatgacagtaggacggtttcagggcgagggtcaaccgtagtcgaaccgagggaccacgtccaatcgacgtacagtccctagaagtggaacgctaggacgctagtctgaacgccctagacgacacggccgttgtattgttgcgtcgttagtcggagagttcgtacgtttgattcggtcaacgttacccggagttacggtcggganaaacgggtccaggtaccccg

SEQ ID NO: 290286 - DNA, 862 bp, Homo sapiens
  misc_feature: GYAE6OF01BTPI3.47.23.C01.1.454.CMB.1.raw
tcagagctcacgtacacgaccggtgctcgatttagtacacgtgattagggattgggggctggggcctaaggaagcagcactggtggtgcctcagccatggcctggaccgttctcctcctcggcctcctctctcactgcacagactctgtcgcctcctatgtactgactcagccactccgtcgggtggcaggtcggccccaggacacggaccggccgaggtacttcccgtgggtacgggaaggaaaaccaacgtagttagggaaaggtaaggagttacgttaactagtttacggaaaccaaccggaaggacgggcccagggcccacgggtccctggtcgcccgtgggttcccgactagtcgtagtagtacgacggacccggacccggccctagggacgggtacctcccgaggtacggccgttcccttcgtcgtaccggtccttacgttaacgttcggtaaccggggaaaccccaccgggtacccccacccgtacgaaccctagtacccggacgggtcccgggacggtaaccgggaaccggacccgggtaaggtacgacgggaccgtaacccggtacgtttaacttaccggttgggaacggttggggtcggtaacggggaattaaacgttaagggtacggaccgtaacccgggttcccgggtcgggttaaccgggtttcggggggtttaccccggggtagggggtaacccggtaaccggacccggttacccgggttaccggtaacccccgtttaaccgggtaccttaacggggaccccctaacccggggtaccgtcccccggtacccccgttccccgggtaccggtaccccctccgttttccccggtcccccggttccccccgg

SEQ ID NO: 290287 - DNA, 824 bp, Homo sapiens
  misc_feature: GYAE6OF01CDSNS.47.23.C01.1.454.CMB.1.raw
  modified_base (139)..(139): a, c, t, g, unknown or other
  misc_feature (139)..(139): n is a, c, g, or t
  modified_base (233)..(233): a, c, t, g, unknown or other
  misc_feature (233)..(233): n is a, c, g, or t
  modified_base (309)..(309): a, c, t, g, unknown or other
  misc_feature (309)..(309): n is a, c, g, or t
tcagagctcacgtacacgaccggtgctcgatttagtacacgtgattagggattggggcccaacaatcacatccctcctcagaacgccccagagcacaactccttaccatggactggacctggaggatcgtctttttggnggcagcagccacaggtcgcccactcccaggtccaacttgtgcagtcgtggggctggaggtgaagacgccgtgggcctgagtgtaacggtttccngtcacggtcttcgtggatacacgtcttcactagtcatgacttatactaggttggtcgccgccgacggcccccgganaggacgtaccgtggaggtcggagtcggatggactcgagtctagttcggactaagtacggtaaactaaacgtaaaacctcgtaacgaacgtaacggtaacggttaccggaaggggtaccgtaacgggtacctaaccgtaacttaaccggaagtaccaacgtactccggtaccccggaccgaaccacgtacgtaccttaacggagttaccgggaaacctggaccgtacgtaaccggtccttacggtaaccttacggtaacggaaccgtacccggtaacgttacccgttttaaactttaccggtaccgttcgggtaacgggtccggttaaagggggttaccggggtttaagggggttttaccgtaaaacccgggtttacccggggttaaaccccgtttttcccggtttaacccggtaaaccggtttaacgggggtttaacccggggtacccgggttttaaacccggggggaaccggggttaaaaacccgggggtaaaccccggggttaaacccccggg

SEQ ID NO: 290288 - DNA, 807 bp, Homo sapiens
  misc_feature: GYAE6OF01DX4MA.47.23.C01.1.454.CMB.1.raw
  modified_base (165)..(165): a, c, t, g, unknown or other
  misc_feature (165)..(165): n is a, c, g, or t
tcagagctcacgtacacgaccggtgctcgatttagtacacgtgattagggattgggactgggcctaaggaagcagcactggtggtgcctcagccatggcctggaccgttctcctcctcggccctcctctctcactgcacagactctgtcggcctcctatgtactnactcagccatcctcggtggcaggtcggccccaggacagaccggccaggtacttcccgtgtagggaacggaaaactaactagtttagggaaagttaacggaggttagtaactagttacgggtaacccaaacgaggacggaccgacgggtaccaaccgggcccctggtcgcgttcgggtccgttccgatgtatcgtaagtacggccggacccggtcccgtacgaacgggtactcccgtagacgtccgtccttcgtccgttcggtccttacgtaacgtttccgtacgggaaacgacccggtaccccaccctacgtaccgaacttaccggaacggtaccgggtaacggtaaccggacggggaccccggtagaacggtcgggaaccgggtacccgtaaagttaccgtttacgtaggtaccggtagggttaggtacgggactaaggttaagagtacgtaccgtccggaagttcggttaacggtttcgggacgggtacgggaacctacggtacctaccggtaccggttaccgttaaaacggtcccggtaacccggccccgtaaaccggggtccctaccccccgggttacccccggttaaccggttacccgttaacccgtttcccgtttaccccgggtttaacccccccc

SEQ ID NO: 290289 - DNA, 819 bp, Homo sapiens
  misc_feature: GYAE6OF01ECTRO.47.23.C01.1.454.CMB.1.raw
  modified_base (239)..(239): a, c, t, g, unknown or other
  misc_feature (239)..(239): n is a, c, g, or t
tcagagctcacgtacacgaccggtgctcgatttagtacacgtgattagggattggggccccaacaatcacatccctcctcagaacgccccagagcacaactccttaccatggactggacctggaggattcgttctttttggtggcagcagccacgacggtcgcccactcccgaggtacctaacttgtgctagtcgtgggctaggaggtagaagacgcgtgggcctgagtgtacgtttcngtcgagtcttcgtaggactacgacgtcttacactagtctagtcgtacttactacgtaggtttggccgccgaccggacccgggaccccggtaacgacggaaccgaccggttagggaggttagggtacggtgggaagtacggactacggtagtcgttaaggttcggtaacgttaaaggttaacggtaaaacaaacgtaaaacgtcccaacgtaaacggtacgtaacgttaccggaggtacgtaaccggtactaaccgttactaacgaagtaccacgtacgtcccgtaccgacctaacgaaccgtacacccgtaagtaccggtacgtaacgtacgtaccgacgtaccgtacccgtttaacggtaccgttaacggaaccggtaaaccgtacccggtaagttttaacgttttacccgtttaacgtacggttagggtaccgttaaacgggtagggttaaacggggtttacgggtttaacggaaccgtttaacggtttacccgtttaccgttaacggttaacggttacgggttaaccgggacggtttaacggggaacggggtaacccgggaaacccggggttacccg

SEQ ID NO: 290290 - DNA, 988 bp, Homo sapiens
  misc_feature: GYAE6OF01C9H6P.47.23.C01.1.454.CMB.1.raw
tcagagctcacgtacacgaccggtgctcgatttagtacacgtgattagggattggggccccaacaatcacatccctcctcagaacgccccagagcacaactccttaccatggactggacctggaggatcgtctttttggtggcagcagccacgaggtcgcccacctcccgacggtccaacttgtgctagtcgtggggctggaggtgaagacgccgtggggacctcgaggttacggtaacggttttcccgtagttacgacggtctttacgtacggtactaacgtacgttccctttacgaacgttacggttacaagtcgtacttacgtaactaggtttggggacgtccggacccgaacccggggcccccggtaagaacgtaccggtaaccggtgaagggttacggagtaggggtgtagggtactagtacggtacgtaggttacggaaacgttaggtaacgtaaactaaacgtaaaaccgtaccaacgtaacggaactaaacgggttacccgacgggtacgtaaccggggtaccaaacccgtacgttaaaccgaacggaccgttaaactaccctaccgggttaccccgaacccgggtaaaccctaaccgggtaacccctacgtaaaccggtaacggtaacccgggttaaacggttaacccgggacccggtaaacgtacccgggtcccttaggttaaacccccggttttacggaaacccgggtaaaccggtacccgggttaaacccgttttaccgtttaaacccggttttaccttaacccgggtacgggtaaccggtaaccgggtttaaagggttaaaccgggggggttttaaacggttaccgttaaacccgggggtttaacccgtttaaccgtttcccccgttttaaaccgggtaaacgtttacccggggttaaccgggttaacccgggggttaacgggttttaaacccgggggaaacccgggttaaaaccccggggtttaaccccggggg

SEQ ID NO: 290291 - DNA, 704 bp, Homo sapiens
  misc_feature: GYAE6OF01DO5HN.47.23.C01.1.454.CMB.1.raw
  modified_base (267)..(267): a, c, t, g, unknown or other
  misc_feature (267)..(267): n is a, c, g, or t
tcagagctcacgtacacgaccggtgctcgatttagtacacgtgattagggattggggcccaacaatcacatcccctcctcagaacgccccagagcacaactccttaccatggactggacctggaggatcgttctttttggtggcagcagccacaggtgccccactcccaggtccaacttgtgcagtctggggctggaggtgaagaagccgtgggcctcgagttgtaaggtttcctgtcaggtcttcgtggatacagtcttcatagtnaatgctatactattgggtgccgccgacggcccccggacaggacgaccgtgagtgggagtggggactggatcgagctagttggataagtaggtaaacaataaaacactacaacaaggtaagttaccgaagggcgacggggtacaccgtaactttaaccgaaggtaacgaccgtaactaccctaccggaccgtaaccctaaccgaacgtacccttaacgaacgttacggaacttacggaagtaccgacgtcccgtacgtaaccttcgtaacgaacgaccgtaaccgtctttaacctttaccttaacgtcgtaggtacggtacgggagggtttacggggtttacgtaacggttacggttaaccctttccgtaccgtttacgtaacggttcggtaaccggttcgggtaccgggtaacggtaaaacccggggtaaccccggg

SEQ ID NO: 290292 - DNA, 721 bp, Homo sapiens
  misc_feature: GYAE6OF01AMO08.47.23.C01.1.454.CMB.1.raw
tcagagctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcagtcgtgggctggaggtgaagaacgccgtggggcctcgagtggtaacgtttcctgtcgtaggtccttcgtggactaccgtagtccttacactagtccatcgtacttagtactaggttgggtcgccgacccgaccgggcccccggacgacgacgaccgttaggacggtggagtgggagtagggactcgacgtacgtagttcgggaacaaggttaacggtaaactaaacttaaaaccgtacctaacgtaacgaaacgtttacgggttaacccggacgggtaccgtaacgggtacccaaaccgttaacgtaaccgtaacggaacggtactacgtacccgtacccggaccgaacccgtaacgaccgtaactaccgagtacgtaaccgagtacgacgaactcgtacgtacctacgtagaacgcgtacgtacttattaccgtacgtcgaggtacgagggtaggtacgggttacgtacggtactacgttccgttaccgtagttacggtacgggtacggttcggaacggggtacgtaaaccggtcccgg

SEQ ID NO: 290293 - DNA, 725 bp, Homo sapiens
  misc_feature: GYAE6OF01EKPWM.47.23.C01.1.454.CMB.1.raw
  modified_base (96)..(96): a, c, t, g, unknown or other
  misc_feature (96)..(96): n is a, c, g, or t
  modified_base (251)..(251): a, c, t, g, unknown or other
  misc_feature (251)..(251): n is a, c, g, or t
tcagagctcacgtacacgaccggtgctcgatttagtacacgtgattagggattggggccccaacaatcacatccctcctcagacgaaaaacccccngagcacaactccttaccatggactggacctggaggatcgtctttttggtggcagcagccacaggtgcccactcccgaggtcccaaacgtttgtgcctagttcgtggggctggaggtgaagacgccgtgggcctcgagtgtaaggtttcctgtacnggtcttcgtaggattacagtcttacgaccgtactacttattcgctacgtgggtcgcggaccgggcccgtaggaacgaacgggtctggaggtcggagtcggggacgtagtcgagtccgaagttcggacaagttaggaaaccaaataaaacctacgtacaacgaagtaaacgttccggaaggcgtaacgggtaccaaccgttaacttaaaccgagtacgaactacgtccgtaccggaccgaacccaacgaccaccgtaacaagtacgtaaacgcgaacgtcgaaccgtctacgttacctggtaacgaacgtaccgtaacgggttaccttaaacgtttacccgtacgttagggtccgacggtaagggtacgggttacgggttacgacggttacggtaaccttccgttacaagttacgtcgggtaccgttagggacggggtaacgaaacgggacccgttacggtcccgccggttaccg

SEQ ID NO: 290294 - DNA, 830 bp, Homo sapiens
  misc_feature: GYAE6OF01BHPKD.47.23.C01.1.454.CMB.1.raw
tcagagctcacgtacacgaccggtgctcgatttagtacacgtgattagggattggggctgggcctaaggaagcagcactggtggtgcctcagccatggcctggaccgttctcctcctcggcctcctctctcactgcacagactctgtggcccttcctatgtactgactcagccatccgtggtggcaggtcggccccaggacacgaccggccaggtacttcccgtaggtagggaacgaaacaacgtagttagggaaagtaagagtgtaactagttacggtaaccaaacgtaggacggtaccacggccgtaccggtcccgttaggtcgccgttcgggttaccgtcctagtcggtaagtcggtaacgttaccggaccggtaccccggtcccgtaggaacgggtccctacccgtggaccgtcgtaccttcgtaacgtcggtaccttaccgtagttccggacggaacctcccgccctaacccgtacggaccacgtaccgaacgggcccgtacgggtaccgaacggtccgggtaagtacgtaaccgggtacgtcccggtaaacgttacgtttaccggcggttacggtaacggggtagggtaccgggtaaggttttaactttaacgggttttcggtacgttaacggtttacggtttcgggttacggttaaccggggacgggttaacggaaccggttacggccgttaccgggttacccggtacccgttacgggtaccctaaccgggttcccggaaaccgggttcccgtaccccggtttaaccccggttcggtacccccttacccggttaccttccccgggttacccccttaaccccgg

SEQ ID NO: 290295 - DNA, 773 bp, Homo sapiens
  misc_feature: GYAE6OF01DNYD6.47.23.C01.1.454.CMB.1.raw
tcagagctcacgtacacgaccggtgctcgatttagtacacgtgattagggattggggcccccaacaatcacatccctcctccaagaacgcccccagagcacaactccttaccatggactggacctggaggatcgtcttttggtggcagcagccacaggtgcccactcccaggtccaacttgtgcagtcgtggggctgaggtgaagaagccgtgggcctcgagtgtaacggtttcctgtcgaggtcttcgtggatacgagtctttacgacctagtcaagtcgtactatacgagtttggggtcgccgtcccgaccgggacccccgtacgaacggtacggtaacctggtaggtacggaggtggggaacgtggtatcgaagtcgtaagttcggaccaaagttacggtaaaacaacgtaaaaacacctaaccgaacgaacggtaacgttaccgagggacgacggggtacaaccgtaacttaccgaagaccgaactacgtcccgtaccgacccgtaaccacacggacccttaacgacgtaacggaacgtgaacgtccaacggtacccttacgacctttacgacgtaaccggtaaccgtacgttaacttaaaccgtttacgtaaccgttggtacggtaacgtaagggtacgggttaaccgggggttgtaaaacccggttaggtaacccgtttcccgttaaaccgttaccctaaagggttaccgggaaccgggtttaggggtaacccggggaaccggtaaaacccggggttaaaccccggg

SEQ ID NO: 290296 - DNA, 802 bp, Homo sapiens
  misc_feature: GYAE6OF01D0G9Y.47.23.C01.1.454.CMB.1.raw
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
  modified_base (252)..(252): a, c, t, g, unknown or other
  misc_feature (252)..(252): n is a, c, g, or t
  modified_base (315)..(315): a, c, t, g, unknown or other
  misc_feature (315)..(315): n is a, c, g, or t
tcagagctcacgtacacgaccggtgctcgatttagtacacgtgattagggattggggccccaacaatcacatcccctcctcagaagcccccagagcacaactccttaccatgggctggacctggaggatcgtcttttggtggcagcagccacaggtgcccactcccaggtccaacttgtgcagtctggggctagaggtgaagaagccgtggggcctnagtgaaggtttccngtcaggtcttcgtggatacgngtcttccatagtctatacgctaactactagttcgggtcgccgaccgacgggtccccccggaanaacggacgaccctgggaggtcgggagtggggatgggactcgaagtccagtttcgggactaaacgtagggtaaaacctaaacgtaaaaaccgtaccgtccaaaacgtaacgggtaaaacggtttccccggaaagggtaccggaaacggggttaccaaacccgtaaacgtttaaacccgaaggaacgtaacgtacttacccgtacccggaccgaaccctaacgacgtaccctaagacgtacgaaactcggaagccgtactaccccgttaggtaccctttacgtaacggtaaaccggacccgtaaccgggttactttaaaccgttttaccgtaaccggttacgtacgggaaccgtaaagggaacggggtttaaacggggttttaccgaaacggtttacggggaaaccctttccggtttaccgtaaacgtaggttacggggttaccgttaccggggttaacggggaacccggttaaacgggaaaccccggg

SEQ ID NO: 290297 - DNA, 840 bp, Homo sapiens
  misc_feature: GYAE6OF01D6O5S.47.23.C01.1.454.CMB.1.raw
tcagagctcacgtacacgaccggtgctcgatttagtacacgtgattagggattggggctgggcctaaggaagcagcactggtggtgcctcagccatggcctggaccgttctcctcctcggcctctctctcacgtcgcacagctctgtcgcctctatcgtactgactcacgtccactccggtcggtgacctggtccgaccccgaggaccgaacggaccggtacccgaaggtccttacccgtagggtacgggaaaacgaaaaccaagtagtttaagggaaagttaaacggaggttacgttaaaccgtaaggttttaacccggtaaacccgaaaacggtaggtaaccggtaccccggaacgggaccccgtaaccgggtcccccgttggtacggtccgttaccgggttcccgtacccgtagtttacggacgtttaggaaaccgtaccgggtaccccggaacccggtcccgtacggtacgggtaccttcccggtacggtaccgtccgttcccgttccgtcggtcggtacctaccgtaacgtcggtaaccggaacccgtcgacccctaccgtccggaccgtagtacggcgggtacgggttcggaaccggtcgggtaagtcggacgttacttaggtttacgttgtacggtaggttcgtaggtacgttacgtttagtcgtactagttacggttcggttaggtcgggacggtaacggtaccgtacgtcggttaccggtccgttacgtccggacgtaccgaccggtccgggtcccgttaccccgtcccgtcggttaaccctcccgtttacccgttaccccgtacccgttaccccttccgttacgacccgg

SEQ ID NO: 290298 - DNA, 732 bp, Homo sapiens
  misc_feature: GYAE6OF01DKXMZ.47.23.C01.1.454.CMB.1.raw
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
tcagagctcacgtacacgaccggtgctcgatttagtacacgtgattagggagttggggcccaaacaatcacatccctcctcagaacgccccagagcacaactccttaccatggactggacctggaggatcgtctttttggtggcagcagccacaggtcgacccactccccaggtcccaacttgtgctagtcgtggggctaggaggtgaagacgtccgtggggccctgaggtagtaacggttttccngttcgaggtcttcnggatacagtcttacacgtatcgatagtctacgtactaggttcggtcgcgacccgaccgggacccccggacgacgacggtaccgtaggtaggtagggacgtgggtagtcggtaagtacgagtacgtaaggttacggaccgtaaagttacggtaaacaaacgtaaaaccacgtacgaacgtaagtaaacggttaccggagggtacgacgggtacaaccgtaagttacgaaggtaacgaactacttaccgaccccgacacgtacgaccgtacctaacgacgtacgaacgtacgacgaccgtactaccgtactacgttaccgtaagaacgggaacctacgggtactttacgttaaccttaggtagtcggtaaaccgagggtaccggtttaggggtacctagggtaacgtacgtttcccgttacgtacgttacggcggttaacgtacgggtaccggtaaagtaacccgggaacccgg

SEQ ID NO: 290299 - DNA, 831 bp, Homo sapiens
  misc_feature: GYAE6OF01A0R0B.47.23.C01.1.454.CMB.1.raw
  modified_base (241)..(241): a, c, t, g, unknown or other
  misc_feature (241)..(241): n is a, c, g, or t
tcagagctcacgtacacgaccggtgctcgatttagtacacgtgattagggattggggccccaacaatcacatccctcctcagaacgcccccagagcacaactccttaccatggactggacctggaggatcgttctttttggtggcagcagccacaggtgcccactcccaggtccaactttgtgcagtcgtggggtctggaggtgaagacgccgtgggcctgagtgtacggtttcctgtccnggtcttcgtggataccagtccttacacctagtactatgtacttaatactaggttcgggtcgccgacccgaccggaccccccggaagacggacgtccgttaggacggttagggtaggtgggtagtcggacgtccgagtactaggttacggtacgtaacgtaacgggtaaactaaaacgtaaaccgtacctaaccgaacgaacggtttaaccggttccggaacggggacccgtaaccgggtaccaacccgttaacgttaacccgaggtaacgacctacgtacccgacccgtacccggaacccaccgtaacccgtacccgtaacgtacgtaaccgggtaacctacggtacccgaccggacccgttacccggttaccgtaccgttaccggtaacggtaacggttaacccgtaaccggtttacgtttaacttttaacccgtacggttcggtaacggaccgggttaaggtacggggtttacgggttaacggttcccggtaacgggtttaacccgttcccgttaacgtaccggtaacggttaaccgggtaccgttacccggggttaacgggaaaccggttaaccggttaaccccggg

SEQ ID NO: 290300 - DNA, 658 bp, Homo sapiens
  misc_feature: GYAE6OF01E0DSF.47.23.C01.1.454.CMB.1.raw
  modified_base (248)..(248): a, c, t, g, unknown or other
  misc_feature (248)..(248): n is a, c, g, or t
tcagagctcacgtacacgaccggtgctcgatttagtacacgtgattagggattggggcccccaacaatcacatccctcctcagaagcccccagagcacaactccttaccatggactggacctggaggatcgtctttttggtggcagcagccacaggtgcccactcccaggtccaacttggtgcagtctggggctgaggtgaagacgccgtggggcctcgagtgaaggtttcctgtccgaggctttcgnggatacagtcttcactagtcatgtctatactagttgggtcgcgccgacgggccccccggaacggacgaccgtggacggtggagtcggggagtggatcgagctagttggacaagtacggtaaacaaacgtaaaacactacaacgaagtaacggttccgaaggggtactacgggtacctaacccgtaacgttaaccaaggaacgactacttccgacccgtaccgacccacgacgaccctacgacgtaaggtaactggacgcacggtccctagtacttacgtagaacgaccgtagtactttaactttacctagtggtacgcggaagtagggtagggtttcgacgttacggaacctttccgttaacaccgtggtacggttacggtggtacggggaacccgtaacggggtacccg

SEQ ID NO: 290301 - DNA, 894 bp, Homo sapiens
  misc_feature: GYAE6OF01AS431.47.23.C01.1.454.CMB.1.raw
tcagagctcacgtacacgaccggtgctcgatttagtacacgtgattagggattggggccccaacaatcacatccctcctcagaagcccccagagcacaactccttaccatggactggacctggaggatcgtctttttggtggcagcagccacaggtgcccacgtcccaggtcccaacttggtgcagtctggggcctggaggtagaagaagcccgtgggggccctagaggtacggtaacggttttccgtggtaccgaggtcctttacgtacggaactacgtacgtcctttacgacttacgtacgatcggtaccttaagtacctaaggttgggttacggccggtacccgaccggccccccggagacgaggtacccgtggaggtacggagtgggagtggatacgagccgtagtacggacgtagtacggtaaacctaagtaaaacctcgtacaacgtaacgtaacgttacccggaaggtactacggggtaccaaaccgtaacgttaaccgaacgtacgtaaaccgtacggtaccccgttaccgacccggtaacccccgtaacgtaacccgtacccgttaacgaaccggtttaacgggtaaaccgtttaccggaacgtaccccggtaacgtaccccgttaaggttaacccgttacggttaaccgaaaccggaaccccggttaacgggtaaccttttaaccggttttaacccgttaaccgttacggggttcccggtaacggttaaacgggtaccgggtttaaagggggttttaccgaacccggtttacgggttaaacccccgtttccgtttaacccggtaaccggttaacgtacccgggggttaacgttaccgggtaacccgggggtaaacgggggttaaaacccggtaaacccccgggg

SEQ ID NO: 290302 - DNA, 773 bp, Homo sapiens
  misc_feature: GYAE6OF01A7ZHI.47.23.C01.1.454.CMB.1.raw
tcagagctcacgtacacgaccggtgctcgatttagtacacgtgattagggattggggcccaacaatcacatccctcctcagaacgccccagagcacaactccttaccatggactggacctggaggatcgttctttttggtggcagcagccacaggtcgcccacctcccacggtacctaacttgtgcagtcgtggggcgtggaggtagaagaacgccggtcgggtcctcgtagtaggtaacggtttcctgtcgaggtcttcgtcggataccccccccccccagtcttcactacgtcagtgtactaatactagttgggtgtccgccgaccgggacccccggacgaggacgaccgtaggacggtgggtagtgggacgtaggtactacgacgactagttacggacgtaagtacggtaaactaaactaaacctaacgtacaaactaacggtaacgtaccggtacgggacggtaacgggtacctaaccgtaacttaaccgaacgtaacggacctaacgttccccgttaccgaccgtaaaccccgtaacaccggtaccctaacgtagtaaaccgggtaacgtaggaaccgtacaaccggtaccctgttaccgttcaacggaaccgacgtaccgggtaacttttaacgttactacgtaggtcggtaacgggaaggtagggtttaccgggttacgtacggttaccggttaaccttccgttactaacggtacgttacggggtacttagggggtacgggaaaccgggtaaaccgggtaccccgg

SEQ ID NO: 290303 - DNA, 737 bp, Homo sapiens
  misc_feature: GYAE6OF01A2PHH.47.23.C01.1.454.CMB.1.raw
  modified_base (274)..(274): a, c, t, g, unknown or other
  misc_feature (274)..(274): n is a, c, g, or t
  modified_base (310)..(310): a, c, t, g, unknown or other
  misc_feature (310)..(310): n is a, c, g, or t
  modified_base (326)..(326): a, c, t, g, unknown or other
  misc_feature (326)..(326): n is a, c, g, or t
  modified_base (362)..(362): a, c, t, g, unknown or other
  misc_feature (362)..(362): n is a, c, g, or t
tcagagctcacgtacacgaccggtgctcgatttagtacacgtgattagggagttggggccccaacaatcacatccctcctcagaacgcccccagagcacaactccttaccatggactggacctggaggatcgttctttttggtggcagcagccacgagggtcgccccacctcccgaggtccctaactttgtgcagttcgtggggctggaggtgaagagccgtcgggcctcagtttttttgaacggtttcctgtcaggtccttcgtggactacgngtcttacactagtcatgtctatactagttggtcgcnccgacggcccccgganacgacgccgtgaggtaggagtgggatggactcacgntagttggctaagtacggtaacaaactaaaacactacaacgtaaggtaacgttcggaaggacgtacgggtacctaaccgtactaaccgacgtacgaactaccgtccgtacccgaccggtaaccccagtaaccgtaccctaacgtacgtaaccggtaaccgtacggaaccgtacgacggtacccgtagttaacccgttacggtaacggtaacgaccggtaaccgttaccgtttaaactttaccgtaacggtggttaccggacggttagggtaaacgggtttacggggtttagtacggttacggttacccttaccgttaccgacgttacggtacgggtaccgtaacggggtcgggtaccggtaaacccggggtaccgg

SEQ ID NO: 290304 - DNA, 695 bp, Homo sapiens
  misc_feature: GYAE6OF01AT9IO.47.23.C01.1.454.CMB.1.raw
  modified_base (350)..(350): a, c, t, g, unknown or other
  misc_feature (350)..(350): n is a, c, g, or t
tcagagctcacgtacacgaccggtgctcgatttagtacacgtgattagggattggggccccaacaatcacatccctcctcagaacgccccagagcacaactccttaccatggactggacctggaggattcgttcgtttttggtggcagcagccacgaggtcgcccactcccgaggtccacttgtgccagtcgtggggctggaggtgaacggacgccggtggggccctagtaggttacgtaagggttttcctgtccgaggtctttcgtacggattacgagtcctttacgacgttagtcctagtacgcttagtaactggttcgggtgccgacccggaccgggacccccgganacggtacggacctggtacggtgggtagtgggtagtggacgcaaggtctagttacggactaagtacggtaactaaactaaacacctaacgacgtaaggtaacggtcgaagggcgtacggtaccactacgtacgagacgactactacgtccgaccgacacacgtacacagcgtaaacgtcgacgcgacgtcgttaacgcgttacggaacgtacgaccgtagttaaccgttactttaccgtcgtacgtcgtaacggtacggtagggttacgggttagtaccggtacgtaccgtacgtactacgtaggttacggtacggtacgggtacggaacggtaccggtaaccggg

SEQ ID NO: 290305 - DNA, 757 bp, Homo sapiens
  misc_feature: GYAE6OF01DUB6P.47.23.C01.1.454.CMB.1.raw
  modified_base (512)..(512): a, c, t, g, unknown or other
  misc_feature (512)..(512): n is a, c, g, or t
  modified_base (548)..(548): a, c, t, g, unknown or other
  misc_feature (548)..(548): n is a, c, g, or t
  modified_base (568)..(568): a, c, t, g, unknown or other
  misc_feature (568)..(568): n is a, c, g, or t
tcagagctcacgtacacgaccggtgctcgatttagtacacgtgattagggattggggcccccaacaatcacatccctcctcagaagcccccagagcacaactccttaccatggactggacctggaggatcgttctttttggtggcagcagccacaggtgccccactcccaggtccaacttgtgcgagtcgtgggctgaggtagaagaagccgtgggcctcagtgtaacggtttcctgtcgagtcttcgtggatacgagtccttacactacgcatgactaactaacgtaggtttcggggtcgaccgtacccgacccgggccccccggaacgtacggaacggtacccgtaggagggttagggaggttaggggagtacgggtactacgacggtactacgttaggacgtaaagttaacgggtaaaacctaacgtaaaaaacctccgtaaacgaaaccgtaaaggtaaccgttaccggaagggtacgtaccgggtaccaaccgtactaacgaacganaactactcccgtaccgacccaccgacgacacgtaanacgtagtaacgtagacgacnctacgtacgtacttacgaagaacgaaccggtacgttaccttaactttaccgtaacgttggaccggtaaggtacgggtacgggtttagggtttaacgaccggttacggtacccttaccggtttaaccaggttacggttaccgggtaacggttccgggaaccgggggtaacgtaaacccgggggtaacccg

SEQ ID NO: 290306 - DNA, 691 bp, Homo sapiens
  misc_feature: GYAE6OF01EYKIB.47.23.C01.1.454.CMB.1.raw
  modified_base (320)..(320): a, c, t, g, unknown or other
  misc_feature (320)..(320): n is a, c, g, or t
  modified_base (401)..(401): a, c, t, g, unknown or other
  misc_feature (401)..(401): n is a, c, g, or t
tcagagctcacgtacacgaccggtgctcgatttagtacacgtgattagggagttggggcccaacaatcacatccctcctcagaacgcccccagagcacaactccttacatggactggacctggaggatcgtctttttggtggcagcagccacaggtgcccactcccaggtccacttgtgcagtcgtggggctgaggtagagaagccgtggggcctcgagtgaacggtttcctggtcaggtcttcgtggacttacagtcctttacacctagttaccatgtactactactagttggggtcgccggaccaccggcccccgganaacggacgaccgtggagtggaattggggactgggacttcgaacgtctagtttcggacaagtacggtaaacaattaaaaccnctacaacgagaacgttccgaaggcagggtaccacgacttacgagacgacaactcgccacgaccgacacgcctacacgtacggaactcggaacgtcgacgccttacgaccgtttacgaacgaacgtacgtacggttacctttaacgttaaccgttactcggaaccggtacggtaacggtacgggttaaggggttaccacgggttaacccggtaaccgtttacccgttagtaacccgtacggttacgggtaccgtacgggtaccggggtaaacgaaacccgggggtaccccg

SEQ ID NO: 290307 - DNA, 809 bp, Homo sapiens
  misc_feature: GYAE6OF01BZQAA.47.23.C01.1.454.CMB.1.raw
  modified_base (241)..(241): a, c, t, g, unknown or other
  misc_feature (241)..(241): n is a, c, g, or t
tcagagctcacgtacacgaccggtgctcgatttagtacacgtgattagggattggggcccccaacaatcacatcccctcctcagaacgcccccagagcacaactccttaccatggactggacctggaggatcgttctttttggtggcagcagccacaggtcgcccactcccgaggtccaacttgtcgcagtcgtggggctaggaggtgaagagccgtggggcctcgagtgtaaggtttccngtcgaggtcttcgtaggactacgagtctttacagttagtacattgacttaagtactagtttggggtccgccgtacccgaccggggaccccccggaacaacggaccgacccggttaggtaggtacggtaggtggggtaatcgggtacttacgacggtacgtaaggtttcgggaaccttaaggtacggtaaaactaaactaaaaacctactacaaccggtaagtaaaccggttccgaagggtccgacgggtacctaaaccgtattaacccgagtaacgactaccgttacccgccgaacccgaaccaaccgacgaccctaagacgtagtaacgtggactaccggctaccgtacgttaccgtacgtaacggaaccgtaaccgtaacggttacctttaacgtttacccgtagttacggtacggtaaggtacgggtaacggggtttagggtttaacccggtggttaaacccgggttacccgtttccttaacccgtaggttaccgggtttaaccggggtaccggttaccgggggtaaacggggtaaaccccgggtaaaccgggttaacccccggg

SEQ ID NO: 290308 - DNA, 992 bp, Homo sapiens
  misc_feature: GYAE6OF01BAYI8.47.23.C01.1.454.CMB.1.raw
  modified_base (253)..(253): a, c, t, g, unknown or other
  misc_feature (253)..(253): n is a, c, g, or t
  modified_base (328)..(328): a, c, t, g, unknown or other
  misc_feature (328)..(328): n is a, c, g, or t
tcagagctcacgtacacgaccggtgctcgatttagtacacgtgattagggattgggcccaacaatcacatccctcctcagaacgcccccagagcacaactccttacatggactggacctggaggatcgttctttttggtggcagcagccacgaggtgaccccactcccgaggtccaacttgtgcgagttcgtggggtctggaggtgaagacgccgtgggcctcgagtgtaaggtttcctgtcaggtcttacgnggtatacgagtcttacacgtgtcagtgactaacgtactagtttgggtcaccggtaccgaccgggaccccccgganaacggtaacgtaccgtacggtaggttacgggtacggttaggggtacgtacgggacttacggacgtaccgttaggtttacggtaaccgttaaacggttaacggtaaaacctaaaaccggttaaaaacccgtacgttaaaccggtaaaccggtaaacggtttaaaccgggttaacccggtaacgggggtaccgtaaaccgggggtacccaaaccgttaaaccggttaacccgaacggtaacgtacccgtacgtttaccccggtaccccgggtaaccgaaaccccgtaccggtaaacccggtacccgtttaaacgggaaccggtttaaccgggtaaaacgttacggaacccgtaaccgggtaccgtttaaccccggtttaaccggttaaccgtttaccgggtaaacgttaaaccccgggtaaccgggttaaccccgtttaacgttttaaacccggtttttaaaccggtccggttaaccgggtacggggtaaccgggttaaccgggggtttaaagggtttaacccggggtttaacggttaacccgggtttaacccgggttaccctttaccccgttttaaaccgtaacgggttaaccggttaccggggtttaacccggttaaccggggtaacccggggtaaaacccgggtaccgggttaaccccccggg

SEQ ID NO: 290309 - DNA, 737 bp, Homo sapiens
  misc_feature: GYAE6OF01A3GCE.47.23.C01.1.454.CMB.1.raw
tcagagctcacgtacacgaccggtgctcgatttagtacacgtgattagggattggggctgggcctaaggagcagcactggtggtgcctcagccatggcctggaccgttctcctcctcggcctcctctctcatgcacgagtactgtgtcgcctcctatgtactgactcgagtccatccgtcggtgacctaggtccggaccccaaggacctaggacccggaccgtaggtactttcccgtaggtacgggaaacgaaacaacgtagttagggaagtaagagtacgtaactaggttacgtaacaacgagacgccgacgaccgtacgccctgtcgcgtcggtaccgtacagtagactagacgtacggacccggaccgtaccgtacgacgggtacctccgtagacgtaccgtcttccgtacgtcggtacctaccgtacgttacgtacggaacgtaccggaccctaccgtacgaactacgcgacgacgcggtaacgacggacgacgtagacgacgaccgtattacgttacgtcggtagaggttacggagtaacgtaagtacgtagtacgaaccgtccgaggttacggttacggtttcgggaacgggttaccggaacgtacggtacggttaaccgtacccggtaccgtaacggtaccgaaccggtaaccccgtaacgggtccccttaccccgggtacccccttacgggtaccctacccgttccccggttcccgtttacccccccgg

SEQ ID NO: 290310 - DNA, 128 bp, Homo sapiens
  misc_feature: GYAE6OF02IC25F.47.23.C01.1.454.CMB.1.raw
tcagagctcacgtacacgaccggtgctcgatttagtacacgtgattagggattgggcacagcggccctgggctgcctggtcaaggactacttcctagtatactctgagcgggctggcaaggcgcatag

SEQ ID NO: 290311 - DNA, 571 bp, Homo sapiens
  misc_feature: GYAE6OF02HFFQ8.47.23.C01.1.454.CMB.1.raw
tcagagctcacgtacacgaccggtgctcgatttagtacacgtgattagggattggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggccccctgtgctggtcgtctatgatgatagtgaccggccctcgtgggactcccccgagcgtattctctggctccaagtctgggaacacggccacccgtgacccgtcacgcgagggtcgacggtcgggatggaggccgtattagttttgtcgtaggtgtgggtagtacgttaagttttggtctatagttgtttgttcgggcggtagggaccaaggctacggaccgtccgtcggtacacggcccaaggcctccgtccccgtcggtccacttccgtccgttcccctaccccttcctaccg

SEQ ID NO: 290312 - DNA, 132 bp, Homo sapiens
  misc_feature: GYAE6OF02GOHNU.47.23.C01.1.454.CMB.1.raw
  modified_base (130)..(132): a, c, t, g, unknown or other
  misc_feature (130)..(132): n is a, c, g, or t
tcagagctcacgtacacgaccggtgctcgatttagtacacgtgattagggattgggcacagcggccctgggctgcctggtcaaggactacttcctacgtgagctctgagcgggctggcaaggcgcatagnnn

SEQ ID NO: 290313 - DNA, 541 bp, Homo sapiens
  misc_feature: GYAE6OF02J1TDB.47.23.C01.1.454.CMB.1.raw
tcagagctcacgtacacgaccggtgctcgatttagtacacgtgattagggattggggccccaacaatcacatccctcctcagaagcccccagagcacaactccttaccatggactggacctggaggatcgtctttttggtggcagcagccacaggtgcccactcccaggtccaacttgtgcagtctggggctgaggtgaagagcctggggcctcagtgaaggtttcctgtcaggcttctggatacagcttcactagtcatgctatacattgggtgcgccacggcccccggacagacgacctgagtggatgggatggatcagcagttggcaatggtaacaataaacactacacagaacgttcaggcaggtcacataccagagacatctccgcgaccacacgcctaacatgaactgacgcacgtcctacgtacttcgtagaacgacacgtctaactttactactgtcgacgagtagagggtttagacgttggtaactccttacgtacgtagtcggtaccgtggtacgggacgaacgggtaccg

SEQ ID NO: 290314 - DNA, 584 bp, Homo sapiens
  misc_feature: GYAE6OF02JQ3U5.47.23.C01.1.454.CMB.1.raw
tcagagctcacgtacacgaccggtgctcgatttagtacacgtgattagggattggggccccaacaatcacatccctcctcagaagcccccagagcacaactccttaccatggactggacctggaggatcgtcttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgtcgccaggccccccggacacgagaccctgagtggactgggatgggatcgagcagttggcaatggtaacagtaaacactcacagaagttccagggtcagggtcacattaccaagacgacatctaccgcgaccacacgcctaacatacgggaactgacgcaagcctagaccttctagaaacgacaccgggtacttaactttacctaacgtgttacgccgtaagtacgggtaggggtttacgacgttagggtaaacttcccgtttactacgtacgtcgggaccgttacgtcggggactaaacgggtacccgg

SEQ ID NO: 290315 - DNA, 523 bp, Homo sapiens
  misc_feature: GYAE6OF02HV239.47.23.C01.1.454.CMB.1.raw
  modified_base (428)..(428): a, c, t, g, unknown or other
  misc_feature (428)..(428): n is a, c, g, or t
tcagagctcacgtacacgaccggtgctcgatttagtacacgtgattagggattggggccccaacaatcacatccctcctcagaagccccagagcacaactccttaccatggactggacctggaggatcgtcttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccaggccccccggacagagacctgagtggatgggatggatcagcattggcaatggtaacataaaacactcaacagaagttccagggcagggtcacattaccagagacatctccgcgaccacagcctacatggaactgagcagcctgacttcngaagacacggctatttactactgtgcgagagagggtttgacgttaggaactccgttactactatcgggacgtcgtaggggccaaaggggtacccg

SEQ ID NO: 290316 - DNA, 540 bp, Homo sapiens
  misc_feature: GYAE6OF02HWPT1.47.23.C01.1.454.CMB.1.raw
  modified_base (376)..(376): a, c, t, g, unknown or other
  misc_feature (376)..(376): n is a, c, g, or t
tcagagctcacgtacacgaccggtgctcgatttagtacacgtgattagggattggggctgggcctaaggaagcagcactggtggtgcctcagccatggcctggaccgttctcctcctcggcctcctctctcactgcacagactctgtggccctcctatgtactgactcagccatcctcggtggcagtggccccaggacagacggccaggattccctgtggaggaaacaacattggaagtaagagtgtacattggtaccaacagaggccaggccaggccccctgtgctggtcgtccatgatgatagcgaccggcctcgagggactccctgagcgcttctcgtggctcaattctgggaacacggccaccctgacccancagcgcggtcgaagccggagatgaggccgactatactgtcaggtgtgggacagtaatagtgatcccgagtcgtagggttttcggcggtgggaccgaagctcgaccgttaccgtaagttccacgcccaacggctacggcccctccggtccactctcgttaccccc

SEQ ID NO: 290317 - DNA, 519 bp, Homo sapiens
  misc_feature: GYAE6OF02FYT0E.47.23.C01.1.454.CMB.1.raw
tcagagctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccaggcccccggacagagaccctgagtggatgggatggatcagcattggcaatggtaacataaaacactcacagaagttccagggcagggtcaccattaccagagacatctccgcgaccacagcctacatggaactgagcagcctgacttctgaagacacggctatttactactgtgcgagagagggtttagacgtggaactccgttactacatcggtacgtctggggaccaagggtacccg

SEQ ID NO: 290318 - DNA, 554 bp, Homo sapiens
  misc_feature: GYAE6OF02IGENJ.47.23.C01.1.454.CMB.1.raw
tcagagctcacgtacacgaccggtgctcgatttagtacacgtgattagggattggggccccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccacggccccccggacagagacctgaggtggatgggatggatcgagcagttggacaatggtaaacataaaacactacaacagaagttccagggcaggtcaccattaccagagacatctccgcgaccacagcctacataggaactgacgcagctgaccttcagaagacgacgctatttacactgtgcgagtaggtagggtttacgacgttaggaaccttccgttactaacgtagttacgggacgttccggtacggggtaccgaaacggggtacccgg

SEQ ID NO: 290319 - DNA, 646 bp, Homo sapiens
  misc_feature: GYAE6OF02GNH97.47.23.C01.1.454.CMB.1.raw
  modified_base (373)..(373): a, c, t, g, unknown or other
  misc_feature (373)..(373): n is a, c, g, or t
tcagagctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcgaggtcttcgtggatacagtcttcactagtcatgctatactagttgggtcgccgaccgaccgggccccccggacaggacgtaccgtgaggtggagtgggagtggatcgagctagttggacaagtggtaaacaagtaaaaccnctacaacaagtaacgttaccgagggacgtacggtaccaacctacttaaccgagacgactatccgtccgaccgaaccacgacgaccctaacacgtacggaactggacgcgacgtcctagtaccttcgtaagaacgaccgaaccggtattaactttacctacgttaggtcgacgtaggtaggggttagggtttacgaccggtaggtaaccctttcgttaacctacgtaggttacgggtaccgttacgggtacgggggaacgaaacgggtacccgg

SEQ ID NO: 290320 - DNA, 539 bp, Homo sapiens
  misc_feature: GYAE6OF02IG75Z.47.23.C01.1.454.CMB.1.raw
  modified_base (397)..(397): a, c, t, g, unknown or other
  misc_feature (397)..(397): n is a, c, g, or t
  modified_base (417)..(417): a, c, t, g, unknown or other
  misc_feature (417)..(417): n is a, c, g, or t
tcagagctcacgtacacgaccggtgctcgatttagtacacgtgattagggattggggcccaacaatcacatccctcctcagaagccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccaggcccccggacagagacctgagtggatggggatggatcagcattggcaatggtaacaataaaacactcaacagaagttcagggcagggtcacattaccagagacatctccgcgaccanagccctacatggaactggancagcctagacttctagaagacacggcttatttactactgtgacgagaggtaggggtttgaacgttaggaactcccgttactactagttcggaaccggttcgtacggggacaaaggggacccg

SEQ ID NO: 290321 - DNA, 582 bp, Homo sapiens
  misc_feature: GYAE6OF02FUWCB.47.23.C01.1.454.CMB.1.raw
  modified_base (429)..(429): a, c, t, g, unknown or other
  misc_feature (429)..(429): n is a, c, g, or t
tcagagctcacgtacacgaccggtgctcgatttagtacacgtgattagggattggggctgggcctaaggaagcagcactggtggtgcctcagccatggcctggaccgttctcctcctcggcctcctctctcactgcacagactctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggactccccggagcgtattcctctcggctccaagtctggggaaccacggccaccctgacccgtcagcagggtcgacgtcgggatggaggccgtagttattttgctaggttgngggtagtacttaagtttggtctattagtgttggttcgggcggacggtaccgaagtcgtaggacccgttccgtcggtcacggtcccaagggccgtcccgtcccccgtcgggtaccctcgttccgttccgttccccgtaccccttcccgttaccg

SEQ ID NO: 290322 - DNA, 130 bp, Homo sapiens; identical to SEQ ID NO: 290244
  misc_feature: GYAE6OF02F45GD.47.23.C01.1.454.CMB.1.raw
  modified_base (130)..(130): a, c, t, g, unknown or other
  misc_feature (130)..(130): n is a, c, g, or t

SEQ ID NO: 290323 - DNA, 650 bp, Homo sapiens
  misc_feature: GYAE6OF02IYELS.47.23.C01.1.454.CMB.1.raw
tcagagctcacgtacacgaccggtgctcgatttagtacacgtgattagggattggggctgggcctaaggaagcagcactggtggtgcctcagccatggcctggaccgttctcctcctcggcctcctctctcactgcacagactctgtgacgtccgacgagctgattcaggcaccctcgatgtcagtcggccccaggacagacggccaggattacttgtgcgggagccagtgtggaagaaagagtgtacactggtaccaacagatcgccgaggccacggccccctgtgcgtggtcgtctatgatgatgtgacccggtccctcgtcgggactccccgagcgtattctcgtggcctccgaagtcgtagggaaccaccggcccacccgtcggacccgtcgacgcgacgggtaccgaacgggtcggggagtcggacggtaccgttagtttagtttttcggtcgtagggttggtgggaagttaacgttaagttttcggtactagttagttggtttcggttcgggtacggggtacgggaaccgtaaggtaccgtcggtacccgttccgtcggtaccgacggtacccggacggtccgtccgtcccccgttcggtaccgtaccgttccgttcccgttccccctacccgtcccgttaccg

SEQ ID NO: 290324 - DNA, 605 bp, Homo sapiens
  misc_feature: GYAE6OF02JDCBP.47.23.C01.1.454.CMB.1.raw
tcagagctcacgtacacgaccggtgctcgatttagtacacgtgattagggattggggccccaacaatcacatccctcctcagaagcccccagagcacaactccttaccatggactggacctggaggatcgtctttttggtggcagcagccacaggtgcccactcccaggtccaacttgtgcagtctggggctgaggtgaagagcctggggcctcagtgaaggtttcctgtcaggcttctggatacagcttcactagtcatgctatacattgggtgcgccaggccccccggacagacgaccgtgacggtggatgggatgggatcgaagcagttggactaagtggtaaacaataaaacactacaacagaagttccaagggcacgggtacacgacttacgagagacatcctaccgcgaccacacgacctacgagtacggaactgacgacgagtcctgactttacgagaacgacgtacggtaccttaatttacctaacgttgtacgcgtaaggaggttacggggtttagaccggttaggtaaccctttccgttacgtacgtacggttacggtaccggttcggtacggggtaccgaaacgggtaccccgg

SEQ ID NO: 290325 - DNA, 638 bp, Homo sapiens
  misc_feature: GYAE6OF02H6K1X.47.23.C01.1.454.CMB.1.raw
tcagagctcacgtacacgaccggtgctcgatttagtacacgtgattagggattggggcccccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacagttgggtgcgccacggccccccggacagagaccctggagtggagtgggatggatcagcagttggacaagtaggtaaacaataaaaccactacaacaagtaaacgttccgaaggggccaagggtaccaccgtaacttaccaagagacatcctccgaccgaacccaacacgacctaacagtacggaactggagcgacgcctagacctttcgtacgaaacgaccgaaccggtcttaacgttttacctacgtggtacgacggaaggtagggttaggggttttacgaacggttacgggtaaaccttccgttttaaccgaacgtagttacgggtaaccggtttcgggtaggggaccgtaaaacggggacccccg

SEQ ID NO: 290326 - DNA, 645 bp, Homo sapiens
  misc_feature: GYAE6OF02HTPQG.47.23.C01.1.454.CMB.1.raw
tcagagctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggccccctgtgctggtcgtccatgatgatagcgaccggccctcagggactccctggagcgcttctctcggctccaattcgtaggacacggccaccctgaccatcagcgcggtcgaagccggagataggacggccgacgtacttactgtacgagggtggttgggacagttaagtagtaggtactcccggaaggtccgtaagggtttttccggggacgggttaccggggaaaccgtaacggccgttacgggacccggttacccgttaaacgggttcccgaaccgggtaccccgaacgggtcccgtaccccgggttccccccgttacccggggttaccctaacccgtttcccgtttcccggtttaccccccccgg

SEQ ID NO: 290327 - DNA, 602 bp, Homo sapiens
  misc_feature: GYAE6OF02HASG7.47.23.C01.1.454.CMB.1.raw
  modified_base (293)..(293): a, c, t, g, unknown or other
  misc_feature (293)..(293): n is a, c, g, or t
tcagagctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccagggccccccgganaggacgaccgtgagtggatgggatggatcgagcagttggacaagtggtaaacaataaaacactacaacaagtaagttccgagggacagggtaccaaccgtaattaccagagacatccgtccgacgaccaacacgacctacatggaactgagacacgcctagaccttcgagaaacgacgaccggtacttaacgtttactacttggtacgacgaggtaggtaggggttttacgaacgtacggtaaccttccgtttaccgtaacgtacgttcgggtaccgtcggttagggggaccgtaaacgggtaaccccg

SEQ ID NO: 290328 - DNA, 538 bp, Homo sapiens
  misc_feature: GYAE6OF02FVYSW.47.23.C01.1.454.CMB.1.raw
  modified_base (391)..(391): a, c, t, g, unknown or other
  misc_feature (391)..(391): n is a, c, g, or t
  modified_base (401)..(401): a, c, t, g, unknown or other
  misc_feature (401)..(401): n is a, c, g, or t
  modified_base (433)..(433): a, c, t, g, unknown or other
  misc_feature (433)..(433): n is a, c, g, or t
tcagagctcacgtacacgaccggtgctcgatttagtacacgtgattagggattggggccccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccaggccccccggacagagaccctgagtggatgggatggatcagcattggcaatggtaacataaaacactacacagaagttccagggcagggtcaccattaccagagacatcnccgcgaccanacgcctacatggaactgagcagcctgacttcngaagacacggtctatttactactgtcgcgagtaggaggggtttagaacgttggtaaccttccttactacgtatcgggtacgtcgtgggggactaaggggtacccg

SEQ ID NO: 290329 - DNA, 575 bp, Homo sapiens
  misc_feature: GYAE6OF02IX2EZ.47.23.C01.1.454.CMB.1.raw
  modified_base (363)..(363): a, c, t, g, unknown or other
  misc_feature (363)..(363): n is a, c, g, or t
  modified_base (404)..(404): a, c, t, g, unknown or other
  misc_feature (404)..(404): n is a, c, g, or t
  modified_base (434)..(434): a, c, t, g, unknown or other
  misc_feature (434)..(434): n is a, c, g, or t
tcagagctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacaggacggccaggattccctgtggaggaaaacaacattggaagtaagagtgtacattggtaccaacagaggccaggccaggcccctgtgctggtcgtccatgatgatagcgaccggccctcgagggactcccgtgacgcgtcttctctggctccaattcgtggaacnccggaccaccctgaccatcgacgcgcggtacgaacgcgganagtgaggccgactactacgtgtctaggtgngggaactaggtaattagtgtacgtccgagtcgttacgggttttcgggacgggtacgggaccgaagtcgtacgaccggtacgtaagtcgacgaccgacgtccgtcggtccccgtacggtcccgtacttccgtcttacccccg

SEQ ID NO: 290330 - DNA, 555 bp, Homo sapiens
  misc_feature: GYAE6OF02G1IW1.47.23.C01.1.454.CMB.1.raw
tcagagctcacgtacacgaccggtgctcgatttagtacacgtgattagggattggggccccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccaggcccccggacagagacctgagtggatgggatggatcgagcattggcaatggtaacagtaaaacactacaacagtaacgtcgagggcagggtcacattaccagacgacatctccgcgaccacagcctacacgtggaactgacgcagcctgaccttcagaacgacgacggtacttacgtttactacgtgtacgcgtaggaggtagggtttagacggtaggtaaccttccttacgtacgagttcgggacgttcggtaggggaccaacgggtacccg

SEQ ID NO: 290331 - DNA, 526 bp, Homo sapiens
  misc_feature: GYAE6OF02ID96X.47.23.C01.1.454.CMB.1.raw
  modified_base (291)..(291): a, c, t, g, unknown or other
  misc_feature (291)..(291): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
tcagagctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggttcctgtcaggctttctggatacagcttcactagtcatgctatacattgggtgcgccaggcccccgganagagacctgagtggatggatggatcgagcattggacaagtggtaaacataaaacactcacagaagttcaggcagggtcacataccagacganatcncgcgacacagctacatagaacngagnagcctgactctagaacgcacggctattactactagtgacgagacgtaagggtttcgacttaggacttacgttctagacgttaggccgttagtacggggactaaacgggaaccg

SEQ ID NO: 290332 - DNA, 676 bp, Homo sapiens
  misc_feature: GYAE6OF02ISXHN.47.23.C01.1.454.CMB.1.raw
  modified_base (267)..(267): a, c, t, g, unknown or other
  misc_feature (267)..(267): n is a, c, g, or t
tcagagctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtgcagtcggccccaggacagaccggccaggacttcccgtgtggaggaaacaacattaggaagtaagagtgtacagttcggtaaccaanagaggccaggccaggcccctgtcgctggtcgtccatgatgatagcgaccggccctcgagggactcccgtgacgccgtcttactcgtcggccttcctaagtttcgtacgggaaccgaccggacccacccgtacgacccacgttaccgacggccggtccgggtaccggaaacggcccgggagtacgtacggaccgggacccgtaacgttacgttacgtggtacgtagggttacggtagggaaccgtaggttaacgtacggtagtaccgtcccggaagtccggttacgggttttccgggcgggtacgggaaccctaggtccgtacggtaaccgtaccgtaacggttaccgaacggtacccgaaggtcccgtcccgccccggttcggtcctaccgttccgttccgtacccccg

SEQ ID NO: 290333 - DNA, 676 bp, Homo sapiens
  misc_feature: GYAE6OF02HRIKF.47.23.C01.1.454.CMB.1.raw
tcagagctcacgtacacgaccggtgctcgatttagtacacgtgattagggattggggctgggcctaaggaagcagcactggtggtgcctcagccatggcctggaccgttctcctcctcggcctcctctctcactgcacagactctgtgcctcctatgtactgactcagccatcctcggtggcagtcggccccaggacagacggccaggattccctgtggaaggaaacaacattaggaagtaagagtgtacattggtaccaacagaggccaggccaggcccctgtgctggtctccatgatgatagccgaccggccctcgacgggactccccgtggacgcgtcttccttcgtcggcttacctaagtttccgtacgggaacaccgggccctacccgtacgaacccacgtcgacgccggccgggtacggaacggccggagagtaggacggacccgtacttaacgttacctaggttacgtagggtaggttcgggaacgtaaggtaacgttagtacggtacgtacccggacgtcggttacgggttttccgggtcgggtacggtaaccgaagtccgtacggtacccggttacccgtaaggtaccgaacggtaccccggtaacggtcccgtacccggtcccccggttccggtacctacccgttcccggttcccgttccccccgg

SEQ ID NO: 290334 - DNA, 797 bp, Homo sapiens
  misc_feature: GYAE6OF02H8XIV.47.23.C01.1.454.CMB.1.raw
  modified_base (224)..(224): a, c, t, g, unknown or other
  misc_feature (224)..(224): n is a, c, g, or t
  modified_base (618)..(618): a, c, t, g, unknown or other
  misc_feature (618)..(618): n is a, c, g, or t
tcagagctcacgtacacgaccggtgctcgatttagtacacgtgattagggattggggcccaacaatcacatccctcctcagaagcccccagagcacaactccttaccatggactggacctggaggatcgtcttttggtggcagcagccacaggtgcccactcccaggtccaacttgtgcagtctggggctgaggtgaagagccgtgggctcagtgaagtttccngtcaggcttctgggatacaggtccttacacgttagtccagtggtacctattaacgatttggggtgccggtccgacgggccccccgggagacggtacggaacccttggacggtaggtacgtacgggggtattacggggattaccgaggtcctaacggtttgggacccaaggttacgggtaaaacaagtaaaaaccgtacgtaccgtaacgaacggttaaccggtttacccggaaggggtactaacggggttacccaaccgttaacgtttaaaccgacggtaaacggtacccacgttacccggttacccggaccgtaacccgaacgtacccggtacctaaccgtagttacgggaaaccttgggaaacccgtcgaacggttcctagtaacccgtttntaaccggaacgtaccgtaccgggtacttaacggtttaacctacggtcgtaacggaccggtaaggtaagggttccggggttttacgaacggttaccggttaacccgttcggttaaccccgaggttaccggttaggggtcccgtttaggggacccgggttaaggaaacccggtaacccggg

SEQ ID NO: 290335 - DNA, 1046 bp, Homo sapiens
  misc_feature: GYAE6OF02GLV7K.47.23.C01.1.454.CMB.1.raw
tcagagctcacgtacacgaccggtgctcgatttagtacacgtgattagggagttgggggctgggcctaaggaagccagcaacctggtggtgcctcagccatggccctggaccgttctcctcctcggcctcctctcgtcactcgcgacgagactcttgtggcctcctatcgtactcgactcgacgccactcccgtcgggtggcaggtcggccccgaggaccaggaccggccgagggtacttcccgtggtagggaacgggaaacctaacggtacgtttagggaaaggttaaaggaaggttcgttaacctagtttacggtaaacccgtaaaccgtaggacgggaccctaacgggaccccgtaaccgggccccccgttggttacggtaccgttcgggttacccgtacccgtaaggttcgggtaaggttacgggtaaacgttaaccggggccccgggtaacccccggggtacccccgttaccggggaacggggtaccgttaccccgggttacggggaaccggtccggttaccgttttcccgttaccggtacccgggtaaccctttaacccggttaaacgttttcccgggtaacggggtaaacccgtaacccgggtaaccccctaaaccccggttacggaaccccgtaacggttaccgtaacgggtacccgggaccggggttacccgggaaaccgggtaccggggaaaccggtaacggttaccggggaaaccggggtaccccggtaaaccgtttaaccgttacccggttaggttaacccggtagggggtttaccggtaccggggggtaaacttaaacgggtttaaacggtaacgggttccgtaacggttaccccgggttaaggtacccgggtttaacgggggtttttccgggacgggggtttaccggaaccgtaacggtcccggttaacggacccggttaacccggtaacggtccgaaccggttacccggtaaccggtcccggttaccccggtacccccgggttacgggttacccgtaccggttttacccggtaccccggttttacccccgg

SEQ ID NO: 290336 - DNA, 556 bp, Homo sapiens
  misc_feature: GYAE6OF02HXMBH.47.23.C01.1.454.CMB.1.raw
  modified_base (215)..(215): a, c, t, g, unknown or other
  misc_feature (215)..(215): n is a, c, g, or t
  modified_base (335)..(335): a, c, t, g, unknown or other
  misc_feature (335)..(335): n is a, c, g, or t
  modified_base (414)..(414): a, c, t, g, unknown or other
  misc_feature (414)..(414): n is a, c, g, or t
tcagagctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattcccngtggaggaacaaacattggaagtaagagtgtacattggtaccaacagaggccaggccaggcccctgtgctggtcgtccatgatgatagcgaccggcctcagggatccgtgacgcgcttcnctggctccaaatttcgagggaacacggaccacctgaccatcagcgcggtcgaagccggagatgaggccgaactattacngtgaggtgtagggacagtaatagtagatccgagtcgtaggttttcggcgggtggaacctaagcgtacgacgtaccgtaacggtcacgcccgtaaaggccgttccgacccccttcgggtccaaccttccgtacttaccccccg

SEQ ID NO: 290337 - DNA, 571 bp, Homo sapiens
  misc_feature: GYAE6OF02I29JZ.47.23.C01.1.454.CMB.1.raw
  modified_base (359)..(359): a, c, t, g, unknown or other
  misc_feature (359)..(359): n is a, c, g, or t
  modified_base (483)..(483): a, c, t, g, unknown or other
  misc_feature (483)..(483): n is a, c, g, or t
tcagagctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattacttgtgcgggagccagtgttggagaaagagtgtacactggtaccaacagatgccaggccaggcccctgtgctggtcgtctatgatgatagtgaccggccctcgtgggactccccgagcgattctctggcctccaagtctagggaacnccggcccacccgtgacccgtcagcgacgggtccgacggtcggggatgggacggtccgtagttagtttttgcgtaggttggtgggtagtacgttagttttggtctattagttgtttggttcgggnggacggacctaagctgaccgtccgtcggtcacgccgacggcgtccgccccgtcgtccacgttcgtccgttccccacccttccctaccg

SEQ ID NO: 290338 - DNA, 572 bp, Homo sapiens
  misc_feature: GYAE6OF02FL56Y.47.23.C01.1.454.CMB.1.raw
tcagagctcacgtacacgaccggtgctcgatttagtacacgtgattagggattggggctgggcctaaggaagcagcactggtggtgcctcagccatggcctggaccgttctcctcctcggcctcctctctcactgcacagactctgtgacgtccgacgagctgattcaggcaccctcgatgtcagtcggccccaggacagacggccaggattacttgtgcgggagccagtgttggagaaagaagtgtacactggtaccaacagatgccaggccaggcccctgtgctggtcgtctatgatgatagtgaccggccctgtgggactccccgagcgattctctggctccaagtctgggaacacggccacccgtcgaccgtcagcgagggtcgacggtcgggatggaggccgttagttattttgacgtagggttggtgggtagtacttaagttttggtactagttagttggtttggttcgggcgggtagggtaccgaagcgtcgaccgtccgtcggtcacgcccgaaggctccgcccccgtcggtccacgtccgtccgttcccctaccctcctaccg

SEQ ID NO: 290339 - DNA, 570 bp, Homo sapiens
  misc_feature: GYAE6OF02GKZ0V.47.23.C01.1.454.CMB.1.raw
tcagagctcacgtacacgaccggtgctcgatttagtacacgtgattagggattggggccccaacaatcacatccctcctcagaagcccccagagcacaactccttaccatggactggacctggaggatcgtctttttggtggcagcagccacaggtgcccactcccaggtccaacttgtgcagtctggggctgaggtgaagagcctggggcctcagtgaaggtttcctgtcaggcttctggatacagcttcactagtcatgctatacattgggtgcgccaggccccccggacagagaccctggacgtggatggggatggatcagcattggcaatggtaacataaaacactcacagaagttccaggcagggtcaccattaccagagacatctccgcgaccacacggccctacgataggaactgagtcagcctgacctttcgagaacgtacacggtcttaatttacctaacgtgtagccgaggtagtaggggttttgacgttacgggtaacttcccttactaacgtagttacgggaaccgttcggtacgggggtacgaaacggggtaccccg

SEQ ID NO: 290340 - DNA, 561 bp, Homo sapiens
  misc_feature: GYAE6OF02I28LW.47.23.C01.1.454.CMB.1.raw
  modified_base (291)..(291): a, c, t, g, unknown or other
  misc_feature (291)..(291): n is a, c, g, or t
  modified_base (408)..(408): a, c, t, g, unknown or other
  misc_feature (408)..(408): n is a, c, g, or t
  modified_base (433)..(433): a, c, t, g, unknown or other
  misc_feature (433)..(433): n is a, c, g, or t
tcagagctcacgtacacgaccggtgctcgatttagtacacgtgattagggattggggcccccaacaatcacatccctcctcagaagcccccagagcacaactccttaccatggactggacctggaggatcgtctttttggtggcagcagccacaggtgcccactcccaggtccaacttgtgcagtctggggctgaggtgaagagcctggggcctcagtgaaggtttcctgtcaggcttctggatacagcttcactagtcatgctatacattggtgcgccaggcccccgganagagacctgagtggatgggatggatcgagcagttggacaagtggtaacataaaacactacacgagaacgttccgagggcagggtacaccattaccagagacatctccgcacacgacnccacataggaactcgagcagtcctnacttcagaacgcacggtcttaacgtttctacgtgtcgacgtagaggtaggggtttcgaacggtcggtaaccttaccgttactacgtacggttcgggtacgtcggtacggggacgaaccgggtacccgg

SEQ ID NO: 290341 - DNA, 712 bp, Homo sapiens
  misc_feature: GYAE6OF02GHBZ1.47.23.C01.1.454.CMB.1.raw
  modified_base (285)..(285): a, c, t, g, unknown or other
  misc_feature (285)..(285): n is a, c, g, or t
tcagagctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtcggccccaggacagacggccaggattccctggtggaggaaacaacattaggaagtaagagtgtacattggtaccaacagaggccaggccaggcccctgngctggtcgtccatgatgatacgcgaccggcctcgacgggactcccgtgacgcgtcttccgtcgtcggcctcctaacttcgtacgggaaccaccggcccaaccccgtgaacccagtccgacggccgaccgggtacgaacggccgggaagacgtacgggacgggacccgtaacgttacgttacgtggttacgtagggttgggtacggggtaaccgtaaggttaaacgtaggttacggaccgttaccccgggaaggtaccggttaacggggtttttccggggaccggggttacgggaacccgtaagggtccgttaccgggtacccggttaccggtaacgggtacccgaacggaaccccggtaacggtcccgttacccggtccccccggttacggtacccctaccgttacccgttcccggtttaccccccg

SEQ ID NO: 290342 - DNA, 633 bp, Homo sapiens
  misc_feature: GYAE6OF02F6TER.47.23.C01.1.454.CMB.1.raw
tcagagctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggccccctgtgctggtcgtccatgatgataggcgacccggccctcgagggactccccgtgacgcgtattctctggctccgaagtctgggaacacggcccaccctgacccgtcacgcgaggggtccgacggtcggggatggacggtccgttaagtttagtttttgtacgtagggttggtggggtagtaacgttaagttttgggtactattagttggtttggttccgggtcgggaagggtaccaaggccgtacggaccgtccgtcggtcacggcccgtaagggtcctccggtccccccgttcgggtaccctaccgttccgttaccggttcccccgtcccccgtttcccgtaccgttacccgg

SEQ ID NO: 290343 - DNA, 670 bp, Homo sapiens
  misc_feature: GYAE6OF02I673G.47.23.C01.1.454.CMB.1.raw
tcagagctcacgtacacgaccggtgctcgatttagtacacgtgattagggattggggcccccaacaatcacatcccctcctcagaagcccccagagcacaactccttaccatggactggacctggaggatcgtctttttggtggcagcagccacaggtgccccactcccaggtccaacttgtgcagtctggggctgaggtgaagaagcctggggcctcagtgaaggtttcctgtcaggcttctggatacagcttacactatcatgactatactagttgggtgccgcccgacgggccccccggacgacgagacccgtggaggtgggagtcgggatgggactcgagcagttggacaagtggtaaacaataaaacacgtacactacgaacgttaccgaggaccgacggtaccaaccgtaattaaccgaagacgaccacgtccgtaccgaccgaccacgacgacctaacacgtacggacttaggacgacgacgtccgtacgtaccttagaggaacgtaccgtaacggtacctttaagtttaaccttacggttcgtacgtagggtacggtagggttaggggtttacgaccggttaggtaacccttaccgtttaccgtacgtaaggttccgggttaaccgttcgggtacggggtaccgaaacccggggtaacccgg

SEQ ID NO: 290344 - DNA, 766 bp, Homo sapiens
  misc_feature: GYAE6OF02JPYS6.47.23.C01.1.454.CMB.1.raw
  modified_base (299)..(299): a, c, t, g, unknown or other
  misc_feature (299)..(299): n is a, c, g, or t
  modified_base (342)..(342): a, c, t, g, unknown or other
  misc_feature (342)..(342): n is a, c, g, or t
tcagagctcacgtacacgaccggtgctcgatttagtacacgtgattagggattggggcccaacaatcacatccctcctcagaagcccccagagcacaactccttaccatggactggacctggaggatcgttctttttggtggcagcagccacaggtgcccactcccaggtccaacttgtgcagtctggggctgaggtgaagagccgtggggcctcgagtgaagtttccgtgtcgaggcttcgtggatacagcttacactagtcatgctatacattgggtgcgccgacggccccccgganaggagacccgtggaggtggaagtcggggagtggattccgaggntagttggactaagtagggttaaacaaacgtaaaacaccttacgaacgaagtaacggttaccgaagggtacgtaagggtacccaaccgtaacgtttaacccgaaggaaacgtacgaaccgttacgtaccccgggaaccgtacccgaaccgtaacgtacccgtaaacgacgttacggaaacgttacggaacgacccgtaacgtacccgttacgggtaaccgttttactaacgggaaaccgtacccgggtaaaccggttaacctttaacgtttttaaccccgtacgttaacgggttacgaaccgggtttagggaacgggtttaacggggtttacggtaacggttaacggttaaccttacccgttacgttaacgtacggttacgggtaaccgttcgggtacggggtaccggaaaccgggtaacccggg

SEQ ID NO: 290345 - DNA, 636 bp, Homo sapiens
  misc_feature: GYAE6OF02J2GRO.47.23.C01.1.454.CMB.1.raw
  modified_base (555)..(555): a, c, t, g, unknown or other
  misc_feature (555)..(555): n is a, c, g, or t
  modified_base (611)..(611): a, c, t, g, unknown or other
  misc_feature (611)..(611): n is a, c, g, or t
tcagagctcacgtacacgaccggtgctcgatttagtacacgtgattaagggagttgggccccaacaatcacatccctcctcagaagccccagagcacaactccttaccatggactggacctggaggatcgtcttttgtggcagcgagccacaggtgcccactcccgaggtccaacttgtcgcagtccgtgggctgaggtagaagaacgccgtgggcctcgagtgaacgtttcctgtccgaggtcttcggtaggactacgagtcttcaccgtagtcagcgctatacgtagttggtcgccgtccgacggcccccggatacgaacgtaccgtggacgttcggtacgtcgggatcggaactcgaacggcaagttcggcgtaacgtacgggtaacaaagtaaaccacgtcacgagtacgttccgagggacgaacgggtaccaccgtaactaccgagacgtacaacgtccgtcggaccgaccctacgaccgtaacctagacgttacggaatacgacgacacgctacgccttgacgagaaccgccgttatactttacgacgngtcgacgacgtaggtgggtttacacggttcgtactccgttagtacgaggtaccggngtaacggtcgggtaacgaggtaccg

SEQ ID NO: 290346 - DNA, 628 bp, Homo sapiens
  misc_feature: GYAE6OF02I6LK4.47.23.C01.1.454.CMB.1.raw
  modified_base (242)..(242): a, c, t, g, unknown or other
  misc_feature (242)..(242): n is a, c, g, or t
tcagagctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggacttccctgtggagaaacaacattggaagtaagngtgtacattggtaccaacagaggccaggccaggccccctgtgctggtcgtccagtgatgataggccgaccggccctcgagggactcccgtgacgcgtccttctcgtggccttaccgaactttccgtagggaaccgccggacccacccgtcgaccctatccgacggccgccggtacgaacggccggagagtcggacggaccgtaactacgttactaggttcgaggttcggtacgggactaaggtaataggttcgacgttacccgagtcgttagggttttccgggcggtacggaaccgagtcgtcgtaccgtaccgtaacgtccgacgacccgacggtcccgtcccgtccccgttaccggtcctaccgttcccgtacgtttccccccg

SEQ ID NO: 290347 - DNA, 619 bp, Homo sapiens
  misc_feature: GYAE6OF02JJLL2.47.23.C01.1.454.CMB.1.raw
tcagagctcacgtacacgaccggtgctcgatttagtacacgtgattagggattggggcccccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccaggccccccggacagagaccctgacgtggatggggatggatcgagcattggcaatggtaacataaacactcacagaattacagggacaggtacaccattaccagacgacatcctccgaccgaccacacgcctaacagtacggtaactggacgacacgtccctgtaacctttactaagggaacaccgaacgggttactttaacgttttaacctaacgtcggttaggacgaagggttacggtaaggggttttgaaccggttagggtaaaccttccgtttaccttaacggtacgttaccgggtacgttacggttacggggaccgtaaacggggtaacccgg

SEQ ID NO: 290348 - DNA, 837 bp, Homo sapiens
  misc_feature: GYAE6OF02IXLX9.47.23.C01.1.454.CMB.1.raw
tcagagctcacgtacacgaccggtgctcgatttagtacacgtgattagggagttggggcgtgggcctaagggaagcagcactggtggtgcctcagccatggcctggaccgttctcctcctcggcctcctctctcactcgcacagactctgtggcctacctatggtactgacttcacgcctatccctcggtggccaggtcggccccaggaccaggacggtccaagggtaccttcccgtggtcggaacggaaacaacgagttcggaaagtacgagtgtacagttacgtaaccaacagacggccaggcctaggccccgtggtacgcgttacggcgtaccagtcgatacgactaacgcggaacccggtcccgtagacgggactccgtacggacggtccgacttcgtaccgtcggacctttaccgacgtttcgtaacgggaaccggtaccggtaccccacccgttaacccgggaccctaacggttccgaacggtccggacccgggttaccggtaacccgggttcgggggtaaccgtacgggtacgggtaaccgttaacgttacggtttttacggtaccggttagggttacgggtagggtaacgtacgtttaaacgttttcggttacgttaagttacgttacggttttacggttcgggtaaccgggttacgggtaaccgtaaggtccgttacgggtaacccgtttccgggtacccgttacgtaaccggaacccgggttaaccgtacggtaccccggttaccccgtttacccgggtacccgttacccgggtttcccgttaccccgggtttacccccggtacccccgttaccgtttaacccccgg

SEQ ID NO: 290349 - DNA, 642 bp, Homo sapiens
  misc_feature: GYAE6OF02FRJ8I.47.23.C01.1.454.CMB.1.raw
  modified_base (299)..(299): a, c, t, g, unknown or other
  misc_feature (299)..(299): n is a, c, g, or t
tcagagctcacgtacacgaccggtgctcgatttagtacacgtgattagggattggggcccaacaatcacatcccctcctcagaagcccccagagcacaactccttaccatggactggacctggaggatcgtctttttggtggcagcagccacaggtgcccactcccaggtccaacttgtgcagtctggggctgaggtgaagaagccgtggggcctcagtgaaggtttcctgtcaggcttcgtggatacagcttcactagtcatgctatacagttgggtcgcgccgacggccccccgganaggacgaccgtggacggtgggagtgggatggatcagcagttggacaagtgtaaacaagtaaaacactacaacaaggtaacgttaccgaaggggacacggggtaccaaccctaagttaacccgaagaacgaccaacttccgaccccggtacgaaccccgaacaccgtaccctaacgaacgtcggaactgacgcgacgcctacgtaccttcgtagaaacgtaccgacggtacttaacgttttaaccacgttggtagacgtagtacgggtagggttacgaacgttcggtaacttcccgttacgtacgtagtcggtacggtccggagggtaccgaacgggtacccgg

SEQ ID NO: 290350 - DNA, 681 bp, Homo sapiens
  misc_feature: GYAE6OF02GTIKR.47.23.C01.1.454.CMB.1.raw
tcagagctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacaggacggccaggacttccctggtggaggaaacaacattaggaaagtaagagtgtacagttggtaaccaacgagacggccaggccacggcccctgtcgctggtccgtcatgatgatagccgaccggcctcgagggactcccgtgacgcgtcttcgtcgtcggcctctaagttcgtagggaaccacggacccacccgtacgaccctagtaccaggccggtcggtacggaacggtccccggaagacggtcggaaccggaccgtaacttacttacgtagttacgagggttcggtagggactaaggttaacgtagtacgtaccgtaccggacgtacggttacggtttcgggacggggtacggaaccgtagggtacctaccgggtaaccggttaccgtaacggtacccggaacggtacccgtaacgggtcccgttccgtccccccggttaggtaccccgtaccgtttcccggttacccgttcccccccgg

SEQ ID NO: 290351 - DNA, 755 bp, Homo sapiens
  misc_feature: GYAE6OF02I1931.47.23.C01.1.454.CMB.1.raw
  modified_base (297)..(297): a, c, t, g, unknown or other
  misc_feature (297)..(297): n is a, c, g, or t
tcagagctcacgtacacgaccggtgctcgatttagtacacgtgattagggattggggccccaacaatcacatccctcctcagaagcccccagagcacaactccttaccatggactggacctggaggatcgtctttttggtggcagcagccacaggtgcccactcccaggtccaacttgtgcagtctggggctgaggtgaagaagccgtggggcctcagtgaaggtttcctgtcaggcttctggatacagcttcactagtcatgctatacattgggtgccgccgacggccccccgganagacgaccctggacggtggagtgggatgggatcgagctagttcggactaaagttacggtaaacaaagtaaaaaccacgtaacaaccgaagtaacggttacccgaaggggacgtacggggtaccaacccgtaacttaaacccgaggaacgtaacctacgtacccgtacccggaacccgtaacccaaccgtaaccgtaccctaaccgtacgtaacgggtaaacgtaggaaccgaccgtaacgtcccgttacgtacccgtttaccgtaacgggaaacgaacccgtaaccgggtacctttaacgttttaacctaccgttacggtacggaccgggtaaggtacgggttacgggggttttacggaacggttacggtaaaccgtttccccgttaacgtaaccgttacggtaccgggttaaccggttccgggtaacgggggtaccggtaaaccggggtaaccccgg

SEQ ID NO: 290352 - DNA, 631 bp, Homo sapiens
  misc_feature: GYAE6OF02GOO7K.47.23.C01.1.454.CMB.1.raw
  modified_base (274)..(274): a, c, t, g, unknown or other
  misc_feature (274)..(274): n is a, c, g, or t
  modified_base (291)..(291): a, c, t, g, unknown or other
  misc_feature (291)..(291): n is a, c, g, or t
tcagagctcacgtacacgaccggtgctcgatttagtacacgtgattagggagttggggcccaacaatcacatccctcctcagaagccccagagcacaactccttaccatggactggacctggaggatcgtcttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtncgccaggccccccgganacgagaccctggacgtggagtgggatgggatcgagtcattggacaagtggtaaacagtaaaacactcaacagaagttccagggcagggtcaccataccagagacatcgtccgcgaccacgacgacctacagtcggacctaggacgcacgccctagaccttcgtacgaacgacccgtagggacctttaacgtttaccgtacgttacggtacgtacgggtaacggacggggtaagggggttttacggtaccggttaacgggtaaacccgttcccgtttacgttaacccgtagtttaccggggaccgttacgtcggggggtaaccgaaacggggtaaccccgg

SEQ ID NO: 290353 - DNA, 780 bp, Homo sapiens
  misc_feature: GYAE6OF02HDGPU.47.23.C01.1.454.CMB.1.raw
tcagagctcacgtacacgaccggtgctcgatttagtacacgtgattagggattggggccccaacaatcacatccctcctcagaacgcccccagagcacaactccttaccatggactggacctggaggatcgtctttttggtggcagcagccacaggtgcccactcccaggtccaacttgtgcagtctggggctgaggtgaagaagccgtggggcctcagtgaaggtttcctgtcaggcttcgtggatacagtcttcactagtcatgctatacagttgggtgcgcccacgggcccccggacgacgacgaccctggagtggagtcgggatggatcgagcgtagttcggactaagttacggtaaacaaacgtaaaacacctacaactaaggtaacgttaccgagggtacgacgggtacaactacttaaccgagacgacgtactccgtacccgacgaccaacgacgtacctaacgacgtacggtaacttaggagtaccgtacgtaccgttacgtaacctttcggaacggaaacgtaccgttaaccgggttaacctttttacgtttaaacccgttacggtttacggtacgggtaaccgggtaaggggtaccgggttttaacggggggttttacgaaacccgggtttaaccggggttaaaccccttttccccggttttaacccggttaaccgttaacgggttttaccccggggggtaaccggttttacccggggttaaccgggggggttaaacccccggtaaaaacgggggtttaaccccccgggg

SEQ ID NO: 290354 - DNA, 552 bp, Homo sapiens
  misc_feature: GYAE6OF02HH5TB.47.23.C01.1.454.CMB.1.raw
  modified_base (294)..(294): a, c, t, g, unknown or other
  misc_feature (294)..(294): n is a, c, g, or t
  modified_base (343)..(343): a, c, t, g, unknown or other
  misc_feature (343)..(343): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
  modified_base (408)..(408): a, c, t, g, unknown or other
  misc_feature (408)..(408): n is a, c, g, or t
  modified_base (425)..(425): a, c, t, g, unknown or other
  misc_feature (425)..(425): n is a, c, g, or t
  modified_base (439)..(439): a, c, t, g, unknown or other
  misc_feature (439)..(439): n is a, c, g, or t
  modified_base (448)..(448): a, c, t, g, unknown or other
  misc_feature (448)..(448): n is a, c, g, or t
tcagagctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaaacttgtgcagtctggggctgaggtgaagaagccgtggggcctcgagtgaaggtttcctgtcgaggcttctggatacagcttacactagtcatgctatacattggtgcgcaggcccccgganagagacctgagtggatagggatggatcagcagttgacgaataggtaaanaataaaacactacaacagaagttcgaggacaggtcacattacagananatctccgacgaccaganacctacagtggaactgngacacgctcgactntagaacganacgtataacttacttacagtcgacgagacggtagggtttcgacgtggaactttaccgtacttaaccgtatcggacgttcggtacggggtacaaagggtaacccg

SEQ ID NO: 290355 - DNA, 665 bp, Homo sapiens
  misc_feature: GYAE6OF02GICUC.47.23.C01.1.454.CMB.1.raw
tcagagctcacgtacacgaccggtgctcgatttagtacacgtgattagggattggggccccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccacgggccccccgacaggacgacctggagtggagtgggatggacgtcagctagttggcaaagtggtaaacaagtaaaaaccactacaaccgaagtaaacggttccgaaggggtcctaaggggtccaaaccctagttaacccgaagaacgaccaacttcccgtacccggccgaacccacgtaacgaccctaacagtacggaaccttaggacgacctacgccctagtaccgtttacgaacggtaaacgaccgtaccggttatttaacgtttaaccttacggttaggtaccggacgaacgggtagggtacggggtttacgacggtacggtaaccgtttccttacgtacacggtcggtaccggttggacggggaactaacggggtacccg

SEQ ID NO: 290356 - DNA, 692 bp, Homo sapiens
  misc_feature: GYAE6OF02FU8YQ.47.23.C01.1.454.CMB.1.raw
  modified_base (297)..(297): a, c, t, g, unknown or other
  misc_feature (297)..(297): n is a, c, g, or t
tcagagctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggtcttctggatacagcttcactagtcatgctatacattgggtgccgcccgacggccccccgganaggacgacccgtggagtcggagtggggatggatcagctagttggacaagttaggtaaactaataaaaccgctacactaagtaacgttaccggaagggacgtaacggggtcctaaccctaacgtttaacccgaaggtaacgaacctacgtcccgtacccgaccgaacctacgaccgtaccctaacgacgtacggaacttcgacgtacacgtccgtagtaccgttctacggaaacgaccgtaccgggtaccttaacttttaccgttaacgtcggttaggacggtaggtaggggtacgggtttcggaaccgttacggtaaaccctttcccgttaacgttaacggtacgttacggggtaccgttccgggttacggggaacggtaaccggggtaccccgg

SEQ ID NO: 290357 - DNA, 586 bp, Homo sapiens
  misc_feature: GYAE6OF02JBUHA.47.23.C01.1.454.CMB.1.raw
  modified_base (566)..(566): a, c, t, g, unknown or other
  misc_feature (566)..(566): n is a, c, g, or t
tcagagctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtgcagtggccccaaggcagacggccaggattccctgtggaggaaacacagttggaagttaagagtgtactattaggtaccaacaggaggccaggccaggcccctgtgctggtcgtccatgatgatagcgaccggcctgagggactcccgtgacgccgtcttctcgtcggccttccaagtttccgtagggaaacctacgggcccaccgtagaccctatccgagccgcggtacgacggccgagagtgacggaccgacgttactacgtgttacgaggtggtggacgtagtaattagtagactccgagtcgtaggtttcgcggtacggacgacgcgtcgaccgtacgtaacgtacacggacccgaggccgtccgtaccccgtccggtaccnccgttaccgtccgttccccg

SEQ ID NO: 290358 - DNA, 775 bp, Homo sapiens
  misc_feature: GYAE6OF02JR6M8.47.23.C01.1.454.CMB.1.raw
  modified_base (185)..(185): a, c, t, g, unknown or other
  misc_feature (185)..(185): n is a, c, g, or t
tcagagctcacgtacacgaccggtgctcgatttagtacacgtgattagggattgggcccaacaatcacatccctcctcagaagcccccagagcacaactccttaccatggactggacctggaggatcggtcttttggtggcagcagccacaggtgcccactcccaggtccaacttgtgcagtcgnggggctgaggtacggaagaacgccgtggggcctacgagttggaaggtttccctgtacgaggtcttcgtggtaactacagtccttccgtaattacggtcctaagtgtactataacctagttggggtacgccgccccgtcgggacccccccggaagacgtacggaccctggaggtgggtacgtggggtatgggactcgaaggtcgagttcggaacgtaagtacgggtaaacaaactaaaaccgtactaccgaacgtaagtaaacggttccgaagggtcgtaacgggacctacctaacgtaaccaacggtaacgaccgtactcccgtaaccggaccgaaccctaacgtaccgtccctaaacgtacgtacggtacgtaacgcgtaaccgcgtacgttacgaccttaacgacgtaaacggtaccaccgggtaactttaccgttaacgttaccgtacggtcgaacggttaaccggtaggggttacgggtttaacgacccggttaaaggttacccgttaaccgtttaaccgacggttacggttacgggttacccggttaacgggtacggggtaaaccggtaaccgggtaaccccggg

SEQ ID NO: 290359 - DNA, 608 bp, Homo sapiens
  misc_feature: GYAE6OF02FJX5T.47.23.C01.1.454.CMB.1.raw
  modified_base (347)..(347): a, c, t, g, unknown or other
  misc_feature (347)..(347): n is a, c, g, or t
tcagagctcacgtacacgaccggtgctcgatttagtacacgtgattagggattggggcccaacaatcacatccctcctcagaagccccagagcacaactccttaccatggactggacctggaggatcgtctttttggtggcagcagccacaggtgcccactcccaggtccaacttgtgcagtctggggctgaggtgaagagcctggggcctcagtgaaggtttcctgtcaggcttctggatacagcttcactagtcatgctatacattgggtgcgccaggccccccggacagagacctgagtggatgggatggatcgagcagttggacaagtggtaacaataaaacnctacaacagtaagttccgaagggcgagggtccaaccgtattaaccgagaacgacagtcctaccgaccgaacccacgacgaccctacacgtacggaacttggacgcgacgcctacgacttcgacgaagaccgtacggtcttaacgtttacctactggtacgacgtaggtagggtaggggtttagaccggttagggtaacccttccgtttacgtaacgtagtacgggtaccgttgggtacggggtaccgtaacgggtacccgg

SEQ ID NO: 290360 - DNA, 632 bp, Homo sapiens
  misc_feature: GYAE6OF02I1JBY.47.23.C01.1.454.CMB.1.raw
  modified_base (216)..(216): a, c, t, g, unknown or other
  misc_feature (216)..(216): n is a, c, g, or t
  modified_base (231)..(231): a, c, t, g, unknown or other
  misc_feature (231)..(231): n is a, c, g, or t
  modified_base (305)..(305): a, c, t, g, unknown or other
  misc_feature (305)..(305): n is a, c, g, or t
  modified_base (446)..(446): a, c, t, g, unknown or other
  misc_feature (446)..(446): n is a, c, g, or t
  modified_base (489)..(489): a, c, t, g, unknown or other
  misc_feature (489)..(489): n is a, c, g, or t
tcagagctcacgtacacgaccggtgctcgatttagtacacgtgattagggattggggcccaacaatcacatccctcctcagaagcccccagagcacaactccttaccatggactggacctggaggatcgtctttttggtggcagcagccacaggtgcccactcccaggtccaacttgtgcaggtcgtggggctgaggtgaagagcctaggggcctnagtgaacggtttccnggtcaggtcttcgtggatacagtcttaccatagtcagtgtactatacagttggtagcgcccgaaggccccgganaggacgaccgtggagtgagtgggagtagactcgagtcagttggcctaagtacggtaacaattaaaacccgctacaacaggtaacgttcgacgggacgtaacggtccaacgtactacagacgtacactcacccggcacccanaccgactacgagtacgaacgtgaacgactacgcctaggtaccncgtagaacgacgtaccggtacttacttatactggttacgacggtgtaacggggttaggttaccgtagttacggacccttacgttacctacgtaggttaccggggaccgttcggggtaaccgggacggtaacccgggtaacggg

SEQ ID NO: 290361 - DNA, 763 bp, Homo sapiens
  misc_feature: GYAE6OF02FTB04.47.23.C01.1.454.CMB.1.raw
  modified_base (234)..(234): a, c, t, g, unknown or other
  misc_feature (234)..(234): n is a, c, g, or t
  modified_base (374)..(374): a, c, t, g, unknown or other
  misc_feature (374)..(374): n is a, c, g, or t
tcagagctcacgtacacgaccggtgctcgatttagtacacgtgattagggattggggcccaacaatcacatccctcctcagaagcccccagagcacaactccttaccatggactggacctggaggatcgttctttttggtggcagcagccacaggtgcccactcccaggtccaacttgtgcagtcgtggggctgaggtgaagagccgtgggcctcgagtgtagtttcctgtcgnggtcttcgtggatacagtcttctactgtcatcgactatactggttggtcgccgtccgaccgggcccccgagacggacgaccgtggaggtggagtgggatggactcgacgcgtagtcgataagtacgtaaacaactaaacnctacacgtaacggtacgtacgacggacgtacggactaaccgtacgtaccgagacgtaccgtacgttccgacccggaccaaccctagaacccgtacccgtaacggtaacgtaccggaaccgtacggaccgtaccgtacccggttaaccttaccggttaccttaacgggtaaccgggtaaaccgtaacggttaccgtttaaacgttttaaccgtttaacccggttaacgttacgggacggttaaccggggttaaagggttcggggtttaaccgggttacggtaccggttaaccggtttaacccgtttcccgttaagtaaccgggttaccggtggggtttaaaccccgggttacggggtaccggggtaaacccggacccggttaaccccggg

SEQ ID NO: 290362 - DNA, 744 bp, Homo sapiens
  misc_feature: GYAE6OF02ICWDV.47.23.C01.1.454.CMB.1.raw
  modified_base (323)..(323): a, c, t, g, unknown or other
  misc_feature (323)..(323): n is a, c, g, or t
tcagagctcacgtacacgaccggtgctcgatttagtacacgtgattagggattggggccccaacaatcacatccctcctcagaagcccccagagcacaactccttaccatggactggacctggaggatcgtctttttggtggcagcagccacaggtgcccactcccaggtccaacttgtgcagtctggggctgaggtgaagagccgtgggcctcagtgaaggtttcctgtccaggtcttcgtagggataccgaggtcctttacaccttaggtccaattcggccttaataacagtttggggtgccgccgacggcccccccgganacgagaccctggaggtcggaagtggggatcggatacgagacgagtttggactaagttaggtaaactaataaaaccgactaccaacgaagtaaacggttccgaacggggtacggtaacggggtaccaacccttaacgttaacccgacgggtaaacgaacctacgttaccgtaccccggaccggaccccaaacgaccggtacccctaaccgtagtaacgggtaacctacgggaacgacgaccgtccgtagacccttttagaccgtaaacgaccgaaccggttacttactttaaccgtaccggttgtagggaccgtaaggtaccgggttaggggttttacgcggttaacggttaccttcccgtttaacgacgttacgttgggtaccggttcgggttacggggaaccggttaaaccggacccggg

SEQ ID NO: 290363 - DNA, 647 bp, Homo sapiens
  misc_feature: GYAE6OF02H5W2X.47.23.C01.1.454.CMB.1.raw
  modified_base (255)..(255): a, c, t, g, unknown or other
  misc_feature (255)..(255): n is a, c, g, or t
  modified_base (488)..(488): a, c, t, g, unknown or other
  misc_feature (488)..(488): n is a, c, g, or t
tcagagctcacgtacacgaccggtgctcgatttagtacacgtgattagggattgggcccaacaatcacatccctcctcagaagccccagagcacaactccttaccatggactggacctggaggatcgtctttttggtggcagcagccacaggtgcccactcccaggtccaacttgtgcagtcgtgggctgaggtgaaggaagccgtggggcctcgaggtggtaacggtttcctgtcgaggtcttcgtggactacngtcttcactagtcatcgactatactagttgggtgccgccgaccggcccccgagagacgaccgtgacgtggacgtgggatggaatcgagctagttggacgtaagttacggtaaacaataaaaccactacaacgtaagtacgtacgagggtacgacgggtaccaccgtaactaccgagtaacgacgtactcccgtaccggccgaaccacgtacgaccctaacgagtacggtaacnggaaacgcgtaccgtctacgtaccttcgtagaaaccgcgaacgttacttaactttaccactggacagtacggtagggttcggtttacgccgttaacggtaccttaccgttacgtacgagttacggtaccggttcggacgggtacggtaaccggtcccgg

SEQ ID NO: 290364 - DNA, 903 bp, Homo sapiens
  misc_feature: GYAE6OF02GY490.47.23.C01.1.454.CMB.1.raw
  modified_base (225)..(225): a, c, t, g, unknown or other
  misc_feature (225)..(225): n is a, c, g, or t
tcagagctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtcggccccaggacagacggcaggattcctgtggagaacanattggaagtaagagtgtacagttcggtaaccaacaggaggccaaggccacggccccctggtcgcgttcgggtcgtccatcgataggtatacggaccggtaccccggcccctacggaacggggtacctcccgtaggacgtcccgttcgtttccgttacgtcgggtacccttaccgtaaacgttttccgggtacggggaaacccgtacccgggtacccctaacccccgttacggaaaccctacgttaccgaaccgggtcccggggtaaccggggtacccgggaaaccgggacccggggtaaaggtacggtacggggaacgggtaccccggtaacgttaacgtttacccgttgggttaaccggtagggggtttacgggttaccgggggaaacgttaagggtttaaacgttaggggttaccggtaacccggttcccccgggaagggttacccgggttttaagggggttttcccggggtaacggggggttaacgggtaacccgtaaccgggtccggttacccgggttaaccccggtttaccgggttaaacggttacccggaacccgggtaaccccggtaaaccggggtcccccgtttaccccggggtaacccccccggtttaccggggtttaaccccctaaccccgggttttccccggtttaccccccggtttacccccccgg

SEQ ID NO: 290365 - DNA, 641 bp, Homo sapiens
  misc_feature: GYAE6OF02IK6CX.47.23.C01.1.454.CMB.1.raw
tcagagctcacgtacacgaccggtgctcgatttagtacacgtgattagggattggggcccaacaatcacatccctcctcagaagcccccagagcacaactccttaccatggactggaccctggaggatcgttctttttggtggcagcagccacaggtgcccactcccaggtcccaacttgtgcagtctggggctgaggtgaagagccgtggggcctcgagtggaaggttttcctgtcaggtcttctagggatacgagtccttcacttagtcatgactatactagttcgggtgccgccgacggcccccggaacaggacgacctgacggtggtagtcgggagtggagtacgaggcagtttcggactaagtacggtaaacaagttaaaacactacaacgagtaacgttacgaagggcaagggtacaacgacttaaccagagtacactccgaccgccaaccgacaaccgtacacgtagtcgaacttcgagacgacgcctagtacgttcgacgtacgaacgtaacgacgtttaattacctaacgttcgtagtacgtaggagggttcgggttaggtacggttaaccggacttacccgttactaagtacgtacggtccggttacgtacgggacgtaacgggtacccgg

SEQ ID NO: 290366 - DNA, 763 bp, Homo sapiens
  misc_feature: GYAE6OF02H66R0.47.23.C01.1.454.CMB.1.raw
  modified_base (213)..(213): a, c, t, g, unknown or other
  misc_feature (213)..(213): n is a, c, g, or t
  modified_base (306)..(306): a, c, t, g, unknown or other
  misc_feature (306)..(306): n is a, c, g, or t
tcagagctcacgtacacgaccggtgctcgatttagtacacgtgattagggattggggccccaacaatcacatccctcctcagaagccccagagcacaactccttacatggactggacctggaggatcgtcttttggtggcagcagccacaggtcgcccactcccaggtccaacttgtgctagtctgggctgaggtgaagagccgtgggctcgngtgacgttctgtcaggtcttcgtgatacagtcgttcactagtcagtgtactagttacgagttgggtcgcgtaccgtaccggaccccccggtanacgtacgaccgtaggtacgtcggtacgtagggactacggtactcgacgtcgacgtttacggaataacgtacggttaaacaaactaaaccacttaccgataacggtacgttaccggaacggtcgtaacggtacctaacgttaacgaacgtacgactacgtacgtcccgaccgtaccggtaacacgtacgacccgttaaagcgttaacgtaacgtacgtacgtacgaccgttaccgtacgtaacccttcgggtaaacgaaccggtaccgtaaccgggtaacttttaacccgtttaccgtaccggttaggtaaccgggtaccggtagggttaaccggggttttaccgggttacggccggtttaaccggttacttaacccccggtttacgtaaaccggttccggttaacgggttacccggttacggggtaaccggggaacccgtaacgggttaaccccggg

SEQ ID NO: 290367 - DNA, 859 bp, Homo sapiens
  misc_feature: GYAE6OF02FZ1KN.47.23.C01.1.454.CMB.1.raw
tcagagctcacgtacacgaccggtgctcgatttagtacacgtgattagggattgggcccaacaatcacatccctcctcagaagccccagagcacaactccttaccatggactggacctggagatcgtcttttggtggcagcagccacaggtgcccactcccaggtccaacttgtgcagtcgtggggctgaggtgaagaagccgtggggcctcagtgtaaggtttcctgtcgacggtcttcgtaggacttacgacgttcttacacttagtctatcgtcgtaataacgtgttacggggtcgtccgacccgaccggggacccccccggaacgacggaacggtaccccgtgggtaaggtagggtacggttacggggtaacgttggggtaacgtacgtaacggacgttaacggtttcgggtaaccgtaaaaggttaccgggtaaaaaccgtaaacttaaaaacccgtactttaaaccgaaccggtaagggttaaacccggttaccggtaaccgggggtaccggtaacggggttacccctaaacggttaaccttaaaccggtaacggaacgtaaccgtacctcccgtacccggacccgtaacccaccgtaacgaaccccttaaacggaacgtaaccgggtaaccgtcggtaaacgtaccgtaaccgggtccctacggttaaccgttacgtacggtaaaccgaccgtaaccggttaactttaacttttaaccgtacgttaggtccgacgggttaagtagggttaggggttttaccgaaggttaacccggttaaccttccctttaagtaccgtaaggtttcggtacggttacccgggtagggttaacccggaaccggttaccccggg

SEQ ID NO: 290368 - DNA, 143 bp, Homo sapiens
  misc_feature: GYAE6OF02HNYSM.47.23.C01.1.454.CMB.1.raw
  modified_base (126)..(126): a, c, t, g, unknown or other
  misc_feature (126)..(126): n is a, c, g, or t
  modified_base (132)..(143): a, c, t, g, unknown or other
  misc_feature (132)..(143): n is a, c, g, or t
tcagagctcacgtacacgaccggtgctcgatttagtacacgtgattagggattgggcacagcggccctgggctgcctggtcaaggactacttcctacgtgagctctgaggcgggctggacaaggcncatagnnnnnnnnnnnn

SEQ ID NO: 290369 - DNA, 681 bp, Homo sapiens
  misc_feature: GYAE6OF02GAQS2.47.23.C01.1.454.CMB.1.raw
tcagagctcacgtacacgaccggtgctcgatttagtacacgtgattagggattggggccccaacaatcacatccctcctcagaagcccccagagcacaactccttaccatggactggacctggaggatcgtctttttggtggcagcagccacaggtgcccactcccaggtccaacttgtgcagtctggggctgaggtgaagaagccgtggggccctcgagtgaaggttttcctgtcaggtcttctggactacagtcttcactagtcatgctatacagttgggtgcgccgacggcccccggacgagacgacccgtggacggtggagtgggagtggagtcgagctagttggactaagtaggtaaactaaataaaacacctacaacgaagtaacgtaccgagggtacgaggtaccaacctacttaaccgaagtacgactacttaccgccgacgtaacccaccgacgtaccctaacgtagtacggtaacgtgacgacgacgtaccgttacgtaccttacgtacgtaaacggaccgtaaccggtactttaactttaaccgttacgttacgtacggcgtaaggtacggttaaggggtttacgtaacggttacggttaaccttaccgttaccgtaagtcgttacgggttaccggttcggtacggggtaccggtaaaccgggtacccgg

SEQ ID NO: 290370 - DNA, 698 bp, Homo sapiens
  misc_feature: GYAE6OF02IHM3A.47.23.C01.1.454.CMB.1.raw
  modified_base (317)..(317): a, c, t, g, unknown or other
  misc_feature (317)..(317): n is a, c, g, or t
  modified_base (342)..(342): a, c, t, g, unknown or other
  misc_feature (342)..(342): n is a, c, g, or t
tcagagctcacgtacacgaccggtgctcgatttagtacacgtgattagggattggggcccccaacaatcacatccctcctcagagcccccagagcacaactccttaccatggactggacctggaggatcgttctttttggtggcagcagccacaggtgcccactcccaggtccaacttgtgcagtcgtggggctgaggtgaagaagccgtggggcctcgagtgaaggtttcctgtcaggtcttgtggtactacagtccttacactagtcagtgtacttaatactagttgggtcgtccgccgaccggaccccccgganacgacgtacctgaggtggagtgggntaggatacgagactagttacggacgtaagtacggtaaactaaactaaaacctacgtaccaacgaacgtaacggttaccgagggtacgtaacgggtacctaaccgtactaacgtacgaacgtacctactcccgaccgtaccaaccactacgtacctaacagtacgtaactcgaacgctacgtctaagtaccttcgaacgtaacgacctaccggtactttaaacttttaccgtacgttcggtacggaagacgggttaacgggttacggggtttacgaaccgtttccggaacctttaccgttacgtacggtaggttacccggacggttacgggaaccggtacggtaaaccggtacccgg

SEQ ID NO: 290371 - DNA, 942 bp, Homo sapiens
  misc_feature: GYAE6OF02HZD6Z.47.23.C01.1.454.CMB.1.raw
tcagagctcacgtacacgaccggtgctcgatttagtacacgtgattagggattggggcccaacaatcacactcccctcctcagaacgcccccagagcacaactccttaccatggactggacctggaggatcgttctttttggtggcagcagccacaggtcgcccacctcccaacggtcctaacgtttgtcgctacggtcgttgggggctaggtaggtaggaagaaggtcccgtgggggacctacgtaggtaggttaacggttttccgtggttaccaggttccttcgtagggtactaccgacgtcttaccgtacgtagttcaattcggtaccttaactacgtagtttcggggtaccgtccggccccggaacccggaccccccgggacaacggtaccggtaccgttagggtaacgtggggttaacggtgggggtactacgggtaacgttcgtacgtacggttaagtttaccgggaacgttaaacggttaacgttaaaacctaaaaggttaaaaccctacgtaaaccgaacgtaacggttaaaacccgtccggtaaccggggtacggtaaccgttaccggaaaccttaaacggttaaccgacggtaaactccgttactacccggtaccccgaacgaccctaccggaccgtaacctacgtaaccgggttaacgaaccgttaacgacgtacccgccggttacccgtagttaccttaaacgggtacgaaccgtaacccggtgttaaaccgttttaacctttccggtaaccggttaggtcccggtaaacgggtaccgggtttacggggttaacgggttttccgggaaaccgtttaacccggtttaaacccgtttaaccgttaccggtaaaccggtttcgggttttaacggtacccccgggttaagggggtaaacccgggaaccggggttaaacccggttacccccgggg

SEQ ID NO: 290372 - DNA, 677 bp, Homo sapiens
  misc_feature: GYAE6OF02FULCY.47.23.C01.1.454.CMB.1.raw
  modified_base (246)..(246): a, c, t, g, unknown or other
  misc_feature (246)..(246): n is a, c, g, or t
tcagagctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatccctcggtggcagtcggccccaggacagacggcaggatccctgtggagaaacaacatggaagtaagagtgtanattggtaccaacaggacggccaggccacggcccctgtgcgtggtcgtccatggatgatacggccggacccggcctcgacgggtactcccgtagacgtccgtcgttcctcgtcggtcctaccctaacgttccggtacgggaaccgaccggaccctaccccgtacgaccctacgtccgacggccggaccgggtacgaaaccggccgggaaagtacgtacgggaccggtacccgtaacgttaacgttaccgtggttaccgtaggggttgggtacgggtaacgtaggttaaacgttggtacgacgtcccggaagtggttacgggtttcggggacggtacgggaaccgtaacgcgtacgtacccgtagtaacgtcaaccggtcccgaggtcccgtccggtcccccgtcggttcccaccgttcgttcccgtcccccg

SEQ ID NO: 290373 - DNA, 804 bp, Homo sapiens
  misc_feature: GYAE6OF02GO48U.47.23.C01.1.454.CMB.1.raw
  modified_base (138)..(138): a, c, t, g, unknown or other
  misc_feature (138)..(138): n is a, c, g, or t
  modified_base (177)..(177): a, c, t, g, unknown or other
  misc_feature (177)..(177): n is a, c, g, or t
  modified_base (197)..(197): a, c, t, g, unknown or other
  misc_feature (197)..(197): n is a, c, g, or t
  modified_base (247)..(247): a, c, t, g, unknown or other
  misc_feature (247)..(247): n is a, c, g, or t
tcagagctcacgtacacgaccggtgctcgatttagtacacgtgattagggattggggcccaacaatcacatccctcctcagaagcccccagagcacaactccttaccatggactggacctggaggatcgtcttttggnggcagcagccacaggtgcccactcccaggtccaacttgngcagtcgtggggctgaggtnaagacgccgtggggccctgagtgaacggttttccaggtcagggtcttcgnggactacgagcctttacacgttagtcattgactagtacaggttggtagccgaccgacggtacccccggagaagcgacctaggtcgttgggaagttacgggatagggtactcgacgtactaggttaccgattaaacggtaggtaaacctaaacttaaaaccgccttaaccgtaacgaacggtttaaaccgttccggaaagggtaccgtaacggggttacaacccggttaacttaaccgaaggtacgtaccgtacgtaccgttcccggaacggtacccaaaccgacgtaacccgtaacgtcgaaagggtaaccttcgggaacaaccgtaccgtacgtactaaccggtttcgaaacggaaccgtaaccggtaacgttacctttaacgtttaaccgaccgtttaggtaccgggaagtaaggggtacgggtttaaccggggtttacgtaaccgggtttaaccggtaccccgttttaaccgttaccgtttaaaccgggtggttacccggggtaccgtttacccgggggaacgggttaacccggggaaacggttacccccgggg

SEQ ID NO: 290374 - DNA, 751 bp, Homo sapiens
  misc_feature: GYAE6OF02GAC99.47.23.C01.1.454.CMB.1.raw
  modified_base (245)..(245): a, c, t, g, unknown or other
  misc_feature (245)..(245): n is a, c, g, or t
tcagagctcacgtacacgaccggtgctcgatttagtacacgtgattagggagtgggggcccaacaatcacatccctcctcgagaacgccccagagcacaactccttaccatggactcggacctggaggatcgtcttttggtggcagcagccacaggtgcccactcccaggtccaacttgtcgccagtcgtggggctgacggtgaagagccgtgggcctcagtgaggtttcctgtcaggtcttcgnggatcagtctacactagtcatgacctatactagttagggtgcgccacggtcccccggactaaggacgaacccgttggaacggtcgggtaacgtaggggaatacgggtagtacgaacggtcctaagtttcgggactaaagtcgggtaaactaaagttaaaaccgtactacgtaactaacggtaacgttaccggagggtaccgaaggggttacccaaccgtacgttaaccgacgtaagacctaacgttccgtaccgacggaacccgaacaacggtaccctaacgaacgtacggaaaccgtgtaacgtaccgaacgtccgtacgttaaccttacgttacgaaacggtccgtaaccgggtaccttaacgtttaacccttaacgttacggttccgtaacggtacggtaacgggtacggggtttacgaacgggttacggtaacccggtttccttaccgttaacgtacgtacgggtaccggtccggtacgggtacccgaacgggtaaccccgg

SEQ ID NO: 290375 - DNA, 750 bp, Homo sapiens
  misc_feature: GYAE6OF02HCMMB.47.23.C01.1.454.CMB.1.raw
  modified_base (142)..(142): a, c, t, g, unknown or other
  misc_feature (142)..(142): n is a, c, g, or t
  modified_base (248)..(248): a, c, t, g, unknown or other
  misc_feature (248)..(248): n is a, c, g, or t
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
  modified_base (581)..(581): a, c, t, g, unknown or other
  misc_feature (581)..(581): n is a, c, g, or t
  modified_base (640)..(640): a, c, t, g, unknown or other
  misc_feature (640)..(640): n is a, c, g, or t
tcagagctcacgtacacgaccggtgctcgatttagtacacgtgattagggattggggcccaacaatcacatcccctcctcagaacgcccccagagcacaactccttacatggactggacctggaggatcgttcgtttttggnggcagcagccacgaggtcgacccactcccgacgtacctaacgttgtcgcagtccgtggggctggaggtagaacgagtcccggtgggcctgaggtgtaacggtttcnggtcgtaggtcttcgtggtactacgngtccttacaaccgtgtactagtcncgttaattacgnggttcgggtcgcccgccggacccgggtccccccggaagacggaccgacgtggtaacggtggaggtagggacgtggacgtccgaagtcgtacgttagggtaacttaaggtaacgtaaactaaacgaaaactacctaacgaattaacgggttaaccgtacggacgggtaacgtaaccggtaccgtaacttaccgtaaaccgaagtaaccggtaactccctacgggtacccaccgtacccaacggtacctaacgtaccgtaagtacgtaaccgngaccgtacaccgttccctgtcgttacgaaggtaaccggctctaactttattacagggtntaacggacgttaggacgggtttcggtacgtcccgtaacggttacccttcgttaccgtaaggtaccggttcggacccggttaggggacggtaacccgaagggttaccccgg

SEQ ID NO: 290376 - DNA, 131 bp, Homo sapiens
  misc_feature: GYAE6OF01A1AA1.49.34.D01.1.454.CMB.1.raw
  modified_base (131)..(131): a, c, t, g, unknown or other
  misc_feature (131)..(131): n is a, c, g, or t
tcagagtcgagagacacgaccggtgctcgatttagatcgtctgtgttgggttggcagcctaaggctgccccagcgtcactctgttcccacctcctctctctcgactctgagcggctggcaaggcgcatagn

SEQ ID NO: 290377 - DNA, 129 bp, Homo sapiens
  misc_feature: GYAE6OF01CLX7B.49.34.D01.1.454.CMB.1.raw
  modified_base (129)..(129): a, c, t, g, unknown or other
  misc_feature (129)..(129): n is a, c, g, or t
tcagagtcgagagacacgaccggtgctcgatttagatcgtctgtgttggttggcagcctaaggctgcccagcgtcactctgttccaccctcctctctctcgactctgagcggctggcaaggcgcatagn

SEQ ID NO: 290378 - DNA, 134 bp, Homo sapiens
  misc_feature: GYAE6OF01D1MZF.49.34.D01.1.454.CMB.1.raw
  modified_base (132)..(134): a, c, t, g, unknown or other
  misc_feature (132)..(134): n is a, c, g, or t
tcagagtcgagagacacgaccggtgctcgatttagatcgtctgtgttgggttggcagcctaaggctgccccagcgtcactctgttcccgcctcctctctctcgactctgagcgggctggcaaggcgcatagnnn

SEQ ID NO: 290379 - DNA, 132 bp, Homo sapiens
  misc_feature: GYAE6OF01DLZON.49.34.D01.1.454.CMB.1.raw
  modified_base (132)..(132): a, c, t, g, unknown or other
  misc_feature (132)..(132): n is a, c, g, or t
tcagagtcgagagacacgaccggtgctcgatttagatcgtctgtgttggttgggcagcctaaggctgccccagcgtcactctgttcccgcctcctctctctcgactctgagcgggctggcaaggcgcatagn

SEQ ID NO: 290380 - DNA, 136 bp, Homo sapiens
  misc_feature: GYAE6OF01CX3F0.49.34.D01.1.454.CMB.1.raw
  modified_base (135)..(136): a, c, t, g, unknown or other
  misc_feature (135)..(136): n is a, c, g, or t
tcagagtcgagagacacgaccggtgctcgatttagatcgtctgtgttgggtttgggcagcctaaggctgccccagcgtcactctgttcccaccctcctctctctcgactctgagcgggctggcaaggcgcatagnn

SEQ ID NO: 290381 - DNA, 130 bp, Homo sapiens
  misc_feature: GYAE6OF01C4EFY.49.34.D01.1.454.CMB.1.raw
  modified_base (129)..(130): a, c, t, g, unknown or other
  misc_feature (129)..(130): n is a, c, g, or t
tcagagtcgagagacacgaccggtgctcgatttagatcgtctgtgttggtttggcagcctaaggctgcccagcgtcactctgttccacctcctctctctcgactctgagcggctggcaaggcgcatagnn

SEQ ID NO: 290382 - DNA, 136 bp, Homo sapiens
  misc_feature: GYAE6OF01BNZOT.49.34.D01.1.454.CMB.1.raw
  modified_base (131)..(136): a, c, t, g, unknown or other
  misc_feature (131)..(136): n is a, c, g, or t
tcagagtcgagagacacgaccggtgctcgatttagatcgtctgtgttggttggcagcctaaggctgccccagcgtcactctgttcccgcctcctctctctcgactctgagcgggctggcaaggcgcatagnnnnnn

SEQ ID NO: 290383 - DNA, 130 bp, Homo sapiens
  misc_feature: GYAE6OF01DZOR4.49.34.D01.1.454.CMB.1.raw
  modified_base (130)..(130): a, c, t, g, unknown or other
  misc_feature (130)..(130): n is a, c, g, or t
tcagagtcgagagacacgaccggtgctcgatttagatcgtctgtgttggttggcagcctaaggctgcccagcgtcactctgttcccacctcctctctctcgactctgagcgggctggcaaggcgcatagn

SEQ ID NO: 290384 - DNA, 135 bp, Homo sapiens
  misc_feature: GYAE6OF01DDERO.49.34.D01.1.454.CMB.1.raw
  modified_base (135)..(135): a, c, t, g, unknown or other
  misc_feature (135)..(135): n is a, c, g, or t
tcagagtcgagagacacgaccggtgctcgatttagatcgtctgtgttgggtttgggcagcctaaggctgccccagcatcactctgttcccaccctcctctctctcgactctgagcgggctggcaaggcgcatagn

SEQ ID NO: 290385 - DNA, 142 bp, Homo sapiens
  misc_feature: GYAE6OF01B74W7.49.34.D01.1.454.CMB.1.raw
  modified_base (134)..(142): a, c, t, g, unknown or other
  misc_feature (134)..(142): n is a, c, g, or t
tcagagtcgagagacacgaccggtgctcgatttagatcgtctgtgttgggttgggcagcctaaggctgccccagcgtcactctgttcccgccctcctctctctcgactctgagcgggctggcaaggcgcatagnnnnnnnnn

SEQ ID NO: 290386 - DNA, 166 bp, Homo sapiens
  misc_feature: GYAE6OF01BMMXT.49.34.D01.1.454.CMB.1.raw
  modified_base (150)..(153): a, c, t, g, unknown or other
  misc_feature (150)..(153): n is a, c, g, or t
  modified_base (155)..(156): a, c, t, g, unknown or other
  misc_feature (155)..(156): n is a, c, g, or t
  modified_base (158)..(158): a, c, t, g, unknown or other
  misc_feature (158)..(158): n is a, c, g, or t
  modified_base (162)..(162): a, c, t, g, unknown or other
  misc_feature (162)..(162): n is a, c, g, or t
  modified_base (166)..(166): a, c, t, g, unknown or other
  misc_feature (166)..(166): n is a, c, g, or t
tcagagtcgagagacacgaccggtgctcgatttagatcgtctgtgttgggtttggggacaggacctaaggctgccccccaggcgttcacgtctgttcccgaccctcctctcgtcctcggactctcgagcggactggctaaggcgcatagnnnngnngnagcnatgn

SEQ ID NO: 290387 - DNA, 181 bp, Homo sapiens
  misc_feature: GYAE6OF01CGDNG.49.34.D01.1.454.CMB.1.raw
  modified_base (119)..(119): a, c, t, g, unknown or other
  misc_feature (119)..(119): n is a, c, g, or t
  modified_base (142)..(142): a, c, t, g, unknown or other
  misc_feature (142)..(142): n is a, c, g, or t
  modified_base (144)..(181): a, c, t, g, unknown or other
  misc_feature (144)..(181): n is a, c, g, or t
tcagagtcgagagacacgaccggtgctcgatttagatcgtctgtgttgggtttagggcagcctaaggcctgcccccagcgtccactctgttcccgccctcctctctctcgaactctgancgggctggcaaggcgcgattagntnnnnnnnnnnnnnnnnnnnnnnnnnnnnnnnnnnnnnn

SEQ ID NO: 290388 - DNA, 136 bp, Homo sapiens; identical to SEQ ID NO: 290380
  misc_feature: GYAE6OF01D47DM.49.34.D01.1.454.CMB.1.raw
  modified_base (135)..(136): a, c, t, g, unknown or other
  misc_feature (135)..(136): n is a, c, g, or t

SEQ ID NO: 290389 - DNA, 131 bp, Homo sapiens
  misc_feature: GYAE6OF01B93ZJ.49.34.D01.1.454.CMB.1.raw
  modified_base (131)..(131): a, c, t, g, unknown or other
  misc_feature (131)..(131): n is a, c, g, or t
tcagagtcgagagacacgaccggtgctcgatttagatcgtctgtgttggtttggcagcctaaggctgccccagcgtcactctgttcccacctcctctctctcgactctgagcggctggcaaggcgcatagn

SEQ ID NO: 290390 - DNA, 176 bp, Homo sapiens
  misc_feature: GYAE6OF01C9I94.49.34.D01.1.454.CMB.1.raw
  modified_base (140)..(176): a, c, t, g, unknown or other
  misc_feature (140)..(176): n is a, c, g, or t
tcagagtcgagagacacgaccggtgctcgatttagatcgtctgtgttgggtttgggcaagcctaacggctggccccagccgtcactctgttcccaccctcctctctctcgactctggagcgggctggcaaggcgcatagnnnnnnnnnnnnnnnnnnnnnnnnnnnnnnnnnnnnn

SEQ ID NO: 290391 - DNA, 136 bp, Homo sapiens; identical to SEQ ID NO: 290380
  misc_feature: GYAE6OF01BNSBQ.49.34.D01.1.454.CMB.1.raw
  modified_base (135)..(136): a, c, t, g, unknown or other
  misc_feature (135)..(136): n is a, c, g, or t

SEQ ID NO: 290392 - DNA, 135 bp, Homo sapiens
  misc_feature: GYAE6OF01COKHG.49.34.D01.1.454.CMB.1.raw
  modified_base (135)..(135): a, c, t, g, unknown or other
  misc_feature (135)..(135): n is a, c, g, or t
tcagagtcgagagacacgaccggtgctcgatttagatcgtctgtgttgggtttgggcagcctaaggctgccccagcgtcactctgttcccgccctcctctctctcgactctgagcgggctggcaaggcgcatagn

SEQ ID NO: 290393 - DNA, 140 bp, Homo sapiens
  misc_feature: GYAE6OF01A8UYZ.49.34.D01.1.454.CMB.1.raw
  modified_base (135)..(140): a, c, t, g, unknown or other
  misc_feature (135)..(140): n is a, c, g, or t
tcagagtcgagagacacgaccggtgctcgatttagatcgtctgtgttgggtttgggcagcctaaggctgccccagcgtcattctgttcccaccctcctctctctcgactctgagcgggctggcaaggcgcatagnnnnnn

SEQ ID NO: 290394 - DNA, 187 bp, Homo sapiens
  misc_feature: GYAE6OF01C7EGN.49.34.D01.1.454.CMB.1.raw
  modified_base (141)..(187): a, c, t, g, unknown or other
  misc_feature (141)..(187): n is a, c, g, or t
tcagagtcgagagacacgaccggtgctcgatttagatcgtctgtgttggggtttgggcagccctaaggctgccccagcgtcacgtctgttcccgcccgtcctctctctcgactctggagcgggctggcaaggcgcattagnnnnnnnnnnnnnnnnnnnnnnnnnnnnnnnnnnnnnnnnnnnnnnn

SEQ ID NO: 290395 - DNA, 178 bp, Homo sapiens
  misc_feature: GYAE6OF01A58FM.49.34.D01.1.454.CMB.1.raw
  modified_base (173)..(178): a, c, t, g, unknown or other
  misc_feature (173)..(178): n is a, c, g, or t
tcagagtcgagagacacgaccggtgctcgatttagatcgtctgtgttgggtttgggggaagaggaagactgacggtcccccaggagttcaggtgctgggcacagcggccctgggctgcctggtcaaggactacttcctctctcgactctgagcgggctggcaaggcgcatagnnnnnn

SEQ ID NO: 290396 - DNA, 134 bp, Homo sapiens
  misc_feature: GYAE6OF01EA1CW.49.34.D01.1.454.CMB.1.raw
  modified_base (134)..(134): a, c, t, g, unknown or other
  misc_feature (134)..(134): n is a, c, g, or t
tcagagtcgagagacacgaccggtgctcgatttagatcgtctgtgttgggtttggcagcctaaggctgccccagcgtcactctgttcccaccctcctctctctcgactctgagcgggctggcaaggcgcatagn

SEQ ID NO: 290397 - DNA, 137 bp, Homo sapiens
  misc_feature: GYAE6OF01DJ4GU.49.34.D01.1.454.CMB.1.raw
  modified_base (135)..(137): a, c, t, g, unknown or other
  misc_feature (135)..(137): n is a, c, g, or t
tcagagtcgagagacacgaccggtgctcgatttagatcgtctgtgttgggtttgggcagcctaaggctgccccagcgtcactctgttcccaccctcctctctctcgactctgagcgggctggcaaggcgcatagnnn

SEQ ID NO: 290398 - DNA, 175 bp, Homo sapiens
  misc_feature: GYAE6OF01C2WFC.49.34.D01.1.454.CMB.1.raw
  modified_base (133)..(175): a, c, t, g, unknown or other
  misc_feature (133)..(175): n is a, c, g, or t
tcagagtcgagagacacgaccggtgctcgatttagatcgtctgtgttgggttggcagcctaaggctgccccaggcgtcactctgttcccacctcctctctctcgactctgtagcggctggcaaggcgcatagnnnnnnnnnnnnnnnnnnnnnnnnnnnnnnnnnnnnnnnnnnn

SEQ ID NO: 290399 - DNA, 134 bp, Homo sapiens
  misc_feature: GYAE6OF01B90MW.49.34.D01.1.454.CMB.1.raw
  modified_base (133)..(134): a, c, t, g, unknown or other
  misc_feature (133)..(134): n is a, c, g, or t
tcagagtcgagagacacgaccggtgctcgatttagatcgtctgtgttgggttggcagcctaaggctgccccagcgtcactctgttcccaccctcctctctctcgactctgagcgggctggcaaggcgcatagnn

SEQ ID NO: 290400 - DNA, 137 bp, Homo sapiens; identical to SEQ ID NO: 290397
  misc_feature: GYAE6OF01EGPV7.49.34.D01.1.454.CMB.1.raw
  modified_base (135)..(137): a, c, t, g, unknown or other
  misc_feature (135)..(137): n is a, c, g, or t

SEQ ID NO: 290401 - DNA, 136 bp, Homo sapiens; identical to SEQ ID NO: 290380
  misc_feature: GYAE6OF01EXXYY.49.34.D01.1.454.CMB.1.raw
  modified_base (135)..(136): a, c, t, g, unknown or other
  misc_feature (135)..(136): n is a, c, g, or t

SEQ ID NO: 290402 - DNA, 135 bp, Homo sapiens
  misc_feature: GYAE6OF01E4PI3.49.34.D01.1.454.CMB.1.raw
  modified_base (135)..(135): a, c, t, g, unknown or other
  misc_feature (135)..(135): n is a, c, g, or t
tcagagtcgagagacacgaccggtgctcgatttagatcgtctgtgttgggtttgggcagcctaaggctgccccagcgtcactctgttcccaccctcctctctctcgactctgagcgggctggcaaggcgcatagn

SEQ ID NO: 290403 - DNA, 135 bp, Homo sapiens
  misc_feature: GYAE6OF01A2MT6.49.34.D01.1.454.CMB.1.raw
  modified_base (134)..(135): a, c, t, g, unknown or other
  misc_feature (134)..(135): n is a, c, g, or t
tcagagtcgagagacacgaccggtgctcgatttagatcgtctgtgttgggtttgggcagcctaaggctgccccagcgtcactctgttcccaccctcctctctctcgatctgagcgggctggcaaggcgcatagnn

SEQ ID NO: 290404 - DNA, 137 bp, Homo sapiens
  misc_feature: GYAE6OF01EYQQB.49.34.D01.1.454.CMB.1.raw
  modified_base (136)..(137): a, c, t, g, unknown or other
  misc_feature (136)..(137): n is a, c, g, or t
tcagagtcgagagacacgaccggtgctcgatttagatcgtctgtgttgggtttgggcagcctaaggctgcccccagcgtcactctgttcccgccctcctctctctcgactctgagcgggctggcaaggcgcatagnn

SEQ ID NO: 290405 - DNA, 147 bp, Homo sapiens
  misc_feature: GYAE6OF01CS2H2.49.34.D01.1.454.CMB.1.raw
  modified_base (136)..(147): a, c, t, g, unknown or other
  misc_feature (136)..(147): n is a, c, g, or t
tcagagtcgagagacacgaccggtgctcgatttagatcgtctgtgttgggttgggcagcctaaggctgcccccagcgtcactctgttcccgccctcctctctctccgactctgagcgggctggcaaggcgcatagnnnnnnnnnnnn

SEQ ID NO: 290406 - DNA, 135 bp, Homo sapiens
  misc_feature: GYAE6OF01DGRWK.49.34.D01.1.454.CMB.1.raw
  modified_base (134)..(135): a, c, t, g, unknown or other
  misc_feature (134)..(135): n is a, c, g, or t
tcagagtcgagagacacgaccggtgctcgatttagatcgtctgtgttgggtttgggcagcctaaggctgccccagcgtcactctgttcccacctcctctctctcgactctgagcgggctggcaaggcgcatagnn

SEQ ID NO: 290407 - DNA, 135 bp, Homo sapiens; identical to SEQ ID NO: 290402
  misc_feature: GYAE6OF01DSZMD.49.34.D01.1.454.CMB.1.raw
  modified_base (135)..(135): a, c, t, g, unknown or other
  misc_feature (135)..(135): n is a, c, g, or t

SEQ ID NO: 290408 - DNA, 135 bp, Homo sapiens; identical to SEQ ID NO: 290402
  misc_feature: GYAE6OF01B4SD5.49.34.D01.1.454.CMB.1.raw
  modified_base (135)..(135): a, c, t, g, unknown or other
  misc_feature (135)..(135): n is a, c, g, or t

SEQ ID NO: 290409 - DNA, 174 bp, Homo sapiens
  misc_feature: GYAE6OF01A6UBX.49.34.D01.1.454.CMB.1.raw
  modified_base (173)..(174): a, c, t, g, unknown or other
  misc_feature (173)..(174): n is a, c, g, or t
tcagagtcgagagacacgaccggtgctcgatttagatcgtctgtgttgggtttgggggaagaggaagactgacggtcccccaggagttcaggtgctgggcacagcggccctgggctgcctggtcaaggactacttcctcgtagcactctgagcgggctggcaaggcgcatagnn

SEQ ID NO: 290410 - DNA, 135 bp, Homo sapiens; identical to SEQ ID NO: 290402
  misc_feature: GYAE6OF01BT6O6.49.34.D01.1.454.CMB.1.raw
  modified_base (135)..(135): a, c, t, g, unknown or other
  misc_feature (135)..(135): n is a, c, g, or t

SEQ ID NO: 290411 - DNA, 163 bp, Homo sapiens
  misc_feature: GYAE6OF01ED91G.49.34.D01.1.454.CMB.1.raw
  modified_base (135)..(163): a, c, t, g, unknown or other
  misc_feature (135)..(163): n is a, c, g, or t
tcagagtcgagagacacgaccggtgctcgatttagatcgtctgtggttgggttgggcagcctaaggctgccccagcgtcactctgttcccgccctcctctctctcgactctgagcgggctggcaaggcgcatagnnnnnnnnnnnnnnnnnnnnnnnnnnnnn

SEQ ID NO: 290412 - DNA, 176 bp, Homo sapiens
  misc_feature: GYAE6OF01AJNYS.49.34.D01.1.454.CMB.1.raw
  modified_base (134)..(176): a, c, t, g, unknown or other
  misc_feature (134)..(176): n is a, c, g, or t
tcagagtcgagagacacgaccggtgctcgatttagatcgtctgtgttgggtttgggcagcctaaggctgccccagcgtcactctgttcccgccctcctctctctcgacctgagcgggctggcaaggcgcatagnnnnnnnnnnnnnnnnnnnnnnnnnnnnnnnnnnnnnnnnnnn

SEQ ID NO: 290413 - DNA, 136 bp, Homo sapiens
  misc_feature: GYAE6OF01BCK5U.49.34.D01.1.454.CMB.1.raw
  modified_base (129)..(129): a, c, t, g, unknown or other
  misc_feature (129)..(129): n is a, c, g, or t
  modified_base (135)..(136): a, c, t, g, unknown or other
  misc_feature (135)..(136): n is a, c, g, or t
tcagagtcgagagacacgaccggtgctcgatttagatcgtctgtgttgggtttgggcagcctaaggctgcccccagcgtcactctgttcccacctcctctctctcgactctgagcgggctggcaaggcncatagnn

SEQ ID NO: 290414 - DNA, 158 bp, Homo sapiens
  misc_feature: GYAE6OF01CIQWH.49.34.D01.1.454.CMB.1.raw
  modified_base (91)..(91): a, c, t, g, unknown or other
  misc_feature (91)..(91): n is a, c, g, or t
  modified_base (114)..(114): a, c, t, g, unknown or other
  misc_feature (114)..(114): n is a, c, g, or t
  modified_base (129)..(129): a, c, t, g, unknown or other
  misc_feature (129)..(129): n is a, c, g, or t
  modified_base (135)..(158): a, c, t, g, unknown or other
  misc_feature (135)..(158): n is a, c, g, or t
tcagagtcgagagacacgaccggtgctcgatttagatcgtctgtgttgggtttgggcagcctaaggctgccccagcgtcactctgttcccncctcctctctctcgactctggancgggctggcaaggcncatagnnnnnnnnnnnnnnnnnnnnnnnn
